United States Patent 7,868,149 (PLANT GENOME SEQUENCE AND USES THEREOF) - sequence listing, part 46

SEQ ID NO: 24298 - DNA, 5809 bp, Oryza sativa
  unsure (1)..(5809): unsure at all n locations
attgatgaggtatttggtgcgcgccttggacagaagcgtcccagggcagaaatgcacaaactgatgtacccgtatgagtgtaaatgttgttaccgtatcacggccttatgctgtcgccattcttttgtatcagcatgaaatgtgattattcccatcaataataaacctggttccctgcatgatatatgtatgtaattataagtaacagtaatatgtgtaaacgcccactgaacgacacaaaaagctataaaagagtgcataaatcgtatcataattaactggtctaacaaaacaagaacagtaaccttttcattcattgccaattcacccgatcggtctggcaaacaatctgtatatgaaaaggtttggactaacttgttcctgatccctctttggaacacaaggattggtggatctccttgtctatgattaagcccaaagagcctaaagttaccaaatcttcacaatgtgcaacgtatggctggagagaaacatcttccaggttacataaaagcatgtcggcgaatcaggtggcttttatctgattttcgaaaggatggaccagcaaaaattcatttttgaacctccctaagctgtaatctgaattttttttgtacttctgattatcttcttaacttcaaaggactacgggcctgtttggtttggggactaaagttaccatgcctaaagtaagccgcacttgtggcggagaaaaagaacgccacagatctggcaaaaaaaaaaagacacagcgaacttgcagaaacatgcctatcaagttagggcaagcctatggttagtagaaaagcaaataccaacctaagtacttgctgcaggtctaagcttaggtttggcaaaacgtggccaagaaccaaacagaccctacgtcgtgtaaaagctctgctatggacccttctacaaatttcggcagagcttttgccgccttaccgtttcaaaaaaccaaaaacaagataaaactagaacaggaacttcgcaaatttgtaaactcgatgcaaaatccatgttcattagttagcaatattgtgacgccaaggttgtcaaccggaatctcaaggcaaatttctacgaaaagcccctcatcaccatccagaccacatgtacccaatcggacggctcgtacttttcaatcgctacacgaactgatctgaccaggataataaaaacagtccctttattatttgtatgccatttaaatgattatgaaaaaattaaaaaaatcaacgagataaattaatatatgataaataactttacaacatcaaatttaacttctacaagttacaacgaaaataataaatttaactatgaatatatatattaactagccatagtttaatttgttttttattacaactagtagaaattgaattttaacttacatgttgatagagtgatctatcacatattaatccatcttgttaaatttattatcattctttttataataatttaaatgacatgcaaacatcgagggattagaattcactctccatatagtagtataaagggtttatactctaaacgtacctctaaaatctcaactgttcccaatctgaaccgcgcgtatccgatcggacggtgtaggtgacctcgccgccgctgccgctttgccggcctgccggggtttgccgccgccgccgtgtctcactctcacgtaaaatgtggcctctccaggaatttctagttcaatttttcaactcgaaaaactgctgccggattctatataattatctcatgacctgaagtacgcaaatattaggaaatgacaaaatatcaaataattagaaggggtaaggatttaatctcaggttgtctagcccaccaccttataaaactagccggaatacctctggacgtttctcctccatggcatgaagtctgaactctgaagttgcaaattgtcccaaatttgaatgtggaaaggctgttccaggtgacgtgtgtcacagattaagaggacatcattaacttccacactcgagtggattaatcgaagccaataataatggattcatcattaaaatcgatcctcatccacagcgcctcgctgctcttccaacaagaagttcagaacacactctgacatggctcagtaattctttactgttcgctcaaattgctacatattatacagattgcagatcaaagtaagaaacgctgcagaaacaaactgaaagtttccggcgaaagcacgggagactaacctggacaaaacaatcgatcatggcaaacacgcacggttaatttctcccggcttcgacgacgaggagacatctgaaaacgaagctgagacggaggcaagcgtacaccaccaatggaggaagaagaggggtggagactggagacgacgatgggtggccgtgcgtgcagagcgaggcaaagcgaagaagagtacaaagattcgcacttcgcggcaaaatattcctaccgcgcgagcgaatattcctccgagcgatgctggatatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctctctacagcgacggcggcggcggcggcgaggtgagaggaaggagaaggggatcgaggaggaggaggcaagcgcagccaccatgggagtgatggagaagctcaagatcttcgcggtgaaggagcccgtcgtcaccgcctcctgcctcatcgccggattcggtgcgcttccctttctctctcgatcctgccgtggccgaaaccctagtagtggcctggtcgtgattcctcgcccccattgaggacgctggtgttgccttgcactgggcgcctctgtttagctcgaattcggtgaccgaggattgattctaggactctctgggctggggtggatgggttcagaacgccttgatgtgattttttcgcttgctaattttctgttggatctagggttctcaaatcgcttcagaggtgttcttctttgcaagccagtagctctgcctgttccccatgctgcgtggctcaagatctcaagtagtctcatagttcatactccataagctatacttttttttttttgggaaagataagatccaattgttccttcccagccaaacagtctggtctgttgaatgccacaagtgttaagcagtgtgttttgttcaaacaatttcattctttagctcagctaaatggagttggcctgtgtaagaactaagatgcaccttgtcgatttggattaaaaaaaagaaggatattctatcagctgcattttttcttcactggtatttactagtaatatatgtctctacgttgtaatgcgccaggcccatataagtagggatgggttataacgagattagggataaaacattggatccggtggttacctatgaacgctactcgtgtaagcggtgcgtgcagtgggaggagggggcagattggcagaaggacttaggaggacgactctgcttttaaggttgtagagaaataggttggtaataatgactgataaaggtcctttgaatctcgtgctgaaatgtagtatccctggggttccctggtaactctgaattggtgttgaaacgcttgcttagtttgcattatgctgccaggggtgaaacttgaaacggtgttgaaaaggttgagggtcttcctttgtctgaactaactaaagtctcttcctaaataccagcactggatgccttctattaatcactggcttgcagaaaatggttgatgcataggaatacattgaggccacatgaacaatgagttgctttgtggcttgggaaagtgaactagctagattccatgtggttttgttctatttgaaaattacaatgattagcaatttttaagttcaatactttgcccgatgtatgggcacactaaattttctttaggaaaccctgattgtgcaaagtatcattcagaatttttttttgaggcaaagtatcattcagaatttcagaaacatgtctggagctttcccgtataatagtaaaattttaatattatgaaagtgctcttaatgtaaaatctaagtatataatttgacgtagccagtttagatagttctacatgtatttggtgatcaagctttagggatgttgagaatggaagcattaatcagtcgatttcctgaaattgcctttaaggcttcaagtttttgtctagttttgttttttgagaaaaaaatttgattagctcttagtatctttctgcttgtatttaccagaatttctgcctttggttagctggtttgtacttcgtatcgcgccttcattgaagttcctcagtagcgcattgttatttctatgttttaggtcttctctgatttgcttcctttagcaagattgtaatattcttccctgagacttttctcagtactcttcatgctagaaatgagtgtgtagaacatccattttgttgcattaagccattaaccagactgctttaatgttagttaaacatttgaacaagaaactagagcaaatttgattcctgagattttctggtatgattggattggtctatggaattattgctcatcagaggagcactctgcatgcttctatcaaataggttcagctgatcttattatttgcaatttcaggtctttttcttccagcagttgtcagaccaatgttggattcttgggagacagcaaaacaagttcctccacctgcgctgaatgatgtatgtgattcctctctgttttttagtacatcagaatgatctgcaaccatatcttagtttctgaccacatcatttatcatgtccttattttgtcatgttcataatgtgccacccaagatatgtgcaagcactagacagtcttatgaaaattatgaagtaaacttattctttgggcgttgttattatttggggcaanngnnaatnnacnactacttngaatnnntattgaaaaactgccactataaaattgcaaaaatgccattaaaactgtcattcgagtggcatccttgcaatattaaaaaaaccagtggtaaatttgcaattgcccctgacttattatttcaagtaggctgtaaaattccaggattgagcactctgaatattcgactggcaacctagactgaattgcacaggacctttaaaagattgtgccatgttaccgattcctttgttgacgactttgccatgcttcacctggttatctccagattcacattattgaagtactggaatatcaaccccgctccattgagaacaccagtatttaattccttctatttttggtacttctgcaggttgttgcaggcgtcaccggcaagaaaaaggagtgacttggcatcttttccacttgctaatgttgtcgcaacgatttctctttgttttgactccggatgggaagcctctcccagtccagatgattaggatcatccattcatatgtccagcacagtgtgaaaacagtactacatgtgatcggcaaaataatcgtgttgtacctgaacttactttcaacataatgaaattaatgctgcaattttcagctttgagcttgcaagcaaagcgtgtggattgattggtagccttaacctatatcgtaaaattgctggtgccgattggttctgtgaagatttacaccagcagattagttgtggcaaacattctcttgtgtgcagcactatcgtcagtggccacgcttgcttgagcaagctg

SEQ ID NO: 24299 - DNA, 8036 bp, Oryza sativa
acattttttattgtagatgaaagatcatttcatctacaattcccctggtttctggcgatggaagaaatactgcaaatctgttagcatgcttccctaactactacatttttttcaaaaaaacctataacttaattaatcatgtgttaattttaaaaattcttcccgaactactactacctttttttcattctgtaacttaattattcatgtgttaatttaaaaattctataacttaattaatcatgtgttaataagccactttgctattcgtgccgaagaggaaaaattttgaacttccttgttcgatcacattattagtgcaacgacgactgcttatggaaatatataagtttgtcgtgatgcaaagtttgatcacgatagcgcgacgcaatatacaagtttgaatacgttaaaaaaaaccatgagaatttgttatagtgtacaatattcctagtggtttaatttattatgtttctttctaatattaatttattattgtatcatcacgcacgggttgatatatttagggggaaacttatattgttattggataatgctctagatctactcatatatagagggttcgagttaaacatagggttaaactgaaatctagagagggtttttacctctcttttttaatcactactcctgtaagcatttgttgtgtaatttagaagaggtaaaaagaggtaacattcactactagtggttttgctatttctattatcaatagtcctgaatttgttgtgtatacagtggtcatgactctctatattgcatgagtgcatgaccttatgggtcttggtttagtaaatcactagaaacgttatatgtgttgtttggttaattttatgaatgttttgaactgaggatatatctcaggacaattgtatttggattttggaggtacaataattggctttaagatattttttgccgttttgtttgtcttacacaatcacccatacagtccaacacaagtaattcatctaattgtgtacaggaggcgcgcccatgatctttcttgccgttttgtttgtcttacataattagttgaattatatgttgtgcctccacgtcacaggtggcatgttgtagcctgagtgaaatgtcatatccaatatactctgttaaaaattgactaggagacctttatactctcaattgtcaaaaaaaaaaaaaaaatcaacctagtattggatttgatgttttctatattcagattctttgtactagaaaacgtctcatccaatactagattgatttttttttgggacgaagggagtaagttattatgcggattatatattctctctccgtcctataatataagagattttgagtggatatgatatatcctaggacaataaatctgtacatgagattttgagtggatgtgatacatcttaggacaatgaatcattgtactacttcctccgtccccaaaataagtacagccatggttttccgcacccaactttaaccgttcgtcttatttaaattttttttgaaaaaaaattaaaaacataagtcatgagtaaagtactattcatgttttatcatctcataacaacaaaaatgctaattataaaaaatttcgaataagacggacaatcaaagttggacgcggaaactcatggctgcatttattttgggacggaggtagtataagatgtgtcacatccgcacaatatctcttatattataaaacagagggagtaggatctagacagagttaggatagaatacaatagaccaggggtgtgtttgagtagaaggagatcggggagattggaaagatacgcaaaacgaggtgagccattagcgcatgattaattgagtattaactattttaaatttcaaaaatagattaatatgattttttaaaacaacttttctatagaaattttttgcaaaaaatacactgtttagtagtttgggaagtgtgcgcgcgaaaaacgaggcgctttctcaccctatatcacacaaacgaaagcagcctaggagaccttatgcgataatacaagaaaaccagtctagcaatcaacgtgcaattttgtacaaatactctcctccaacccttgggctcaattagtggtaactgggctgggcctccgtgggccgcctatttcgcaacagtccagttagtctggtgtttcagcccattcagtaatacatgggccaaggcagattagagcagggtccaataaggtccataaagacccgagcaaacctagggtttatgagcacggagcgtataaaagcgagcctccacgccgccgtccctccctgcagccaccaccaccacccccacaccggagcacagcgaggcggcgccgcagccccatcttctccggtgagtcttcgtccctcaccctcgccttctcttacggaaccctaaaaccgtatgatctctactagtacgatggatggatggatagctcttagttttggtcagttcgatggcatttgctcgttctgctcgttgtctaatatcttctacgatcctatccggctgttggtccagtagtattactgcaagaactgtaagcttagttcgagatttttcttgtagacgatttgttacctacttagattttgtttactagcgggttatttgtttcgctcggttagatctggtaatataaaacgagccatgtagcgattttgatgtgtgggggcacgaactgttcttgtcacgagaaaggttgtaccccagatttcatttgcaatcgatgccaattctgggcaaatgttgcgttataataatcatatatatgggtcactttttcctgctgatcattagttacaggatcttacagtaggttgttggttttggttatgtaggcgaagcgaaatggcgacggttccggagcctttgatctgggagattgtcaagaagaacaactgcttcctggtgaagcagttcgggaatagcaatgccaaggtgcagttcaccaaggagcccaacaacctgtacaatgtccactcctacaagcactctggtcagtagtcgcttcttgcaacattgctggctttttgatggaaaccaagcatttcattcagcatctgcaaagtgctgacttgggtgatgatgtgttttgtaaggcttggcgaacaagaagaccgtgacgatccagccatcaggcgtgaaggacgcggccgtggtcctctccacaaccaagaccaagaagcagaatgccccagcgaagctctaccacaagtctgtgatgcgcaaggagttccgcaaaatggctaaggctgtcaagaaccaggtattagcacgtgaaactacttctttgcatagcttcttgtccttgttatgccttgcgatgctagaagctttaaatgcactgctatgaacataaagcatcctatattttggcttcattactcttttcttatttactgctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacaattaaaactcatacaatgttttttacagaagttggtataacttgctgttaaaaaaacagttaggtgtcaatgaactgcaagttagtttgtgagaattcctgtttttcgttttcagaaccatctttttttccctgtttttgttacattgctaattctaactgctgctgtgataagccgtaacacataagaaggccaaccgatcaattggttctttgatgaaatactcttgttacacttggcttctgagcgtcttatactggcatcatgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacacttaaaactcatacaatgttttttacagaagttggtataacttgctgttaaaaaagcagttaggtgtcaatgaactgcaagttagtttgtgagaattcctgtttttcgttttcagaaccatctttttttccctgtttttgttacattgctaattctaactgctgctgtgatgagccgtaacacgtaagaaggccaaccgatcaattggttctttgatgaaatactcttgttacgcttggcttctgagcgacttatactggcatcctgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagacgtaacacataagaaggccaaaccgatcaattggttcttcgatgaaatatatttgttacgcttggcttctgagctgaatctgcctctagtatttcttctctatacggcagctttcctttatgtaccttactgaacaatcatcagtagtttgttctttaatttgctgttattctgcccttcaggtgagtgacaactactacaggcctgacctgaccaagccggctcttgcgaggcttagctcagtgtaccgcagcctccaggtttccaagtctggtgccaagaagaagaacaggcagccaactaagctgtaaatcgcttaaagctcgcttttttttttgtcaaggggcctcgtggtgttcatgtttccagctacctctgttcgtaacagtgattgagacttgaattgatatctatgctagaattggatcaactatgctacaaatctactctagtttgtactcgctacaattttggtctgctgtgtcattgttcacgttgcacttgataatagcagctaagctaatgtcatcaaattgctggtgccgttttgctttgtacacatccccgtgtagcttctgcgaccagattacctatttttgatcaagctgtgtagggttgtggcatgatggcatcaatgtgctgttgccatttgacaaatcattctgcttattacatcaagcacttcatacgttagtgagagcggggcgaggatcttttaccatagggaaaattggttctatgccatcaaaagttttcaagttttgctttataccatcgaaagttccttttcaagttttgctttatacctcgaaagttcctggtgattttcctaccataatgttacatgggtcatatctttatactccctcgtatttgaccgttcgtcttattaaaaaaatttatgaaatatataaaactatatgtgtacttgaaattatatttaacaacgaatcaaatgatataaaaagaataaataattacttaaatttttttgaataagacgaatagtcaaacacgtactaaaaagtcaatagtgtcaaatattttgaagtatttgcaatgataatgttattatggtagagaatgtgaacccgtgagggagatgattttgcattgtgagtttctgacaagcggaagctctagaaagttctgccactctgtgagagtgcaaagctgttgtgatgttgcacttgcacctgctgctgctgctgaggcccgaagcgttgccggaccgagcggtacgccatgagcccgagcttgtgcgccttctcgtacatggtctccggccgcagcggcgcgacgtgcaggccgacggcgtcgagctgccggccgctcctcccccagaacccgacgatggcgccgccgtccaccgggaacgcgaacggcgtgccctccgccgcgccgccgcctaacggcccgtactccctccggttggtcctgaacgccagccacctgatcaccgccggcgcgccgccctgcgccaccgccgcgtagtgcccgctcaccgccgtcaggtactcctccgggaagcccagcttgatctacgtcccagccaaacagactcagggggtatttagatacatggatgtaaaatttttgcatgtctcatcggatatacggatacacatttgaagtattaaacgtataataataataaagcaaattacagatttcgtttgtaaaccgcgagacgaatttattaagcctaattaatccgtaattagtaaatatttattgtagcaccacattatctaataatgaaacaattagggttaaaagattcgtctcgcaatttacacgaaatttgtataattagttatttttttcgtttatatttaatacttcatacatgtgtttaaatatttgatgtgatatgttgaaaatttttgccagggatctaaacaggccctcagctatggctgtgccaagaacattacaaggtgcagatggtattgggtgtgcacctgggtggtctggttgccgccggcgccgccgtgccgctcgccggcgacggcgacgccgttccggtcatactcgacggcgatggagtcgatgcaccggtcgtacgacagggtgatgctacgaacgccggtgtgaccgccgtcgtcccaggggctccctccggtgccgccccatggcccaaccttcatgatcttcttggacacaaccatcttcttctgaggttgctgctcctgcaaaaaaaaaagggatatcctgtataattgaagtgtatgagttgctcactgaacttttggatagaaaaattcagatgatttttctgttctgcaagactgaaaatgaagtgcatgacttgcataccatgtttggttcagatatgttaagaactacaccaagtagtaaggtgagcagctaaacttattcagagaacaagtgcgctaacagataaaaatggatagggatttttttttgtttgcaggaaacaaccagatggaagaacagaaatattaggatatataggaaaaataccacacagtggcaattgggtgataagtgggaatcagaaccggatgctgtaatggcagtacgctgctttctggaaagctaagcatattgtacaggaagtttttgttctccaagagtccaagtataaattccggtaacatgatcctgccaatacctagttttcagttcaatgttaccactcctggtgattttttatttacatatcgcagagctttagtgtagtacaagttttttagggaaaagaaatcaaagtttgatattttggaaaataaagccttcatgttatttttgttcttcttcttatatggaaggatatgcagctctcctgtctattcgagaaaaaaaaagaaaaaatgccttcatgttgaatcatgaattgctcacttaaactccaagttcataagcatttgcacgttaacatcagataaagacctgaaacaaatgttgtacctcatgtcattacagtgctttgaaaaacagaaatgaagatgtagacagtggactcatactcataggtaactcctagaacttagttcgttccaaattcgtctgtccccagtccccactgaacaactcaatcctttgaattttctggaaataaactcagtccaaattggacgcatgaaattcgcataacacaatttatctcacatattattacatgcctattacgcagggttggtgcccagaaataccattcatggccagttgggattgagtactactactgctgaaccaatgttcaatacaaccttgtttgacagcatccagaaagtctgaaaacacaaccagcagttgtcgttttctaacttcagatgt

SEQ ID NO: 24300 - DNA, 2323 bp, Oryza sativa
attatgaactgctaattatagctttggtatgcatgattaagtgattaacagttagcagtctcctgtctttaagctatggttagaatccacttattgttgcaaatctacaatgagctgtctgatttgaatgtggggcccacagccagtctcctcctctcctatataaaggcacacactctcctctaacccctctcacaaatttctcttcaaatttcaaagcacacaaatttttctttctcttgcagtattattattactaccatggcatccaggatcttgtacgcagccgccgtcgtcgcggccgtcgccgtgtcgtccctcgccggcgtcgcctacgccgccgacgccccggcgccgagcccgacctccggcgcggccgccgtctcgtcgtcgctcgtcgccgccgtcctctgccccgccgtcgcgctcctcctcggcaacctccgccaatgagcttgaagatcatagttgaatcgaatgctgctgtcaaacatgcgtaatgtgctacgcatcgcgtgatatcttcttcttcttgttcttcttctgtttgagattgctcgttttctgacctgtgtggcatgtatttttatcgattcagttaagccaattcttccaccagcattcatccattttaatccagaatttattggtttcagcccttaaaagctgactgatccattggttttaatggtaaaacaggtggctttggaagtaaggtttctttcataaaaaaattttgggggacccaaaaatgttaaaaaataaaataaaataatattttaagttaccaaaattttcactagagaatgttatacctactgataaaaaacgtaaaatcactttctttcatagttaatcagtagtggcgtattatttcaaagaaaaaaaagagagaaaaaactgtagtgtcgtagtctgctttgctctttctgtttggacaaagcacatatcacttccttttctttctttttttttggtattttctcatacaatttacatcccattcctagagagaaaaggtgaagctttagttgggatagaaaggggttaacaaatgggataaagcgtaaaagcagatcagtaaagcagccatctcatggctgtaaagcagcaggcgtacacgtacatgttggaattcctttcgaattgtttaacatatatgctggcaaaaggaaatgtatataccatagttgcagatttgcaaggacatgcgttgcaattctgacatgaatcggatgtcggatttttcatcggatctccagtttcctacgttgcaaatgtacaggatttagcagttcagaagtactccagtacattttagggcctgtttagatttcctggtaaaatttgtcaccctatcacatcaaatgtttggacacatgcatagagtattaaatataaacgaaaaaaataattaattatacagattgcatgtaaattgcgaaacgaatcttttaagcctaattgctccatgattcgacaatgtgatgctacagtaaacatttgctaataatggattaattaggcttaataaattcgtctcgcagtttataggcgaaatctctaatttgttttgttattagtctatatttatatccgatgtgatacgccaaaactttacacccatagataaacacccccttactgtgaaagcgagcgatgaaattgcaatgacacgaatgcgacatgaagaattagctcgacgtagagctgtcagtcggtttcagaccacaatggaatacaatggccattcaaatcgaaacgttcgacagttttgtctgctctgaattacaacagaagatttacgcctggcattatctcactctctgaatttacagcaccaggtgataaaaatattgaagactatcagattcgtgttaactgctattgtcatgcacagggcaagctacacatcgatcaaactggactggcctgagcagtgtgcttcacattttaggtagcaagacgtatacatgagaaacttggaaaacattcagagccgcgttgctggtaggcagacagcagacagtgttcagagcaaacatatttcctgcagcctctgtgttcttctgtgcagcttccaaattacgacagtccagtcatcttgatctcctcaaattaagcgcgagaagcggcgagcccgtgattgttccatcagaaagctgaaaaatcttcagctaaatgggtatgcgcaattatctcctttctaatgttcagctgcttcgtgttcagtgatcctattattcagagtcgctgtccatgttgtgcattgctttcaaccccctggggcgctgtgaaaccagaaaacaatcaaggaggctca

SEQ ID NO: 24301 - DNA, 10917 bp, Oryza sativa
ccaatgttagattctgaagcttgtctggccgaaaaggagaacatagagccaaaaatgattattttttttagaggaaaaacttggctggagctctgcctattcatccgaggagtagtagaattagacaaaccgaacactttgacaaaattgtgcatttaattctcttcataaaaaggttgtgtacatctaacctccattaagcacagtaactgtatgtttaatcttcagtaggcagtcctgtgtttttcttattagtcaagcaaaataaggtgacagataatctattgctagaaacaaaatgaacattcaacaacagtgactgatttcgcggtgaaaactggataaatagatttttatctctaaatcttcttacagcaaatcattcttagattctcacatagggagaaatggagcaccaaaaatgcatgattcatcacattttgggggaagggacaagtaagcaggcaataaatttcagcaattacctatgtcatgtttcatcatctccagataagaaacaaagtattacaggaagaaagagaacgtcacaatgaatgaacaagttgtcaccatccaccttacgagtggttgtgactgacttgagataaatatggtgttcccccctcaagccaaaattagtcgacagaaaattagctgagactagcatccaaaggcagaccgaatgtaattatgataagctattagcgtcaacctcatacacagttgtttcgcaaagaacatcgttgtagcaaagccgcatacactggatgaggcaaccgaaacggaagcagccttcacaattggcagttccgtttcagaaaagaactcttaataattcacatatggccctgacctagatagagatcgacagccaaaccaagtcagctaagttggaaccttggagatagattgaccaaaaaattcagcaagtaccatcttgcttgttattgaaagaacatatccctcaaattgtccaatattttagcctttcaaagacccaatttgagcataaaaagtaacacaatcacccataaaaagtaaaaccagtatctagcacaccagaatcaaacaaagaaaattagtgtcaagaccacaaaaacatcatggtcttcatttcacatcccgtagacaaacccaacgattttggacaccataatcatctcccgttacaaaccaaaaccatcaattcattgcttataatgtgtgcctacatcaatatataaaccactatttgtgcttagtaacctctgcatcatacagtcacaacggcaatgacacccaaagtgaaaccgaatcagatcaagaacactaacgctgctcgatgtcacgtgcccggggcagccaatcacgtgacggccagttgttctttcaacgcaacagttactccaaatcttatcgcattagtttaactgacgcttaacaacaaagcagtcagagagcacacgcaacgggcacggcaacatcgcaaataccaaaaatgatttttaaacaaaaaaaaaagaaataaaaagagagagaaaatggctacctgacagcgcggtggtgggcgtggccggcggttgtgtggtggcggtggtggtgagccgccgcggcggcggccgcacggcgctggctagccgcggccttctcggcggccacggtggcggcggcgttgacgtctcggcggtgcaccttgacagcagagcagccgcttccggttgccccactgcaggagcaggtcgcgctccgccgccgttccgccgccgccgccgccgccgcgggtggagccccgcgtgtggtagtgattcctcgcctccttctccattgccggaccagagctcgccctgcacgtgtcacagcaacaaaaaaaaaaagaaaagaaaaaaaaaacacagaaattcagcagcagaagggaaggaagaaagattcatggtgggaagggaaattgctagaatttcaatcagattggaatagtgaagaattgcagaggaaattgctttgaggacagatcagctattcagctcagaccaattggtctaaaaataatctcaagattttattacaaatcttccgctttaattctccgtacgaactaggagaagggcaagttcaacaaactttagctcaatttcaccctccacccaaaagtaaaaaaaaaaaaaatcttctcagctgcccgatcaaatgaccggaacaagatgagacaccactaaaatgcaactcaattttaaggggccgaggaaatcagccagataaagttgcaaacttttgggagttttgcgaccactttgctttcaaaaattcagactgaaaccttaaaaaaaattcagactgaacgaactcaaaatcgggcaagaatcagacaaattaacagatcgaatttaagatgaaggtagatattcagttcaatttaactcatctattctggaaagaaaaagcaacctagataaaggggagaaaaaacagaacgatacaattttcggtaatcctacagtagagaaccaatattgaaaattcaacacagaaatggacagtgaaaaagttagaaagaggggacaacaaatcggacaaaatttgagacgagaacaagaaaacggcgagcagacgaacaagccaatttgggagcagaaaaaacaagagtaaaatgtgctaacttggtgaggtatacaaaatcatcaacacgagagaagcaaaacacaggggatgacccaaatcattaccagcatcctacctaaggaaaatcagctccctctttccaatcgacctactacaaggaaaaccaaattaaaactgacaagatttgtgacgaaatcaagtcgatcccaatcagaacccccaaccgcgcaaatcccaagttaggcagctcagatatgaagcacacttgatgcaactaatgcgtcttggcgaaattggattcaaattacccagtctgaatcatccctcactccattcccaatcgcagacagaggcgcagacaacggcagaagaattccagcacaggaaaaagcagccgcaaaaaggaatttaatcccgggggaataaagagggaactgaatcttccagatcaaacaaccaattagcaagaaccgaagaatccagaattcgaacaaaccacaagccagaactcacaacaattcagaagggaaaatttatccatcactgtgaaagtaaaacttttccaactccaatccccaccaaaaattttaccaaacaaaacaccacagagacaaccaaaaacgcagcgaatcaaactgttaagggcagtacctgcgaacacctcgctccaattcacctgacaaagccaaagattcctcactcctctcctcctcctcctcaagaacaccgacagatcaagagaagaaccgacaaaatggattcctcaggctgcggtgagaagagtacggaacccagagagagaaaatcgggacgcctttgtggccggccgtgttcttcctgttcctcccccccaccaccagaagccagagccagaggaagaagaagaagatgaagcccattttatatgccatctcctcccctctctctctctcccccacttctcgacccgtctcgggatgagcacaccaaatccggatcctatcagcgcctcgctggcccgtcctcagccgttgatctacagatcgacggtccagatcgccccaccgcgctcctctccgcggtaaaacgtgcaattgcctcgctcccactaatgggctgggccgctacatggcccgtagaatgtgggccgtggaccatgggccgtatgacgtgggccgagtaccgtgggcctgccgtgatccaattcccggccgtttccgatgcgattcggccactcgatttcatgattccgatcggaatcggaatcgcgcctctgcggaatccatatatattcgccggctcgccgccgctctctccaccgaccaccatggctaggatgaagaagaagggcgcgctctctcgcctccggacggcgacgtcgcgcgcggccaccgtggctaggcggaagggtgtcgtcgtcgtcggtcgcgccggggactgcggcggcggcggcgaggaccgcatcagcgacctcccggacgacctgctgcgcctcgtcctgcgccggctcgacacccgcacggcgctcgccacgggggcgctctccaggcgctgggcctccctctgtcgcggtctcgacgccctcgacttcctcgtcagcgacgtgctcccgccgcgctaccaccggtgccgcgaccacctcctcctccaccacccccacgccactaaaggcatcgacgccgacgatgccaaggttgtcgccggcaggtacgagcgcctctccatgcggaaaatggtggcctccatcgacagcttcctcgacgcggcgccggacgacgacgaccccgatcgacggaggaggatcactaggctgaggctggagttcatcatcaatcaccactccgacagcatcaaccgcttgatcgccacggccattgatgcttggggggtcaaggatctcgagattcttgctgggacgcccgcgcatcagctacggccgctggaccgcctccacatcttccctcaccaaggtatctgctctgatccccgcagctccactctgacaagcctgacgctggctaactgcacgatcccgccattgcaagggttccaagctctgaggatcctcgtcttgcagcatctgccaagctccacgcgtccagcagactacgaatcggtgttcacttcttgcacacagctgcgagtgctgcacctcaaatcctgcatgttcgatggcgttctacgggtaaacgctccgtgttcatcgatcgagcagcttgtgttcgaccactgcggcggtggcctgatcattctctacgctcttccaaagctcgaggagatggccgtggtgcagacctgcgtatggttccagcgtggctccatgccatgcctcaaacgcctgaacctcatctttcgatacaagcatgatcatcactccacctccatgccttggggcatgaacctgatgcagattgctgagtacaccccagaaataacagagctgttcctggagttcaccggacgcggggcggcgacgatggatgcgccgccatcatcgccattgccgtcgctgccaaacctccgaaagctcgtggtcgtcgtgccatcgtcgtgggacgtctcatggccgcgcctcctcttggaggtggcgccatgccttgagatcctccacgtccatgtcgccgcctgcgaggacgagccccgcggcgagatctcgtggcggcgatgcgagtcgcgacacaggaagctgaaggagttggggatgagtggcttcgaggggacgggaaggcaggtttactttgttaactttgtgatggaggtatcattagctctgaagtctgtgagtctgtgcaaatatgcaggtgtttactgggactacgacattgttcgtgaagatcgtcgttggagcagtgacgacagagctgatgtactgaagcagatcggtgagagagtttcttgcacagatattccggttcagttagtccgggagtgatttctcatgttgactagctagtaagtttaatagtgtagtcaactaatagctctaaatcatctattgctaatctaatagtctattcatataataattgtctgtaaatatatatattatattattaatatctggtcatatctctcatacacattaaaaaaacatctctcacatacacacaacgtattaaatttgtagtccgtttttattctctctcctatgttatctcctccacatatatgtttatagttagcttatagtatgctattatacttgtgctaacaagattgaattatgtttcttattaagttcttaggtataactttttataggctttgcacccatcaatgttaattttattatatgtgaaatagatttgtaagtttcaaacaattaatgtaagatgtaagttttggtacttgcattactgaaattaatagtgaagagatgtatgcgattaggacccgtattgaaccctaagttgcatacatgtggtgaattaattccttagccttgcaaaataatagatacatatgttcttgtttagtcttccgaattttccttcccaatatgcatggttaacaaaatgacacttctcaatcactgtatgaaatgccagtaaccacaacttcgcaatgtacattttttttccaacattgtttatcagaaccaaataattatttgacactcaagcggtaacaaaaaaatagaataaataacaatacagttctcgtgagttctcacatcacatgtaagaaatgcagtaccatgtgacacaaactcttttctccatttctcttgttattttcaggagtccggttatctttccgagttagtccactgtgccctcccttttccctgtaaccccccaaagatcatagttgtaaaatcttttttttccttgctaatatatcgatgcgtaagatttttgcgcattcacagaagaaatgcagtatcatggattataagaagatgtgcagtctgccaggcaattcagtaatagacagttaaagcaaccaaaaaaataaatagacgggaaatggtcattatgtgattaaaaaccatcggaacaaccagaattgaacaggaaggcatagtgattccactcaggtttgtacatagtagttttttttttcgaacacgtaaaaactttgcatgtcatttgtattagaagctataaaaaaatcaatttacaaccaagcactgggggtgggaaagggagagaatacatacgccagctagcgactaagtaaagacgcggcccctgaaaaaagagggaaaacaaaggaggttgaggaaaagatcagaggggtggatctactcgcaaaagaccttagaatcttgtcagttcaagagctttcatgattgatgccatccacatcccgtggaaatttgtctcatactctcaccaggtaagaacatatttctgcaagcatctaaatatatgtaggaatccatcctctcagtagaatattattaaaaatatataagaacagaggaaggtattactttatcagttcattgaacaaattgtttcacatagcatggtttatgctattgcagcgggactctccatcttacctttgaaagaattgcttcagcagaagtttggacagaggatggcaaccaaaacaaaacaataatgctactaaaaccatggactcatttcagtcgcaacatttcaatttattaaaggcaaaactatatccacatcatgcatgtaatatacagtcgcttttcgacatctttcacatgtaactaacaaagtatagatgagaaggctttcccaaaactacttgaattagagtaattgagcactaaattctatcagaaatctggtattgctgcatcagtagtcatctcccaggctctatgaaccatgtatacatgctcactttttaacaaagcaacaagctacagtaccatcgatacttctactacaaaattaacaaactaaaacagtctttctgttccctcagatcctactatcatcaactctattagctgagcatgccaacttcaagggggcaatatggattcaagagactctctaggcatccatggtaaaaagacacagcagcggtcaaaagcctcctgaggttactaggtctgataacttaagctttggatacaaaacatgagagatcactcaagaaatacttgaactggagttgctgagcaagaaattttatcagcaagctgatccagtatttttgctctctcctcatcacaccaacggtgttgttgcctcacaatgttccagtcccagtaacctatttcctgaacacggccatactcaaggaaacaagctccagtaccattgacacttcaatgacaaagttaacaaagtaaatctgtctctctgttccttcaaaaccaatgatcaccaactcctttagccgtttgtgctgcaacttggatggctgccacaaaatatcattgcaagtctctccttcccaaggggtaatatggatatgaaggctctccagacatggcgctgcttctaggaggagtcggggccaagagatatcccatgatgaaggcacatcggcaatcagaagcctggtaagctttggtaacagcaacgaagggcacgaaggccgaaaccatctttcatatccggtgaatcgtataacctggtcagttatgtctggagtgaatccaagatgcggcttgagatccaagttcgcaggcaagcaaaagttaagtttatgcctgagaccatcgcgtttgaggttcaggcgcacgaggcgcgggaaggatccaagcttgtaccgtacccaggtctgcatgacaactatactctcaagcattggcagagcgtgcagctcaaacccagggacgccacaacactccagaacaagctgcctgatcattgacctgggggcatcaacgaaaacactactgccgcgcttgcaggggcaggacttgaggtgcacctcttgcaactgtaggcatgagctgaacacactgcttcgtaggctgccgcgggtgtggagtcccgcaagtcttgcaggaccagcttggtgagagcttggaacccctgcaatgggggaatcacacagtccaccagcttcaggcttcgcaaacgggatctgtgcgggtcattgcagagaccatggcgacggaagatgtgggcatcctgaaaatgatgccgccaatacgttgtcctaccaagaacctctagatcctcaactccccaagtatcaacagccttggcgaccaagcggttgatgcagtcgtggtagtgtgtggcgatgaactccacccgcagcctactgatcctcctccgtggagctccgccgccgccgtcgccatgggcaaaaccatcatcggcgtcgaggaagttgttgatggaggcgaccatgtttcgcatggcgaggcgctcgtgccgcctgatgctagcaacgatggttctgagctcgtcggcgccatcgaacacaccactggcggactcgtggagctggatgcaccggtggtagcgcggcgggaggatgtcgccgaccatgaaatcgagagcctcgaggcccgcgcgcgcgaggccggaccagcgcctggagagcgccgcggtggcgagcgcggagcgggtgtcgagcctccgcaggatgatcagcagcagatcgtccgtcaggtcgtcgatgcggttgtcgccgcaagccgcgggcgcccgccggcggcggcggcggcggcggcgataggacgaacctttcctcctcctagccatggcggagtcgcgcggcggcgtggggtttggcgcgcgcatctgatgccctgagatcgcaatggcgtccccgcggccgcgactagatagcatccgccgcgggccgcagctggaatccgaaccggaatcgcaccgaggccgcagctgctcatactattcggactcgattcgacgggtggctttggggatcgggggggaggggcgatgaggcggtgacgccgccggaatccagtggagccatgggaggaggaagataggaagcgaggccgccgaggctctggcgccggtggtttggcggatccagcggccggctccggcgccggtggcgagcggcgacggcgaggcggtagggaagaaggattaggcctaaaaaaataaataatagaaaatgtggaaggcccatgggtgaaacctggcaagatttcattgatgggcctaatagtgcgatatccagcccatctcacagtagatgggcctgatattgtgggctacccccaactcctccccctctccaagagcgagaagcccaagctctgtcatctatctgtaagatacaaataattagagcactgtgatttcatcttggttttccagtaacttctaactgagtttaaagaatcacagttaaaagcattgtttgtaagggattttgatagaatgaaccaatgggaaatttgcttagaacaagctcgttgttttttaatcactagtgtagtaggctgctagtgtgggcatacaaaatgttttatgcttccttcaaggagtatacgagtagcttgattcttatcagaaaattcgagtcacatgtgtaggggcgataatcggtcaagatatatggtttctttcacaaccctacctacctagtacttatataattttagtttaaattgctactttactttatctccatatatagacattcttccttaagatgtttttattctttatagagtatttcatgtcttaaaaataacaacttctagaatttaaatttcattctaaattttattaataaactgcatgtactaactatgggtatgttcggctgctctttgttgccacatgctgcacgtataaaatatcgtcgtataagctgcaacacagtgtaaataagggcagtcgaacaaaccctatagctttattatcatcctaaccaattccgggtctgctcccacccacacacccaccctgagagcaggtacaacagtgggctaatagcctgcttacataggatgatttttgtatatgtggctgagaaagaaaaattgtagagagaaaagcgagcgactatttagtcgccggctcttcgcgcgagcctatgcattttacctaccatgggcccacctgctctcacaacaaccaatggaaaaatgaatatggacgtgaaatactggctggttccttcggagtagacactagcttgattaaaaaaaataaagaagtgttgcctgttgttgtatacattgtagattagctgtctattgttggacgtggcactcggttgcagccagcagtcgccggtactattaaccttgctatgagaatgcaaacaagtccttctaacctcctccatgatatatacaagtgtcactatctaaaaattgctatatatgtttcgatacggatagtgtagattatattcttcatgaaccacgatgtgcacctagaagagcagcatatccagagtcctcat

SEQ ID NO: 24302 - DNA, 1873 bp, Oryza sativa
atttcgccatgacgccacgagtttgttacgcacagaaaaacgcggtgccggcagtgcatgatgcatgcgagtgatcaaaccatggaaacttgcatcgaactctcacctcatgtcaccacaaaaactgcaggtgaaagttcagacttcttcttcttcagagatagatagagagaagcatgaacaataatactcctcatacatttcaaagttcagacttcaaagtgcacctatacacggttgtagagatgttggtgatcggtcacacatagcgatggttggtttggtgtcgattcttttctcaagctgacgtatagaagacatcagttcgtggtgttgtgtttttttttcttttatgatttagcctattaggattataattttatattttttctactatagcaatatataaaacctcgtatttgtctcgtttggtgcggttggtttaaaagaaagaaaaggttcagacttcttcagagacaaagagatggaggggcatactgccattagcacacaggaatagaattgaagaatgctgctgcagcagcagctttggtcagtgcacagtggtggtgttctcaaggtagcaagctttggcagcaaacgaggtgtagtactccagaatggagagaggggacaggggtacactgccacacatgggggtcaggcccaaagggaatgtcttttggcattgggcagcccaaagcgtggtggtaccgatacaccaacaccaacatatgcattccgtttctcatcttgttattcccctagctaagctcaattagctaacccacacacacaaaaaaaagcgagctaaaggcgtgcaaatgcaagatgctacagtgccctgcagccggcaaaagatcaaagatttcgattccaattccaatggcacattggcacatttcaagcccagatgcatggtcgacagcaacaacacccaggaagagatgatcatgtcaaaagggacacaaagcatggatatgtacatgtcccaattgtgtctgatcaattcctgtccaattttctcacatcatatgtggcgtgattccaattcagagatgtgtaggggtggtagctatagtaatcaatcatcagaactatcatgattccaattttactttgtgttttctttgcttgcttgcgttgcatgcatgcattgcaaaaaaaggctgttaaattttagcaacaaaaggagcaggtctttctgatggttttttgcatcgtccaacatggaaaaagttcggcgatgtcaggcagacagaaagtgcatacacctttttctctctctcatttttacccttggaattgaagtacttgggcaaaaaagagatcactgattaatttactcatgtcaatgtcatgtactatacgttattactgcatcgatccatgcaaaacaaaatagcgtttagtacataattaattaaatattagctaacattaattagaaaaatatattaatatgattttttaaagtaactttcatatataatttttttttaaaaaaacacaccatttaataatttaaaaagcgtgcgtgtaaaatacgagggagatgagtcggaaaagtaaaataagaactcagccctagttacacactgttaatcatataaaatcctctcaatcgatcaaaaggtaaaaatgaagcattaatttttatcagcttgaacagcaagagatttgtctcatgcatgtataaaatatatatatgtcactcacacgaatacacaccttgcatgcatgcatgaatcatgcatggtacacagtactacaattgcaaattcctattggatttcacaaagccagcaagtccatctcgcccaaatgcaagtacagtgctattgctagaaccagtagcagcagtagcagtagc

SEQ ID NO: 24303 - DNA, 11882 bp, Oryza sativa
agaaggcggtgttcgacgcggcggcttgcacggtcgtcgtctcggcaacgttcgggaacgcgaacctatcgaggagcccgccgtcgtcgtgcgtcgcgccggcgatggccggcactggcaacacatccaccgagtcaaggaacgccgccgccgccgccgtcggggacgcgtcgccgtgaagagcactcagaccatcttggcaacgcaggaggctcatctggtgggacggcaggtcgacgtcgaggccgtaggcatcgtcagagcgaacggcgccggcggcgccgttgccgccgccgtcgacgagggagtggagctcgaagctcgcgcccaagacggcggcgaggaggacgtcgtcgtcgtcgtcgccgccggggccgcagctcggctggcacggcgcggctggcgcgctccacccgaaggcgtccatgtacatgacgcggtcgccgccggcgaggcttccaaattggctagctaaactcgcctgtagctatctgctgctactaccactgcaattaactgcaaattaaatgagctcgtgtcagcagaaacacatgcaagagtatgcaactgcatgattagcaataaattcagaatctaactcccaaccaaaaatgctgatcaacatacgcaagatatatatctagcccaacagaatctattgctgccaagattaacataacggagtagaaatcaagaagaagaacaaaaacaggaaagaaatagtgttttattgcatcttgggagtacctgattagtgaggatatctgatcatttcagctataggtaagtgccgatctgagatagattctgaagagattggtgtagcatggggacgaactgagcacaagtgcagcgtttgctaggatggtcctctgcctgtgggatggctgggcatatgggcgtcttttataggcggctctgagctagcagtgggctaaatctaatccatatagctggccaaatttggttctttttccttagaaaaaagcaagataagtcattttctctctatctctttcttgcattatgtggggcgcaatcagttggggacagcagagagtactagcacaacaatttcactcgcttaattactaattgacagttacatttgactgctcttgagtcgagtcaatttaggtgataactactgtactagctatttttctttgttctgcaaggttagattaaagaccgtatatatcttactgtgctaagatttctgagattctcagtattatctaaaaaatatttctgaatttacttctgtggttatatggttccagcttattgctttgatgaatattattgccagtgccctcttctgcttgtcttcttgtttcttgtctggtatgaggagttgaggtaacttatctctggattgtactgtatctggcagttttttgttgggacttggtactacatcacatgaaactttggcatttcttcatgtgacaggactaatgattaagcacgataacttgtatagtttctgtaacatttagtagcagaagcagtagtttttaactacaacaagctgaatctagctagcagctggtccaggaagacatcaagatttcctgtccgttttttgaaaagaacaagataacaaggaaggcaggacacatctctgaaacagatgaaacaagacaaatccgtgacacaagcaaacggtaatgcagagcaaggtccttactagatacttattttgatattattttcttgattcaaaagggaaggaaccacacacaatgcaaagtatatatatgtacatgcatcatatccatgataagatgaggaccacatattgatgaggatatgtaaccacaatcgattgcaagataagaattcctatttcttcagaaagaattaataaacaaaggacaagataagaacacaaagtctacttacatccattatttaaatacaatccatgatagatgtacagtactcagctactatggaacatttctttgtaacaagatgtcggttttttcgtcatgcatgcgttcatttttcagaaaagaaaaggttagccagtaccactgaagtagtcaagcttcagattaattagtgcatacggcacatggtaacatatattgccctccattttggaattgtaatactaaaaatcaagtggccctctcattattattttttttctaagaaccctgcttttttattgaaaagttaaggaaaatctcagtacaaaaggagtagacagagatcgagcttgcatggatcttgaatcctatactagtatactgtaatgaacttccactgtctactctcattaattccaggttataattaattactatatgaaaattctgcttcccggtacacatgcatccaccaccaatctaccacaagttggacccaaagaaatccactgaaaaattcacaagcgaataatatatatcattcacaaattggttgcctgctagctacttgccttggagctgataaagtctatgtatatctgttacctatggtcagatatactcagatagatcatacatgacgctcttgtcaattgaatatcatctattgtgtgtcctgtgtgaagaatactaggagcactcgtaatttttatctcctttgcttgagatgcatatgtttggtgtgccttcacacgagcttaattagcagcataacgcttacatatatagcacattactccaaacatatgcgcagttttatctcttttgtcagagtctcagtttgcagccatgcatatcatcagaaaaaaaggatcacgtactacgtaccaactgtggtcacaagacacatcctactgctcttgtccattgcagcatagcacagcaaccatacagtttacactcgacagcaccactcaacatgcaaaattaagtacagtgtttacagcatttgatcatcatccccccctcaagcgtaccaactcataattaaattcagttccggcaaaattccatcacattcgcatctactaggcgactttttctctgtatttgaaaggaacatctagcagtagcagggcggggggctaattaagatcaccacaaacttaattaatcagaatccctggcaatctgtatacgaaaattaaatggaaacagcatgagaattgaattgggagtcgtacgtctgcagcatcaaagtaccaaaagggcggcggcatttagagacggtgggggctccgtctccgcgacgcgtctccggtacgtctctccggccggccccggccgcaaccgccgcgcgagggtccggaagcttggccgccggtacgtgggttgccgcctccgacagttgcatgccacgagtctctactcaatctactagtccattttttttctgacgattttttttctacttacgtccatctgacgggcttggactatatataatctctgaccggtagagccctcgttacccattagagattaagtgacaagtgagtgaaggtccgtcagcgacacagcgaaaacaaaacgttcgatcatttgtaaataaaatagatgattagagggagggctcatcttctttttcctccttcagccccccctccttaactcattctatcaatggtgatccaacgagataggagagagtcgagtccttctagcacccacgatggatccacccttacttgtaagttgtagtgacaaaataaattatagcaaagtaataaataaataaatttttgaataaggtgaatcatctcctccttctcttgttaatggtgacatgatgttatactatctcctccttctcttgtctcctcaatcctcatcagcgcgcgcgcgcgcacacacagatatatatatatatatatatatacgtggctacttggcgttctatatatctcagatggttgttcatgtagtaactgttaacttcagagaaaatctcccttctaaaacaacttcagagacaatccctcaaaagatgaagggaaacaacagtggctaattatccttttatccaaatttagaatgtgtgataatattttaagaactttcgagctttaaaagtccacactatagctgcatttatagaaaggtcatatatgttaatgaagaaagtgatatctactggtttatgtttcaatgtacttttatatggttaattatacgaccttctagttactcatgcaagataaagtattaaacatgtctagttgtatttgtttgcattgctgttggatgcatgttgcactaacagtgtcgatggctagctagttttaggcttgtaggtaatgtgtttttaagtacgtttgatgtacctctgttacatattgatggacgtgttaattgcaaatgcaatgcaaccgacgacacgtattgatccataactctctctctgacgtgacaaacttcataggaatattgtaccgacttgtcgtgttgttctgacagctactttagcacctaacgtaaacttaattactttctccgtctaattttaagtgcagtcataatttttcgtgcacagctttgaccgtatgtcttatttaaaactatttttaaaaaatttaaaaatataagttacgtataaaatactattaatgttttatcatctcataataataaaaatactaattataaaaaaaattaaataagacggatgattaaaattggacgcgaaaacttatggttgcacttaaattaggacggagaaagtacgcccgttagtgcaatcatttccgaatttaattgaaggaacgtacgtttgtaccacgaacacttcgtttaatttggtcaaatggaaacggaagcatatgcattaattgaagtggtataagctatcggatgcactgtagcatccaccgatccacgtggtagggtagttgtgttgaatatatggacaactcaatttttcagagttgttagcctatgagtcgataatattgtattcatttttttatcatgttttaaatgtggtttaaaatagtaggtcaatctaggacttggcctaataagactataatagacgatcgattttacgactatataaacaattgatttttcacttgccatagattataggtggctgtgtaattaaacggtttatcatgcgagattagactgaattgttttctatacccgtacttaatccgacatatatacatgtatatatatcgttttgtcgatgtacttaaatattagacaacaccttatttctaaaaaatatatatgtatgaatggtgtgtgtttttcatcacttgggtgtcgatgatgtatcatataatatatcttaatttggaacgaaattttctttagctagcatatgtagggctgtactataggtaggcaatgccacagtcgtcgcgccgtgcaaaaacggcctctttttatacgtgtgggaccacagtttactgcatgcgtgcaggctcaatcgctctcgtgcacagtagcgctgcgacccatgtattatttgctcgatcgaccggccggtttcctgttgcagctgcatggaccagtacaccctccatcccatagaaaactaatagtcccatcatttggcttattcaagaaataagtcaaacaacatatttacaaacggaaaataatttataataaaacttttatatacatattcttagtgatctaaaaacagatgttgaaaaataaactatgatgaaaaaaatattaaaatcaattttaaatttaatattgaaaatttaaattttagctgataagtataagaataaacgaaaagataggccgtaaatcctaactattaatctaacactctgtcatctttttagagagactagccgctaacatatactcctatatagtaggtacatgcatgcagactctgatcgagtagatatatactactccatagtcataaagaaagtcgtttaggacaatgtttaagtcaaaccttaaaaatataaatcatgaataactttcaagttcttgagtttaaaaatgtaaaaattatatgtatagatttgtcttgaaaagtactttcataaaagtatacatatataatttttttaataaatatttttatagaaataagaagtcaaagttgtgttttggagatcgtgtcgctgtcctaaacgacttcctttacaagtatggagagagtatgcatgatcaacgagtagttagtatactgtagacgaattaattgaaccgatgagatttgagagccagctgctagctagaataacgaccgtcaattaatcagatgtacgagacttaaatttatactcctacatggaaatgtttggtcgtgtgttggcttgaattgacgcagtaccggccggtaatcactgcattgcaccgttgtctcagctagccggcgatggaagtgtaagcgtatgcggcatattttggccttacactgtagtactcctttagctatggcgtgagtggtaaggtagcatgtgtacgttagtttctcgtgtcatctttgattttagctgacttttctagttacgtgtggtacattaattaattccgatccatatatatatcgagctatgagcctaaattacatattaattgttgttattagcggcataccagaacggtatcatgccaatgtgagaacggtcctctcataaattttcttctcatcagtaatagatggtaagacaccacttcttattatcccatatcagggtgaacccatggattgtcggtgtgcactggcatacccaaaacataggaaaaaatttagggagacatcacctcgggtggagaagggctggtggctagaaagggaatggcaatggaagtagaggaggtttccactgagcaaccacatcgccttggacttagagatagttgagacgacttcagcaaaggaactggtgaacgacttggcgttaggcttgggaagaggaactttgtgcccattacttcatccttcagtgattgatgtaagatgacggcccaacgtctatagtaaaaccgtcaagctgtaactatattacggatgacacacgcggaaccaacatccataggaacgaccccttcattcactgccatggtgatatattaggctagagttgtgaaacgataaccctctctttccatagagatccaacaagtagggggcttatgccccttagcctctgcgctggatccgccactggtgcagcaccaccttaggtggatgatggggaaggggatcagcaatgtacacgacacgaggcaagaggaggggttccgttgaggctagtggtttaacaaattacttatacgccattcataatttctccccactacaacaaaaacattatataaagacacttttgtagaggcattttgcaaattgcctctaagatcatgagtttatagcgtagagacactttatagagacactttcaaaattatctagaaaatttttactctagagacactttagaaatatttcaacacattttattagattatatcttgtagaggcattctttcggcactttaaaatgtgtctaacatgtaaagacgtttgcttgagacactttaaactctgtagagacacttcttacaataaaaatatactaaatgactaaatataagtaacttaaggcataaacatatacaatgaatgacatggggttgagttggttagtgccttgaagataagaatgatttgttcaagagatcatgagtttaaggattggcaaaaacaagggaaaatattttattctcattttactggtttcatatggttgtggtacaatttaatgtctctagaaaatgtctctaccaccttatagatattttataaaatgcctcttcgtttatagagacaattcaccataaggcacttattagacattttttaaaatgcctctatagtattgtaaagacatttgaaaagtgtctctatagtactagaaaaatgtcttctagtgtccctacaatactagtgcactagacatcgtttttgtactagtggtgtatatgctcatactataagcatgaattttacttagtatatacaagtggatctgaattgttaaacaaactcaattccaaaagtcacattagttcactctcctaaaccttgcttctatacattaggtcatactaccaccaatccttttcagcacacgctacacgtgatagtaagctagggaaaaaagaaattaaattgttaggttcttgtacagatcaatccacgtgcacggtttgcaggctgtactacacatgtacgtgtacaagtgtatcgtagtagctagtacagtatatcgtatttttctatttgtctactgtatgccgccactactactattgatcagtacgtgtgtacatttatacacactacagtctacagagaaggacgacgatgagatgatcagagaatgcggctgagatgcactagacgaacgaattcgacgacgatgcaacagtagcgtaggtgcagccagtagtagcgatgaccaccaaatttcctgcacactagtggactgctgctacagtggtttccggtatttttcgatcttttgcccatccatccactgatccactggctcggcagccacctgatacacgagtagtggtagcttgacacacacagacgcagctgataccaaagtgagctctcgtttgtttaggccccctctaattgagccggaacaacacctgcggcccattatagttgggccggaacggaacgggagtatcacgtacgttcgggccgtacaagttgggcccgcccctcgtcagcctacctgcgaagctgcgttcgtccggagatggaaaattctctggtttttcaaagcgcacattttctaaacttttttataatttttatgtaaagatatttgtttttaaaattcattacgcatctctcaatcttcttatttcctcttatctcaaaaagacaagcgatggaactagcatgtcgttttcttcagagaagttcgcttcagagttgatgcacatcagtgatcgtgtctaggggcaggggcaggctagtgcagctagggctttgagtctttggcccgcatcaaaaaacatgcttaaagttcaattcaccatgtagtattatttttttagaaaactaatgcttcattaagccgtgtttagttctaaagttattcttcaaacttccaacttttccattacatcgaaattttcctgcacacacaaacttccaacttttccgtcatatcgtttcaatttcaaccaaactttcaattttggtgtgaattaaatacagctctagagttatatcttagccctattctcttataatttctggtttcgccgctgatcgtatcgacgtgtcgtgcagatacatcgatcgatcgggtgcaagcaaagccaaaccaagcgaaaaatgagaaagaaaaggaaaagcacaggagcgagggatctccatccacaacgtcgtggacgtgccgacgtgaccgtcatcaaccaaagacgacgagaccaacacaagacgcgctccgtaaagcaaaccaaatgccaaaaaagaccgaccgacccagcagaggaaagtacgccccccgcggcctaccttcaaagcgatgagaatccagtgcatcaccctcgcgatctcgcatcatcatcatcatcattcttagccccaaaagaaaagcctcaaatgagtagtacaaatccaatcagatgtcattccactgatccacccgtgacgtcggcgaccgagaaaattgcagctgcttttcccgcagccgctcccataccggattccacgaataatcaaaacataaattactagtaaattatattactcccactacatgatcatgcattcatgcagcagttcaaacttcaaataaatttgtagacggtgacgaccggcttctttggttcgtcaccggatcgatggaaatcaagaacacagcaactggagaccatgtccatggtgaggagtttaatttgacacttgatcacaagaagcaagggaaaacaaaagcaaaggcattagtagagcttgtactagtcacttttgaagtgaggggggctaggattgatcagcgcccggtgttcttccatagccaagctctgagatctcccagcttgttgcaggggccacctcctggtgcaaccgagtgtattgctgagtccaaatgggggcatgaaaaaagtcgctcaggctttgcaaatgctcacatcagagttcataggtcagtcaaattacctccatctttgtcagcaattcacttgcagttggtgcagatacaaatatttgtctacaatcagagttgatgaagccctccgcctcgcctttgtcgaacaacgcgagcagtggatcgtagtaaccgtcaacatttagcaatccaacctgttcaattggccaaggttttatatgtgatggagaccttaatccatcaacaaagcattatgctactttgccgtttacaatatatctagtatcaaatatctcaattatgcttactggcttgtcatgaattccaagttggcaccatgttatcatctctaacagctcctccattgttccatagccccctgataaaaatcaataaccaagttacatttgaattatcaattactagtgtgatagatgatgttagaaagaaggtactgaacatttcagatcgtcagtccatctcacatatattggaattatcaattaccaggaagagcaatgaacgctttggatcgccgagccatctccgctttccgctcatgcatgtcctgtacaactattacttctcccacactctcacctgatatctgttagaaaagcaatatttgcaaatgtcaacacaaaccactccctttacaaaattcttcacaaagctgtacagtccttccaagtcaaagtaaaacatctcttttaaatgatcgcatacacgtactattatcaattatgttaggatcaggtaacttcaccctgacatattcaagataaacatcaccctgacaaattcaagatagcaagtgtactggtcctactatttaattcagctgaaaactaacaatgaattgaagtatgctgctatacggcttgtacctgccacctaaaaatggacagaaaccaaactttcggaaatcctagccctgtctagcttgatcatttcgtttagactttagggttcatttcaaatgtggaattctgatccaaacaccacaggattccaacggcaagttctccaagtaagaacacaacatggcaaacgctaaaacataccaatacagagctgaattcaacgacacttctgaaccctgaaaaatctacgaaatactgaaaggaagtcgaagagattgcagacctcgacagccatgagagctctaggaatcaccctgcgaataaatcaagcaaaaattttatcacgccgcattagatggtggtgtagcacgtacacgagaatcacaggcatccgcaggtgcagccgcgaaagcaaggcagcaaaagtaatgaggaaatcgctctcaggcgcagaaacgaagctggctgcgtgcgtacgtacccgacgacacggcggccgccgtcgagaaccgtacgcgcgatcaagcccatcagcccgatgctgccgccgccgtagaccagatcgacgccccgcctcacctgaaaaacaaaaaaaggagaagaatctcacggctcgcacctgaaaaaaaaagtgtgaaaccaaggatggaaaagtacgatggcggcggcggcggcggcgagcgagacagctcgaccgtcgccgcgccacgcgcccgcccgttatctacgcgtaccagctcgtggccgaggtcgagcgccgcgtcgccgaacaccctgcggcgccccgcgttgctgccgcagaagacgcagatcgtcccgaacctgctcgccgcggtcgcccccgccgcctccgctccgtctcccatcgcgccccgcccccagacctcgccgtcgccgtcacggcctcactctatctcctccttctcctgctgctccagcgagaagagtga

SEQ ID NO: 24304 - DNA, 8848 bp, Oryza sativa
ccaccaccaccaccacctcctccccccccctcgtcgccgctgtcattttcgcggtgaccacaccgcgccacgccacgccacgccacgccaatcaccggcgctgcacacgccggtgggggcggggcccccgcctccccgtcctcaaagcccgtaactctgaattgtccccctcaccggtctgtctccgagaatctcgcctgcctcttctgcccctctcctccctccggtccactgaaccctccctccatttttcgtttcttttattatttttttgaaacctttcattttgaaaacaaatatctaaaataaaaatttccaaaatctgaacatttgacgtggcaaaataatactatcacgccactcgcaaaggacgtggcgattttattctgccacaccagctaaaatgacgtggcttgtagagtgatgtcaataacgttgtcacgccatttaaaccgatgtgatcgcgttgttttagtaaaaagatacaaatctagaaaatactacctccgtcttatagtagttatcgttttgattttttccttacaacgtttgatcattcgttttatttgaaaaatgtgtacaaatataaaaaggataagtaatacttaaataataaagtaagtcataaataaaataaataataattttatttttttaataagacgaatgattaaattttttaaacaaaaaactcaaagcagacaagtagtaagtattaagagttaaaaaaagttctgaaaataaaagaattcactttcctcttctctccggataacggcatgcgtggcactgtaccacactaaccccccctggaccatccgctcctgggtcgctgaaacgatggcacgtctgcgccggtgtcgcttgcgcaaccagaattaattgcctcctcctcctcctagcgacaaagtgaggggtggccaagttactatcaggtgagtgacactaacaaccccagctgcggtaagaaacaaaaacatgcttcaacatatttagagagaaaccgagagtgcatgcttaaaaggagataattaacccctttttttctctaaacaaacatgcttcagcatatgtagagatagaccgagagagcctgcttgaatggaggtaattaacttcttttttttcttttgccatttcgaaagggtgagtggcaacaaatatcactttgtaacaagagaggcaaatagttttaaaaaatatttttgacaaaggcaaatagttaaatttgctgcttaaaaggcagttgtacgattataagccatagacatgtgatcgaagtagcggaaggggacaaaatttacgcttataaaccgaagatagtttgtttaagacatcgattaaacatttttatacttgatgatattttttaataccgattgtaaagcacttggttttcataaaaccgctagaagcagtttatgaaaaaccaaacggttttagctattcttcttcttactgaattaaccgaaagtcgttggttttacgggctgctttcgatggctttctgtaaaccaacatagactggttttgacatcagaaaatagtgctctcactgatgtaaaacgtggattttggtagatgtgcggtttaatgtggtggtcggtttcggcatagctttcaccacgtccctctcactctcttgtgcagtgaccaaccagggagtggtacagttgcagctgctgctgctctgcacaatctcgtcgtgttcgaattcttttctttaatccttttctctcgtccttttaatttcaggacgccacgtattggtcgctgatgctggtacaaatgaccaaatcgtagggtttttttgaaaagcaaatgaggagaggattattgtaattgatcacgtcgttagtcaaaaggacactaaataaagaagccaatcaaggacgatcgctgcaccaaacctaaaatgtttacccggtgattgtgatgagagcgaccaatcggcgagagttatggcaattgtttgagcaatcagacgatcggcaatggcatgtcatgtgatctttacggaagatgataaacgttgcatcattctcattgtccccaagctagcattcataattgatatatattcaaacataagaaactgtcaccatctccaattagaactgcagctctttataatactactacacagcatttagggataaaaagaggttcagacatttaactaatgactaatctcagttgtgcatacaaaaaacatgatagaggcaatgaggcattgagcttggcttggatgtataaatgctaacaacggatcagataatatatatgtaagatgcaaattagctaatttgtccatagaacagcaagctagaacagattgtcattctccttgtccaagctccttgtcatgctacggcctttcagagacagactgtttaacttcctggaggtgactgaaaattctgaacaggcgttgctctgaacatctaatggagagagtgcaacccttttgtaagatgacatgcctccagatcgctgtctctgaatctggaatggactgttgcagctctgccttgcttttgcagacttcgtcaagctcatgtaactcggaccttcaccatgtccaccgtcggatcttgctggagttgctgacgatgtcgatgcagagctcacatcacacgggaagtctgaagaagaagctgagagtacagaaggaggctttgctgccaccctgttccctctcatcttaactgagcttgcatttgaaagttgggcgccagctaagttcagttcgccactgttcttggaacacttcaattcagcatggctttgctccatgagcctgctctcccaaggctttgttgccatccatccttcaatatagctccagtcgtgattgcacctattagactcatggttcctcagagatctagcaggagagcttggccttgcactttgttttgaactcctaggctgaaaggaaaatggatgtgagcagcatgttatatcaacttgcgtcgtccagcgcaagagttcctcttaatgatacaaaagtatacctggtgagaaagcgcataagcaattgccctttccctcttagccacagcatcatgcctcatgtgtattttcgatcttacttcagaaaccgatccttgactgtcacaccattgttcctgcaatgccacaatctttgacatgttaatacgatatacatctcattttaaagcaaaattcgctttttttctctctaattaaaacaccaaaaaatatattcctgtgtggcctcaggactttttaaaagaaccagcacagttccagcttagaactttgcctggcaataactaattgcaaaaggcgttatcggtcttgtcagcattgcctcttcttacctaacaggatcacttccaagatcgattcaaacatgtgttgtcattacgagagagaaaacaacaatcttaatggactcaatcattactaaaaaaggaaccttaattgtccttatcagtccgaaaagtcattttcaggtaaaagtacccccaccatattaagtcatacatcactttcttcttaaggaatcaaattaaggcaccagtacaaacctctcaaattataacacctagtagtataacttaactaaaaagaacaattttcaattttcaagccttcaaatgatctccaaataaatacatcatttttgtatgtcagtaagacaactattttgaggactgaattcaaaatcttactttataactttgatttggattggtgcaagctctatcttgttctaaatacttcctttttcacaatataagtcattctagcatttcccacattcatattgatgttaatgaatctagattgatgttacatcaatatgaatgtgagaaatgttagaatgacttacattgtgaaacggagggagtagttgcaatattaaagcctacatgggagtgaattcaaccacacactcacacagcccatgggccatagacgtaccagtgttgagctagaggcccatcttacataccgatataggaaaatggaaggcacacttcaatctgactctaccaaattccactcccaaagtcccaagaaatggagcaatgccatcgaatttgcagaaatggcatgcagattaccatttatatatactccactacacaagtatttcgattctttaatccactgcacagaggaagcgccaccaatgcaattttttgcattcagaaattaacgcaagaaggatatagcactgcacgtatcaatcgtaagagaagcacgcgggtcaggctgtgttcccatgtacctctgcttgtttgatcgggtcggcgcggccgtcgcgctcgccgaccgcgtcctgcgagtcccggccatccgccgagcagcgcgcccgccgctcccgcgcgcgctcctgcacccgcagcagcgcgttcatgcacttgagcgtcacggcgagctgccgccgcaccagccgcccccgcaccagcgcctgcagccgcacgatgcctctcagcgccttcaacgcccgccgcgcctaactccacacgccattgacacaccacgcaaagcacagcatcaccaccaccgcgccacatcaagagcagcatcagaaaaatctgtgtcttaccaagaaggcgcggaaggccgcctggacgcggacggcggcccactcctggcggatgacgcggaagtccctgggcggcgcgcggacgacggcggcgacgaccgagctgaacgcgtcggcctccgacgacgccgactccgacgcgtcccccgcggtcgacgccgacgccgacgccgacgagctgctccgccacagccgggtccacctccgccccttcgtcgtcccctccggcgccgccttgaggctcaccagcgacttgatccacttccccgacgcccccatcgacgctgagagagctcacaaactcctcctgtgggggcagcgcgaggaggaagaagaagaagccaaggcgagagacaaaatggaagtaggaggagaagtggtgggggtagggggagttagccgttgtctttttcgtccacgacgacgcgaactccgcagcaaaccgttccgttccgttcaattagcggtggccgcgtggggattcaaaatttgaacggcgagaagaagccacaagtggcaaaggtgggacccaccttggcgtcgctgacaagtggggccgtgtgatgtggttttctcggacgtctcgggcttggagaaggggggaggaggcgacggctttctcgggggacgtgttaggagaggctggcgcgtggggtccgcgacatcgtgggcccatatgtcatgcagatagaggtggggtggcgtggtggttgtgtccagtgtccactacgacgaactgtgcgtcggcacgatctggatcctggagagtggacgaactgtgcgtccactacgacggctttccctcctgtagtacgcgttgccgacgacggggcggacacgacacggtgggatcgcatcgcatgggagaccgtggcacggacgatcgagagggcgagtaggcgacacgagctagccagaatggagtttttcaatcaaaactcgtcgagcctgaggcagttggacacggctcccggctgagcggactcgggcttcgacgaccactactccctccaacgcataaaaaacaaatttaaaatcagatgtgacacattctaatactataaatctcgatatatatatatccagattcgtagtgttaggatgtgtcacatccgatattagattgattttttttaaaatggagagagcatagcctaccatggctgatggtaaaacatataacgaaactacccgaacttgactcgacagtgtgactgcaaggaccggacatatatgttcccgcccttcaggagcttgaagattattacgttgggttccacctctagatttccgtgtccaactttgactgtccgtcttatatgaaatttttttataatttgtattttcattgttgttagatgataaaacatgattaatattttatacgtgacttgtctttttaatttttttttataatttttttaaataagacggacggtcaaacgttggacacggaaaccatggtttgtctttttttgggacggagggagtaccctccaagcctccaagggctaagagtgtggtggcgactctggtcaatcctgttattttctaattaagattcggattttacatcgttttttatttgcatagttttttttaactactaaacggtgttacgtacgaaaactttctatatagaaattgttttaacatattaaatatgttaatttgttaagtttgtactccctccgtccaataatatagcaacctagtattggatgagacacttcatggcataatgaatctggaccgcaggagtgtctcgtacgttatattatgggacggagaaagtaataattaaagacttaattatatgttaaaattgttttcgttttcgagctcaaactccctccctgcgcgccgccacgagctcggcctccctgatgcgtcgccgcatccacacctccaggcgagaaggcggcgttgagctctcgtcgtccttgccgtgcgagacgcttcgcgccgccgcctccaagggagcaactagcaagcagcctcgcttcggcgccgctgccgccacagcctactccgatcgatctgtaatagcgtgcatattcactgcatgtgtagttgtgttgtggtgatgtacacgcatgtgaacgtgaatacctaatatgatgcctttggtccttatgcaatcatgctaattgttgttgttgatagcctggatacttggattacggtaagatttggtgcttattcactggtgtttggctatttcttgtcttgctttgctgctaccaaatctattgagatattgtcgggtgtgggcacccgacggtgccccatacccgcacgggggcgggaacgggggaggggaaaacactcccccgcgtgcggggatgggaatggggacgggattttttttctactacggggacgggacaggatagcaaaatccgacgggtgtagccttgtaggtgtagcccccccattgccatccctactcgtattccctcccaggcccaagtataatggggccacatttaagtacttcctttctggcccaactagaatgggctgaaggtaacatcacagtgccgttccaggccgactgtaatcggactcaaatcaccaagtcgtgtgctccaccagcgtgtcactctgaatccataaaaacgctgtacacgaaaacttctgtagcacaattgccatctctaggaaaaatgtaaatgtgtgtgcaagtgtgtcactctgaacccctgatctgcgctgctccatcagtgagtcccatcctctcgtcactccacgagaatatctgcgtcaccaaatcaccatcagaaaaacggttttttctataacgtacaagctcaagatggctaatctgaagagatcgttccaaagttgcatactacctaaacggtgaaggtaaattaaaaaggtcatctggtggagcctgcctggatgatggttggttgcgttggaagcaaagatgtgattggaacatttggagttgatacgttatcatatctgccgctgaaagcgaccatcgaagaagaaaagcatggagatttagggacaggttatcggttatccccaacgtcggtttaatgcactaatcaaggactgacgggcgccgcgccacgacgcgagcaggttgacttgcagcagggcgtggactgatcaatcgatcgagcaacacgtgagggcatctgtgcgtcaatgtgcaccagcaacgacaacgcttaactcttacaagatcctctgtgccaagctcgatgatatactcatgatatactccatatccatgtgtacctaacatttctttatcgtacaatatacttcctccgtttcaaaatatttgacaccgttgactttttagtacgtgtttgattcattcttaaatatactttcaagtacgcatatagttttacatatttcataaattttttttaataagacgaacggtcaaacatgtgctaaaatgtcaacggtgtcaaacattttgaaacgaagggagtatattgtagcatctcatgtacgcatgtactcgtagtatcattattctgtcgtgtgctccatggaaaaatgtcaactgtacataccactgtatatgcacgtgccataggacggctggagtagccgagtagcaacagtgacttgtactccagtccaccacatactacagtgtcagcgtacgcgtcgtaggccgtcttttttttggcggaagatgccatgcagatgcagcagctgcaatcccggcgggtcggctccccgcgctgctgctgcttgcctgcttgggcggcagcttggattcccacgttttccacccaccaagtcagccatctcccaccccgcctcgccgcgtgtcgcccccgcccgcctcgcctcgcccgccattttaaccgctcgcctccgcgacgccctcgtgctagccaacccacacaaacccccgtacaccgccccaaaaacgctaatccccacctgtacaccacagccgctcaccgagctctcgcccgcgtcgtccgtttccgcgctttcccctgctagcctccgcgtgatagatggacgtggcggaggcggcgtcgccgggggtgggcgcgtgggcggcgatccgcgggtacttcacgccggcgacgctgttcctcgtcgtgaacatcgtcatcggcaccatcgcgctcacctcccgcacgcaccagcgccgccggcggcaggtgtaccagtatcaccacgacggggagatactccaccacgaccagttgcaaccgccgccgccgctgctgcatcagcaatactacggcggcggtgagcaccagcaga

SEQ ID NO: 24305 - DNA, 2008 bp, Oryza sativa
cctccgctcgttcaccctctacagcttccgctccggcgacctcgccaccgacgacatccccgccgacgcagcggcggcggcaacgcccgcacaagcgcactacggtaggacccggtcggagccggcgcgggagcaggacaagaaggcgaagaagcaggcggcgtcggaggcgaagacgatgaccaagtcgagctcggaggcgaggaaggacacggcggcggaggacgccgacgacggcggcgtggacgccagagccgacgacttcatcaacaaattcaggcagcaactgcagcttcagaggctcaactcgctgctcaactacaaggagatgctcaaccgcggcagcagcaagcagtagctagccacactcgccaagaacaacaagagccttgcaatttcacagcaagctcactaagctccctgttaattatactacttagcaatgctaaatcaatcaagagatttcttatatatgtggtgttaatgaattaaactgtgaaatagttgcaagatttttgccttaacagaattatcttgtgactgaggatcatgcattgtctgcttcaaatcaagaggtgagatgagataagtgagcagtgatgttaacaggagaggtgggtcgggcgtctctttcgtttgggattgagatctttgtgaattgtgattatgcctctctgacctcggaaaaaaaaactactcataaatttgggagcaagtttaggatcttgggcacggtggcccatgcaggtgacccatgaggccatgactcccaagatggatgaaactgagctctcattctcagcattaatctgatgctaggattagttgctgtccaaagttaaatgtgttgtctctaccaaacctgcagatttttgcatactgagtgactagtcagcacaaatagtaaatacttgtgtctttgtaagctatcattctatcaagtgaacagaatactgggatatactaataattatataagatttatgacacgtcaaacgggcagaatactcggatatattcagacgtcacagttcatcaggtatttggctacgtctctcaccttttctcacaatttcttttgtaaggtctttttctctcccgatttaacttgtcatgcaccagtagtagtagtaacgaattcaacaaccaccctccacatctgactccacccatgcaaagctccacagttgcgacgcatcaagccgtttggattggcggctccggtgaactgggcaccaaccagctgctcatggtcaattggccataggccccatagccagtagaactgtagaaatcgccttgtacaaaccgtccactcagccgcgtgccacacacgcaggtggcaacgtccactggaccactcgagaagcgaaaattttgcctaccgcgacgtgacacaatctatcttctatccatgccaaccaacctgacgacatgtgttccggcatattctatccgatccgtggccatcgatcggtacacggacggccagagattaagccacgtcactgcccaacgctctactgcatgtcggggcaaagtcgagagtcaatctcgagacgtcgatcagtgtctatatgagaggacaaagcgtcggtctcggcctgattgatacacagatacagtgcacacctctgctttctcctctccaggtgtgttcaccgtcaactgtgttggctgagttatcaagactcgaagagtactctctccgttccataaaaaacgaatttagaattggatatgacatatttctagtatgataaatctagacagatatacatccagatttatagtagtagaatgtatcacatctagtactaagttggttctttatgagacagatggagtaccttgtgttgaactgcacaaggctgttgataagctataacgccaaccacacatggaaaccaggctcaggtttgcattgggatcgcggttcctcgttaaattgtccaagattacaggattgattgggtgtaaacagttgtgttacagttctacttgaaca

SEQ ID NO: 24306 - DNA, 10399 bp, Oryza sativa
cccacaatctatactattgcaccacctttcaacaaatcctcccccatttcactattggctccccccaaatttcaaaattatctacttgttcaataagaaaaatcatagtattacttagactaaataagtgtttattgattgattcaataagctagaaacttaatttgtttttcattgcaatgcacgggctcttaggcaaactacttaaatcaagggaaagtttgaaaaaccctgccttctcactttgccccccatgtcccaaaacaccccccgagtgaatactttgtccacttatggaagtgtttatggattttcccttaaattaatataaatatcacaggcataaatcttcatgtattgaaagtgagcttcagttgccactgcttggcactatcctgttaagaattcactaagattttataagaacagcattgtagcccagtggtcatgaagctgccaggagcttgggccagcctgtgttcaagtcctctcagacaggttctctcgccaattttcttctttatcagtcatagatgctaagtccctccttactatcccacattttattcattcaaaaagatctcactagattttctagttctgttagctgttaaagcactccaacattccaaagtgagcatactagagaaagagctagttaccatacttctgtgaagggggtccatttatgtagaaatataccttaggtgtgcttggtgcctctgtaaaggaattttctctgttagctgaaacttcagcttctttattttgcagctgttaacacgaaaggcaaaagataatgatgtattagatgaaaggaaagaaattagagcaaataaggcatataccataaaaactttccctctttgtatatacaccattgaaataaatgagttcgctttaataccacccaaatttcaaaatttcctcaaaataccattccattgcctcttgtcatctctccataagggtttggttcaattccatcacattattggaaattttggtttctctaccaaaagacccaccaccttagcactatctgagtatatgccatttatctttcgtggtacactttattggcattggaagatagtactagtaagatttagataaagcggtgacctctgaatggcaacaagctaagccaaacaaggcctaatggggaacctatttgccgaggcatgacactatctacaaatacaacactgccgataccatttgagagagcacctatcagacgaaatctggacgtgctaccacgatacacacctcatggtgtccttctggatgactgcgctgtaacggtgatcgtgtgaactctacaagtgaggtgcaagcttagtgaagttgtaatgcttgcatctaattcctagtaataccacatatatccctagaatgctaaaatgaccaagcagtgctggcactctatcaacaggaaggtgtttgcttgtgatagaacttccttggggacaacagtggcgtgtgctctcagcagagaagcaggtgggaagggagggtgggtcaaggtgcttggggattatgtcagcctgctctttatggggaaggggttggtttatgcgttaggaggagtgataggaggcaagggaaggtacttggaggagatttgtgaagttattaaagtgaacctaactgtttcaattacaatggtatctaaagagggaagatattttgtatatacctaattttctcaagaaagtaaatcgctataaccaacatttatcatcgatttcccatcttttaatgatattcttcaataggtgcttcaataaaacagtgcatacatttgggatggaagcctaagtgcaaattgtagattaaaagcatgttgctaatcgctactctaagaaatgctaacttcaggagcagcatggttatcgcaagcttcctaaatgtacctgcttctgtaagttaagcagtgtaagtatctcattccgtagttcaagatgctcgacgcaaactgctttcgtcgggaccttgggcttcaaattcacctacagagaaacaatgcatacaatttcatgtatctaattgtgttattaaattataaaagaaaatgcactgcaaacctactagacccaaaaagaacttgaacaacatcagttcggtgcatatcaagtacagattgatgtctaggaaacaaaccccgaggtcttgtaaagtctggtcaacccttttgataactctaaggcccgccgaggcacttgctgcttggaccatttgatcaagcgcttgggttctcaaatacactcgaagctgtaaaagaatgtatagcgagtaaaaaacatctaaaaagaacagtgtgaagagtgatataccaattttcatgtgattcataggcatccacagttaatgagaacaagaccgctagtaatataattaacataaggtctgcttgtgatgagttcggcttatttctaataacagccacctcccatgcaatgagcaagataacttacactatctttgtttttcaggaataaatgggacatgctataattgctcaggaaacataattttacacttagtttaatagtgacattatggcatggtaagatgaaggataggacaatgtggtttccacagaatggggcaaaatatggttagctttaaataaatagaacaaaatgtctactgtaacaaacaaaatgttaactcatcggcagctcaatataagagacagaaagcaacaatccatagtttcagagttaccattcgcagtgaagcaggtatggagttattcactgctgcagctggaagtgtagcagttgacaatgggtgtgtgttgctcaagggagatacaccatcaacattatcaaagtgtgccagtgctcccgcttcctcagtatgctatagacaaagcctcaaacgcttagagacatgtaaattccagaccactgatcagatagatcaggcagactatatcacttcaaactaactaccatcaaaattcataaggtttattagtgaacaacactatcatccctgcatgacagcaggcatctgggaaagcccaaaaggctaagcgctatttgcttgaacagatcggagtctcatagatatctagatgatttgacatctcttgcatcacagaaggaattctaaaaaaaaactcattatttgcaatataatgcaaattgccaccagaacattcttgcttgagattacttttgtggtgagatgtatggaattaaatgtgctgattactcactttgctagcagcacgagtttccataatgcgttttgcttctgctaaaatctgaaaaggtaacacttgtaatcagacataaaacattggaatctaaggaatgataaactgcacaagtcagctgctcataatactatcatcaacaaatttctcacctcagcatcctttcgttcttgctgttttgtctgggagagaagtgcagataaagcacgctttctctcggtctcatgagcagcattgaatgtttcctgagaagaaacccatatggacagaaataagtacaagggcaaacataataagaaaacaattactcaattattcataggttagatcaacatgtaccttcacaaggggattaccagcaacttcatcaaatgaccgagctctagcaatcagaagagcacgagtaactgcaataacaaagaatatactggtgtagaattcacaaaagcaaatagtaatgcacagactgaattgttgagcatagaattataccaaacttgaaatataataattggcagcttcagcagttgactgattattctaaataacaagccatgcaatcaccttgttctcataaaagaagggcaggggatgtataatgggacaatgaccagaatattgcttatatcaatttgtgtgcgtgtaaccttttcttaagtccccattatacataagtaatgtgagcaatattctggctgttatgataaaaacaaattcggtggaacggttacggagctgacaatttactaactgttcttgtttcatatattgaatgggaaaataaatggatatgataaccacagtaaatcacttgttggtttttgaccaagtaaatgcatgtgtagaacattaaaaattaacaacaaaggagaattttctgtggtggacactatctaagcatagaggttatatcaagatataaggtaccagaataataacggctcttcaaatcctccatgctgcgatcagttgggaacctatcaactattactatgaagcgaaggtcaaagcgttcacatagttcaaatagtttatctgtttcctccctgctccatgcctgaaatgaaatcaacaactgattatttatagaagggctttcaataaaattgtttgcaaatataatattttcaaacaaaggcttgcaactattcgaaatgaatgctcaaatgccacataacaagcatataaagatgagatgataacataattatgtataattttcgaacttcccaacattgttatcaattgtattcaagagcgcaatgatatccacagaaggtttttagcaatataagattttcaacaaaagatcaaacatagcatttataaaaatttattattgcaactagtacctacaggatcggttaaatacttctcatactcctcatcggtgtatttgagaacatccgccttctgcaataggaaaaaacaagcaaaaactgagtaagcatcaatgcaggatatgaaggatgtacccaacacaatatacttcttaccttgttgtattttgcaaagtgatagtcaccagtgggtggagcaccatttacaactctaacctgaaagatcaaaagggtgactttctgagtttttttttctaagatatgtatgccatactacaaattcatgagaaacagacccaatggtaaagttgaaggttgtcagtccgtgcagaggacgtgaaaggtagccactgccatgctatctgcagaagtacttcaaatggtcagatttagtacaagctccatcaaaatgggagcacgaaacaccttgctgcaattacccatatgactcaatggacatgaatatgtgaggtggattcaatctgcttatttgggttgaccaccaatttcaaaacagaagttgcacatgatcaaatcatcatttcatttgtcccatattaatcccatgagcaccttacccttaatgcctaattcctaataggtattaagtatacgagtagctaaactctcagctcagttcatgtgcttctactagagttatcaaattttcagcacatatcagctcaccttctccttctcaacagctggtcgccgcttcaggtgcgaagcctcgatggtcggcatgagtggagccatccccacccctccagtgagcgcgtacacctggatcatcaacaaccatcagcacttcagcagcaacgagaaacgcggggtcgaagtgtgcgggaggatggcggattaggccgcgccgtacctcgcgcgagacgccatcgggcttccgctgcggctccttgggcgcgcggggcttcttctcctggacggacgggaaggcggtcttggggaggccgaggatgtccttcgcgtccattgccgccggacggaggaggcggacctagggttagggttttggtctagtgcgccatgggagagagatcgaggtaggccgaagccgccgcctgcgtctgcgttgcgtcgagctgagctctacctcaacttggcctcgcgagagagatggattggagaagggaaagcctgagattgtatgggcctagtcatattgggccggcccaacttcttatggcctttgctagaccgagtccgagtccgacttcttggcacggtagctttttttatttcctctttcccgtgtctcacggcgaaccagcgaggccgaggcgcggagctgagcggaggaggagacgcgccacccctcacggcgctccggcgaatcggcggtgaacaccggcggtaatgcccccctccccttctccctcttgtagactgcgtcttccggccgcttggggtgggtaggattctgcttgtttgctctcgatcgttgggcgtggaagctggggtttgaatcggcggcgaacaccggcggtaattccccctccccttctctctctggtagacgcaccttctctctctggtaggctgcgtcttccggccgcttggggatgagattctgtttgcttctagcatcgtctcgatcgttgcctcgttgggaaactgcccttcgggtgaagggcatttaggtaattcacattagtactaaactttcaatggaaatataaggatgagtttttttttataagatagagggaatatgccatatctcataataacttattttgggagacagagggaacttgcatattaccctctcaaatatagtagtaattatttttgggacggagacgataaaaatatattctttgtgcgtcgagaatctcccccatcctctctgcgtaaaaaaaaaaattcttcccgtattgtctcgcctgtgccgatcgagcaggaaaatttgataatttaacacttttttcattgtccaattgttttagttgacacttgtgagaatgacatgtgggatcatctgagtgaatgaaagtgggacaggatttcaaataatcaaaacccattttaaggagtgttaaattatcaaatctctcatcgagcatagtgcaggggagaagccagggaagagggaggtgacgtcgtcctggtgagcatccacagctgggtcctggtcttttctccaataaaagttggatggagattaagatttccgttgcatgtttttcaaattgctaaacggtacgtttcgtgtgaaaactttttatatggaagttgctctaaaatatcatattaatctatttttcaagtttgtaataattaaaactcaatcaatcatacgttatttggcctggtttagttcccaatttttttcccaaaacatcacatcgaatatttggacacatgtatggagtattaaatatagattaaaaaaactaattgcaaagttatgggggaaatcgcgagacgaatcttttgagcctaattagtctatgattagccataattgctacagtaacccacatgtgctaatgacagattaattaggctcaaaagattcgtctcgcggtttccaggcaaattatgaaattagttttttcattcgtgtctgaaaacccccttccgacatggatatgacacctaaaaattttcttttcgtgaactaaacaggccttatattattttcttagggctgttttggattagtgccaaaaacgtgccctaccaatactttggtagtttgaacagtgtatctggtgattttggtttgaagccaaatcattggcattgccaatgcccaatttgatattttctatattctactcaatgcttggttctaaattggcctcaaaccaaatacaactctaccctaccaaaaaattggtagtaccaaaacttgcctaggttttggcactaccaacattttggtagggtattgaaccaaacaagcccttaattccacagccttgaacctacaaaagaaagtttgggggattcaactgaacccccatgtcccaagatggatccgcccatggcgccagcgccgccgccctccacccactccaccgcacccttcgcaactccggaggtgcgttctgtcgccgccagacgcccgcggcctgcggcggcgagcatctccgcgcgcctacgcgacgtggcgaggaggaggaaggataggcctcgtcgctgccgggcacaggtggctccccgcggcggcgaccgcatcagcgccctctccgacgatgtgctcctcctcatcctgcggcggctcgccacccgcgccgcgctcgccaccgctatgctctccaagcgctgggcccggctcctgcgctggcttgacaccctcgatttcatggtcggtgaaatactcccgccgcgctaccgtaggtgcatccaactccaccaagcggctggttttgctgcgtatcccgttgatgtcaaggttctcgttgcaagtatcaagcgacacgagcgccttgccatgcgaaacatagcggcctccatcaatagcttgttagacgcggatggcagtgatgaatgtgctggccaagctcgacggagggcccgtgtgctgcgggtggagttctttgcgactcactacaccgatcttatgaaccgattgatcaccaaggcattggatgcttgggaagtcgaggatcttgaagtttttgctaagcctgcatattggtctgagtggtctctgccgccgattgtccacagatttcctcaccatggtctctgcattgagccccacaagtcccggctgagaagcttgaagctaggtggttgtatcattccgccattgcaggggttccacgctctcaccaaaatgaccttgcaagacttgcgaaactccgtggccaaagcatcctatgaagatgtgtttaagtcatgcccccagttgcaagtgctacacctcaagtcatgcaggtgggcggaccggggcattctggttatcgatttcccaaagtcagggattaagcagcttattgtggagttttgcagcgccattgcactacactctcttgggatgcttgagagcatagctataagggagacttgggtcaggtataagcattgctccttctcgcatcttatgcacatgaaccttaacttacgccatggttaccgtaatcgtctgcgtgacttatgtattggttgggacttgaacatccagcagtttcttggattcaccaagaacataaccaacctggttctacgattcactggatatgggagatggttcgtgccatcttgcccctcgttgttgctggctaatctcagaaggctcctgattgctgatgtgccttcatcatgggatgtctcttggcctcgcctcctacttgaagcagcaccatgcctggagagccttcacatccatattatcccttgggatgacgattcttttgatgaaatcatttggcaaccatccactttgcagcatgaagaactaaaagagttggttgtaattggtttcgagggaacagaaagacagatttactttgttaactttgtgatggaagtatcaacaacattgcagcttgttgctctatttagatatgggcatgttcaagaaatggggcgttgggactggaaaattgtgaggcagcaacaccattggaatgatgaggagaaagcccaaattctgaaccagtttgctgatagagattcttgctcaataactccagttcaagtagttgtagagtgatctgttatgttaatgttttacttgtatacaaggctttaagttataaagcatgcatctgttatgttacttgtatacaaggctttaagttataaagcatgcatctgttatgtcagtgtgttacttgtttacaatgctttaagttatactgcatgcattatgatcttaatttatttctgtgcgactttttataagttacttttacagtaactctgtttttgttattatgccttgtatgcatgttcttttgtatttaagtggagccttctgtttgttctctactcctcttctctaaggttttacatttttttagaggttctcaagttttacttttgcatcataggacaccaagtcataaatttcatgagaggtatgtcttttgtaactgacgtgaacaagatgattagtgttcatagattcttatgacaatggggtcaatgtctcactgagtcaccgatcatattttgttgtgcaaggggatgtgccttgataattaacgacttccgtgtacaggatattcattagaatcatttataaaagataaaatcaaactaactaatgtgcagtttagtttcattctaggaccgcttcaacttggtccattgaacaacaaaccacctgtctgatctgctcctgcacggtgagcttcccctcgtcactccaggtatatttctggcttaccatctcctattcacctagcctcttgtccttgacatattcatgcttgagcagaacaacacggcgcaacgaccatgatatgcctcacaagctgaacctttctttctttcttgatctgaaaaccaatgaccaccaactcctccagatgagaatgcagtgctcttgagggctcctgctcccacactatctccaacttccgacgaacggccatctcatcatcgtcttcacaacgttgggaaaagtggacgtggagtctctcaagcgatggagcctcctcaacaagggcacagatccatgtggcatcccagcgcggcggcatgtccacgaccagcagcttcctcaggctgggcatctctaagaaaggactctccggcgtgacccacatttgaggtccagttagccgcagcatgagatctgtcatgttggccttgcagaaatagctgagcatggacagcacggcttcacgct

SEQ ID NO: 24307 - DNA, 5272 bp, Oryza sativa
tgccgtgtgcaggacagctttatgagaggccacaatggtagagagcatcttgcagattggttgtatggtgagcagatgaatctgtggtaatgccttgtccaataattagtaaatctttgttcactgcaaaatacaaatttatatccctggctcctcccctcccaaacgcgatcgcactgaagtccccatctccttatagagtagattatgatagtgtctttttccactgttgtgtttagtagtattgccttcagcaatgcatctgaagctgttatgatccagtgttcaatcaatcaaatttaatagataacaaaacattagcgagaatttggatgtcgttgatattggttgtcgtttttctattactgtgatatgagtttagatcattttattttgttgaatataagctagcaaagaaaactgggattagctcaatttttttggcttaggataacatatgccagagaagaaacttgtaactaattaagtgtgcagtggtagctcaattttcttgcatatgctttgttggatctcatttttagtttgaattgcttaatgactataagtaagttaattataatcagacaccctttatttggggataacgactgtgtttacttcaataaataagaaagtatcatttttgtggcaagcaattttagtcttattgaactgttaccaatacttaagcgcacgagtccattgatattacagaacccctcagttttatttacaatgaagggttgttattgacctgattttgtttaaatcttgaagagttaggagtaggaaattgatggagctgttgcttgccttcccaatgccccccaatctaatcattgtacattccacaagagctatctaatcattatactggcacatttcagaagtaaaaggatgctcaatttcaacattgaaatcatatctattgctcaattacagatgtgatatggtaccccacttgatttatcgactgaatgggtgttcttgtgtgttgcgttgtaggggcgcaatgtgattattgagagatcccataggtctctcaaagacccaaagtcacaaatggagtaactgttgcaaaaaagcattgagtttgagcacagcgctaagaatgttggtgcaaacctggtgaagcaagttgctgaagctactaataaggtcgcaggagatggtatgggacctgagttgtaggaaaatcctgtacttgagtagccatatgaactatctattcgattgtgctttgagcatagcagatcagcagtccatctgatttctaagcgtactcaatgccaattcgccaacgagcatagtgttaacctgtcttttccgctatgtgcggttaatgttttttctcaactagtagtaatgaatatgttgtcatgataggttaattcttatggcatgaatcaaaatattgattgttatagcattagatggtaaggaccaagttctagtaaattcctgaattttttttaactaaattcatgtactctttttttttcgataactaaattcatgttcagcaaatcagcagcagttcatctgatttcctagtatagggcctattttctgccagaaactccccaaacaattcagattttcacttcgatttttaaaaaaccatatttgtaaaatttagaaaatgaactaaaagtaaacccagttttccagattctcatccgtacagtacctatagcagccccaagaagtctactgggcctatgtgtacatgggctgacatcagggcaagagttcttgtcgcttttcgctactggtacgtgcggttcgttgccgccgcggccgcgattgcgatctcaggcaacctcgccgccgcgccctccgcgacactcctccgccatggctaggaggaaggggaggaaaggtgcgttctaccggcgccgccaccgggatcccgcgacctacggagacgccgctgggaggaagggggcggcggcggcgctgtactgtctccgtcgacgccggacacccgcggcggcgccctgcgacggcgaccgcatcagcgacctctccgacgacgtgctcctcctcatcctgcggcgtctcgacacccgcgccgcgctcgccgccgcgatgctctccacgcgctgggccccgctccgtcgcgagctcgacgccctcgatttcgtggtcggcgacgtactcccgccgcgctaccacaggtccgtccaactccacaaaaccatcgcgtacaacggtgacgccaaggctctcgtcgccaccatcaagcggcaagagcgcctcgccatgcgaaacatggccgcctccatcggctgcttcctcgacgcggatgacagccatgaccgtgccggccgagctcgtcgtcgtcgtcgtcggatcggcaggctgcgggtggagttctttgccactcactacaccgatcttatgaaccgattgatcaccaaggcattggacgcttggggagtccaggatcttgaggttttcgcccaatctgcaaaaaaaaaaacaccgccggatgtccacagatttcctcaccatggtatctgcaatcagaagtcccgcatgagaagcctgaagctaggaggctgcatcattccgccattgcaggggtttcaagctctcaccgattgaccttgcagacttgcaaatctccatgcccaaatcatcttagaaagccgtgatcagatcatgccttcagatgcaagatcaacacctcaaatcatgcagagaggtgggtcaggtcattttggtcatcaacgcccccaggtcatggatcaagcagctgaccgtggagttatgcagcgtcatcgcgctacactctcttgggatgctcgagagaatagctatcaggcagacctgggtgagttacaaacatcactcctccttctcgcgtgttatgcacataaacctgaacttacgccatggttacattaatcgtctgcgtgatttatgtattggttgggacttgaacatcgagaggtttcttggattcaccaagaacataacgaacctggtcctacgattcactggatatgggagatggttcgtgccatcttgcccctcattgttgctggctaatctcacaaggctcctgattgctgatgtgccttcatcatgggatgtctcttggcctcgactcctgctcgaagcagcaccatgcctggagagccttcacatccatattaccccttgggatgatgagcattgtgatgaaatcatttggaaaccatccactttgcagcatgaaaagctgaaggagctggttgtagttggcttcgagggaacagagagacaggtttactttgttaactttgtgatggaagtatcaacggcattgcagcttgttgctctgtttagatatgggcgtgttgaagaaatggggcgttgggactggaaaatcgtgaggctccaacaccattggagtgatgaggagagatcccagattctgaaccagtttgcccatagagattcttgctccacaacttcagttcaagtagttctagagtgatctcttatattaatgtgttacctgtatacaaggctttaagttatactgcatgcattttgatcttacggagtcactgtttgtcttatgtttatgcgcattcataccgcttattagcaactaaactggtaaaacttttttataccgttttagcctagttttccctaagtaactgttcactgtattgtttgttctcttttcctcattaaaatgagacaccttcttctatatataaaacgtcgataacagcctgaccattaaaaaaaagacatttttatatatgttattagcgattcaaaagcaaatgttgtaaaataaaatatgatgaagaaaaccacaaaagcaacttaaaaaattagttctaaaatttaaattttgacttttaagtataagcgaaaatatattgctcttaatttatttgtgttactttttatgtgtttttttgcacgaactctgtttttttttatttatacatatccgtttgtatttagttgaagccttatgtttctacctgccatccagtttcgttctcaagttttacttttgcctaatttaagccgattttccttctgctagtcgactggcggggggagcaaaatcgagcactcccctacatacgcgcacgtgtgccccccgggccccaccatttgtcatgccccaacctgctatgtgtctccacaaaaatgttttcacctagtgtactcataatgtttcactatatatagatttaatgttgtagtattgtagtactgtacaaaatttgtcctaggggtattttggtcatttgaacaaatttatacagtgctaacggaggttaaccggacggcgatggtaaatcgtagaagttaagcaaaagtcgatgacatattgtagaacatgacaaagtcagtgacaaatcatagacaagttagtggcatataatggattgtctatttcactagcgatatcagtcaccaaagcaagaagtcggggtctcggggaccattttgtcattttgtcaaactggacctaggcccattggacttcttaggcccatggaccgtacgtggagccgaagcttccggaacccaaaacccttcttccctagcaaaaccctctctctctcttctcgaatcgaaattgcgaagccgcaagcaaagccgccggaggaaggagcaatcgcgagtactcgccaccatgtaccgggcggcggcggcggcggcgtcgtcgatttcgaggtcctcgtcggcgctgcggaagcaggtaaccggcgcgctacctccgcctcctcctccttcccacctgacgcatctcttccgggcgacgctaacggacggggactcttgcttgcgaggcagctgtcgcgcggcggttgcggggagcagcggctgtgggcgcgggggtatgcggcgaaggaggtggcgttcggcgtcggagcccgggccgccttgctgcagggcgtgaacgacctcgccgacgccgtcaaggtcaccatgggccccaaggttcgtgctctctgacagactccgagatgcgtggattggttggggagagtgttgcagcgatcgggctggatctagtggtggaagcgctagattttcgcactcgatttggcgactgaatgggcgtgtttgtctgtgtcgttgtaggggcgcaatgtgattatcgagagatcccatagagctcccaaagtcacaaaggatggagtcacggttgcaaaaagcattgagtttgaggacagtgctaagaatgttggtgcaaacctggtgaagcaagttgctgaagctactaataaggtcgcaggagatg

SEQ ID NO: 24308 - DNA, 6296 bp, Oryza sativa
aagcatattgttaatctgttttttctgctatatgtgttaatccttcttgtcagctagtaatgaatgtgtcgtcaggataggtaaattctgatagcatgaatcaaaatattgattcttaagtaaactcacttgagtgtgatgctcagtgacttaagttctcacagtggataatggcggcaatagtttctgatatgtgtggttttcatgttctgtttttttttttgggggcctcatcgcaaacattatcaaccctatgaatagcataattactagcatgaatataatattcagtgtcactcactgcatttctggttgtatggggtaacaggtaccacttgtgcaactgtacttacacaggctattcttacggaaggctgcaaggctgtggcagcaggggtcaatgttatggacttacgtaatggcataaacaaggccataagttctatcactacacacctcaaaagtaaagcatggattatcaactcctcagaagaaataaatcaggtgggatgctctggtttggagtggtattttgatctctctgctccctccagctacattgtataaaccatattgagttgcttatgcatctttgctgtagttattgtttgcatctgctgtaaataagctaaataatcactttgactctatattactgcaaactttccatagtaattatcccgcattcttgcatgcttaagaatatgttatttcatatttctgtaaaccaggtagcaactatttctgcaaatggagaaaaggaaataggagatttgatatcaaaggcgatggaaaaggttggaaaggatggagttattactattactgtgagtaccaagtgctgcttttattattagcctcatactgcagaatcattctatttggtaatacctacttacctaggctgcaacttattttgggaaattggcaggatggcaagacattagacaatgagcttgaagcggtacagggaatgaaactttccagaggctacatatctccttactttgtgactgatcagaagactcagaagtgtgtaagtctgtatttcttggtcaaatcagtgaatccagcatgaactacattgtagaaagttcgctacattccctcatttgctttgactttatgatggaaatatgcatggaagtggatcacatcagtaataattgtgagtcaggttgtgtattttgattggttttggttttctgccactttgatataatcattagtagattatgtctcttagtgttgaccttataggatgactcagggtgcttatccttgcaaggttttatttcctgtttgttaagttggtttcttagatagctttagacccagaaaagacctgatgagagcagagaaaatatatatgagagttgtatcaactggcatggaatattccaaataatggtctgagacgatctcatgtatccctatgtttgtgcaggagatggaaaatcctcttattctaattcatgacaagaaaatctcaacgatgaattcacttcttccagttttagaaatgtctatcaaggtgattatgtcccataatgtctcagcttcttttgaatatggcaatggtaaattggtttagtactaaccagtgtctcatgtatgcagaatcgtaggcctcttctcatcattgctgaggatgttgagggagaagctctatcaatgcttgttctgaacaagcatcgtgctggattaaaggtgatattaactactggtcctactgtatacaatactgaattgcgtatacaagctgcttgatgatatgtgtccgttgttagttaaagtgcaagcttcttaccttcttcaagctagagctatggatcgttgatattctggtaaattagtaattatcatgcatcgattatagatatgtgctgtcaaagctcctggatttggtgaaaacagaagagccaatctggatgacgtggctgtgttgacaggaggagaggtcagtcatgatcaacaaccataaaagtccttaaacacaagtgatacaatatgactgaaattggcttgcttatttcgtttaatttaatttcaaggttgtcagcgaggaccaaggtcttgatcttggtaaagtcgaactacaaatgcttggcactgctaaaaaggtttgtcaatcttcacaaattatttcacctgagaaacagacagtgagaatttcctttacaggttactgtatcccttgatgatactatcattctagatggtggaggcgacaaacagcagatagaggagaggtgtcaacaggtgctgcaataaaattgtcactcttgaccttcatcccaactatctagataatagtggccggattctcctttgatagaaattaaattgtttgttatgtgaatgcccttaacagcttagagaatcaatggacaaaagcactgctgtatttgacaaagaaaaggctcaagaacgtctatcaaagttatctggtggtgttgctgtcctcaaggtttgttatttttcaggtgcacagtgatgtttcactgtatttcttttccccactttgctcctctcaggatatccattttgactgcagattgggggagctagtgaagttgaagttggtgagaaaaaagatagggtaacagacgctttacatgcagcaagggctgctgtggaggagggcattgtaccaggtgtagtgacggttttcttattttttccactttggtgtcttttttcctaaacttgtttcttgatgttttgctttcgtgtaacttgtccatatgttttgtgccaatttggaacttcaaacaggtggtggagttgcccttctgtatgccaccaaggagcttgacaagattatcacagcaaatgaggatgaaaagattggagttcaaattatcaagaatgctttgaaggttagttcctgtattggttttggcgtttcatgtgcctgatggcttgtttcttaaacatgtaataatctctgaatttctgtaggctcctttgatgactatagctgcaaatgctggcattgatggtggtgtggtcattgggaagctaattgaacaagataatcttaatatgggctatgatgcagcaagaggtttgtgctgtttagctatgttttggcattactggctgtaacaaaaattatgttgagttcctttattgcggtttagatagtccttgaaaaggctatccatatgccttcaaaagcatagtaatctttatgattcattagctgattcctgctctttgccaactacaggggagtatgttgacatgattaaggctgggatcatcgaccctgtgaaagtcatccgaacagcgctacaagatgcatcaaggtacgcacgttccttaagttgattactatttttcctttgcattactaaaatttccacacttgcttaataacttgtgtttttgtttcagtgtttctttgctgatgacaacgacagaggcagctgttgtgagcccccagcagcaaaggccagaatggctagtcggatgcgcagatgagcgggatggatttttgagagcaagtaacatgatttatgatatgtcttctgcctgatgtaaggcagtgcccctcaaatgaaaggagataatcttttgaaagctatatgacgtgattttgtcttttcgtggtgaaaggcagtagtagtacttaatatttctacagaatttcacggcccgggagaaagacgttacagatataatttattttaaacttgggaattgggaatccgtctgatgtaaactgaactaatgtggagcagcacctcattttgtagattactacatatgtgaaattgatactgtgaaagctgcaatattttactatgcattttggcaataattttgcctgcgcaaaaccaccatttgtccgaccacctgaacgaattattctcccctgatctccttgaatgtgcgtacgctgcacatgttcataagcacgaactgattcaaacacatcacaactcgactgttatcaggaaggcgaaaatgcaaagtagacaaacaaggagtgaagatttatgactcatgaacacttccaatttctcattataaggggataaggggaaataaaccgtttataccgtataatatagatcgtatctaactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtaaatctgaggtcaaattgccaatcctagttatttcaaaggtatattgcttgcattgttttgtacaacctgattcatataggacaatagggcgatctgattctatatatatatcaccaatcaaacctggccaaacttgcttgtagggtaaattgacagtcctaaactcctaatcagttcaacaaagtatgcaaccaaaatttgttgtgatccagctagctactactaccgagtacatgttaatcataccatacgggaacatatgctaaacagacctttgatcactgaagcatgcgaaattcatgtccaagtttcgagaccaaggggcctaagcattccgtcgagcaccttatgcgcggaagccccaccgagggcaaccacaaggagtgaagcagggaggggggaggaggagtggaggagcggtctgttcctagagtatcctgaccttgtaaagctgctcggtgatggcggaggcgacgacgccggtgtagaaggcggcgacgtaggtgccgatgagtggcgcgaacgagcgcggcgggcggtacggctccaccatgtcccagagcaccgtcttctcccacctgttgaattgccggtccgcgtaccacctccacaaccgcctcgccatccctctctcccctcgccgccgccgccgctcgcctccgcctccgcctccgtcccctcgccgccgcaagcctctgcaacgccgccaccggcaaagaacagcgccaccgctcagcacgtcacctgattaggctttcaattgggccgaaatgagactgcagatcacgtgggccgcacgttgcgttgcagtccaatttcagcccgacccggcccgtactcgaggcccaactagaccggttctacccagcccagccttagcccagaccggcccgagaacgggaagtgaaaacgcaaaggcggggggccgagcacgaaaactcgaaatagcccgcgacctctctctctgtgtctccgccgccgccgcctccgccgctcgccgcatccgtcggaggcgagatgggcatcaaggtgagcgcgggagggggggggggagccgcgccgtcctcgttcggatttgtgaccggtggtgtgggttgtagctgtttttgcggccgattcgtgatgggttttcgtctcgattttgtgcgggtttttttttgttagggtttgacgaagcttttggcggacaatgcgcccaaggcgatgaaggagcagaagttcgagagctacttcggccggcgcattgccgtcgacgccagcatgagcatctaccagttcctcgtatgcccccatgtctcctctcacattctgcgagttggctttgaaatgtgctcacttacttggggtttagggtttcttaagcctttgattgcgcgagagagattgtatttttttctatttaactgcccagtgttgtaaggattcctcatttcaaattgctctcttagaccaaatcgggttgggtgaaattgggatacctccattgtgcctcatattttcttctttggtcggctatatttattaacattaaactaaacacctctagcattggatgttttgctttaaaaatgggagtagagcatagcaattccatattacattcactatatgttctgtgtgcaaatgcttgacaagttttggtgaggtattaggaaatccttacccactgctttataagttgaaaaaacattttatgttttacttgtatagattgtagttggaaggacggggatggaaaccctcacgaacgaggccggtgaagtcaccaggttctaaatattaatcttacaccgtttctagtgctaggattctgttaattcttttataaattagaactttttgctgtgcagtcatttgcaaggtatgttcaaccggacaataaggttgctggaggcaggaatcaagccagtgtaa

SEQ ID NO: 24309 - DNA, 1447 bp, Oryza sativa
atgttctattatgttctgtcctgtgcttgttctccttcccaccttgatccccagagaaatgtcttttaatgtgcaggaaggagataaagacgcaattgaaaaattcagcaagagaactgtgaaggtgagaaggggggttgatcttacacagtaaaagaaatgtaaaaaaagaatctatgatgtttgagggacaacagattcattcgctgagaaaaatatcaatgaaaacagttggtttgaataacatgatatggaagatgcaaaaaaggtaagtatgagagtaaccttatctttgcatcttctttttccttgagcaggtcacgaagcagcacaatgaagaatgtaaacgactattaagacttatgggggttcctgttgtagaggtaatccaattttctttggtgccacatgctttttcagggaatgagtcaatatataatcgttggatttgtttattttactatgctagcataaaatctatgatttatcatgtatttgccatgctctcaatctcatccaaagacatcttctttccggtaccaataggcgccatgtgaagcagaagcagaatgtgctgcactttgcataaatgatatggtaatgttaacatagtggacttctgccttcttgtttccatctcttgcttccatttttattaattactgttttttttataggtttatgcagttgcatcagaagatatggactctcttacttttggagctccacggtttcttcgtcatttgatggatccaagttccaagaaaattccagttatggaatttgaagtcgcgaaagtatgcagcactgtgatttgcttggtacagacactgatgttgtacacacttgaccaattttcatattgcaggttttggaggagcttgaactcactatggaccaattcattgacttgtgcatcctatctggatgtgactattgtgatagcattaaaggtatttttgctttccctcttctcatgagtagtattcctataaattcttgcttgcttgaatttctgtccatgcaaactttttttcctaaccaactatgtgtgcttgtccgctaggtattggaggtcaaacagctctgaaacttattcgtcaacatgggtccatagaaagcattctggaaaacataaataaagacaggttaatcttttgaactatttgaatatttcccacttgactgagaactcaactgagacatgtatatcagctgtgtggcaaaggcagcccaaaattttctatatgtgccactttatttcatttcttggtcgcattatcttacttagatgtaatgatgtattgtaatgtgatgaagaccatttcctatgctaatttgtgctaaattttgatcatatctatcgcctactgcagatatcagattcctgaggactggccttatcaagaagctcgacgcttgttcaaagaacccaatgttacattgg

SEQ ID NO: 24310 - DNA, 495 bp, Oryza sativa
tttttttcttctctttcttttccacggttctttggatattggcccaattcttctcagatcaaccatttatcattcgcggtaaaatagttcatcccaattcattcccaccaccccatattgattcacccggtagggccaaaagaaaaaaaattccaaaagaagggcgggcttccacggcttacggttgcataagctttggcacgggcggcttcccctttgggatcggccggggcgggttgcttcccttccaaaatgggcaccggcccgccccccggggtggaagcccccccccgccgttccggcttagggaaggaaaagaataagaaaagaagaagaaaaagaaaaaaatggggtgaaaagaaggaagagataaggtaagggtgaagaaaatagaacttattaattgatcggtttcttcttcttggttttcaggcatgcttaagccttccgccgggcatgccaatctttttttccggttggtgtaactacccggga

SEQ ID NO: 24311 - DNA, 776 bp, Oryza sativa
catcctgacgcatctctgaacacaagatgacgcattgtgccaaaagacacgctcgtgtagcagcgcagcatcgatcagcagcgtccagtgccatcactgcctgctccacctgctgcctgcatttaatcaccgaccttacaccagcagcagtccaccaccccgccgcttccccgcaaaaacaaaaaaaaaaagaaaaggagagaaaaaaactcctttccgccaccctccccttcccctctctctctctctctctctctcacgcagccgaatcgcgaggagagattccatttccccaccatggcctccctcctcctcctcctcctcctcgtgctctccctcgccgccgtccacaccgacgcggccgcgttcccgtcgccggcaggtgcccgcccaacccagccaccttcttctcccgccgcgccgcggtttgtttgggggtggcggcggcgtgcaatgggcggggatatattcgatcctgacattgtttttgtgggggggattttctgcagatagcatcgtgaggcagctgtcgtcggtggtgaaatggccgcgggttccttcgtcgtcgtcgtcgtcgtcgcacgggcacaagcagccctcgcacccgcagtacggtgagcgccatagctgccgacttggtttgctagttgctactgttccagggtttatttactagtagtagtagtcagcagcgcaagttcgattagttggcggagtggtgatttgacgatttattaggttatttttgttgtttctggctttctgcagttcggacg

SEQ ID NO: 24312 - DNA, 19920 bp, Oryza sativa
  unsure (1)..(19920): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgttctatgattggtagcttgctttaccttaccgcatctaggccggatatcatgtttagtgtttgcatgtgtgcaaggtttcaaaccgctcctaaggagtgtcacttagtggccgtgaaaagaattctaagatatttaaagcattcctctactattggcttgtggtacccaaaaggtgctaagtttaagcttgttggctattccgattcgaattatgccattgcaaagtggatagaaagagcacatccggtagttgccaaatgcttggtagatcctttgtgtcatggtcatccaagaaacaaaactccgtagccctctctaccgccgaggcggaatatgtttcggcgggtagttgttgtgcccaattgctttggatgaaacaaatattgttggactatggcatatccttcaccaaaaccccactcctatgtgacaatgatagtgccataaagatagccaataacccggtccaacattctagaaccaagcatattgacatacgccatcacttcctaagagaccatgtagccaagtgtgacatagtcattagccacataagaaccgaggatcaactagccaacatctttaccaagcctcttgatgaaacccgcttttgcaaattgaggaatgagttaaatgtcatagatttctctaatgtggcttgagatggtgcaccatggttgtttctttttgcattatgtatatttgctctcatttgctcttatgctttggatttgttgccatttggttcttcattgcgaaaatggagcatgtcacattaagggggacttttgtactcttgcatgtgctctacttccctttatatgtgagcaaatcaactagtggtgctagtagtatttccaaaaatgcccaagtcaacataagtcaaaacttttgcaaaatcaatgtaatttgaaaactatctcttggaaaatgtttcaaaaggtttcctatatgttttccacacctcacattgcaagaaaaatgatttttgaatgaaaatcccattttggccctcttttgaagaaactagattcttagttttggccaaaatgagattgagaaggagtttgagaaaagtttcaaaacaaagttagtagagaagaagatttgaaatgtttttggtattcaaacctatttcaaaaaccaaatcattcaaaagttatttgaaaatcaaattcgcccaaaaacccctatagaccataaaaggtcacctcctagcactcaagtgagttttgttacaaatcttcataattttcaaatgttatgaatggttggcaatatttaaactcacacatttcaaaatatgctccaaaagtcaatttttttatcgaatttcattatgtgggggttgtcggcctgtgcaagggctgtgcacagccggcaggtggcctggcggtttgaccggcgctatatgcgcggtctgaccggccaggtttggcggtctaacaggccacatagggccggtctgaccagccgaggtgggcccagggaatttttattccccctcttcttctacccccacctacctctctcctcctcatcctctcacttccccaactcgattttttcttcctctctctcacctcccctcaaaccctaactccttcctccatcaaatccattcaatttgaccacggatttcattctggttacaccgtaagtgattctcctccgcttcctctctctattccatggattagtttgtgtttttgttgagtttttgatccatggcatggaaccctaggtgaagcacgaggtgttcttcaatttgcaccaatagagggtagttcttggtgtgattcaactcctccaactggtaaatccctctccctcttgtgcattctctcaaatcgatctatttcaccctagggctatgggtagttgttccaatcttgatgaaataggtccaaccctttgatgttctagttccactcttgtgcaatattgttctagcaatttttagactcaaatgagtagatgtgaaaatttttggatgcttgaacttgtgggaggaggtctacctggagccacaggcggtctgaccgcgggtcagccgccggtctgaccggcgagtgcgcccggtctgaccggctggcaaccgtctgaccggcctgatgccgtcagacgccctgctggctgtggtctgaccacccctccataggatatagtcaaattttcacctctccaaattgtttctagaattattgctaatatctatcatcctttactctttgacagtgatgcctccccgcacttgccatggtcgtcgtgcacccactccggatgccgtgagtgagcctgaggaatcgagcggagatgattatgctcaaagtgatgaagaggttgaggcaaatgttgagggggctagtgaggaggctagtggagatgataacagtggaagtggagaggatgaggatgaaggaagtgataatatgcacattgatccctccatccagtttgttgtgaacatgaggaatccatcgcagtataccatcttgaggcaccatgatcagtttttgaggcctcgggacaccccggatccccgttttcacaccgctttccagaagtctgtgtatgagcaggtttatgcagggaaagcatttgcagagcataagtggatttcttggagagacataaatgagactccagagtttgagggattgtaggatctcttcaagactgttggcattgactggattgtgaccctcaagcaagactacaatgaagatttgatccggcagttttatgttacagtgtgggtggctggggactatagtgagatgaagtggatgtccgacaccctccactgttctatctctaggaggcaattccggcggctcctcaatattcgcttggactttggagatgacttgcatgagaagcacacccataatctgctctccatagactatctctctcagttttatgaagatggagtgcggtacacacatgggaaggttgccggcttgaggactatccccagtgtggttaacaggattgtgagagctaccatcctccctcgccttggcaacaatgatgacattaggggggtggcttggcacgtcatcgatgcaatcattcagggccgtcagttcgacattgtgtctctcatgatgcaagagattgccatctccaaggggaccttcactcagggaatctattatgccccttacatcatgaggttgattcaagacaagcttggggctgctgggcaaaatttgaagaagcacaagcagtacaagccccgccttcagcttggagctccctgtgctcctagggcggcgccctcctctcatcctggagctagctcaagctcagcacctcttcctcctcctcctcctgggtatgatccaaatactttcttccatccacagtatgcttattttggaatgcaacccaacgagtacttcaacccggtacttggagctattaataccctaagtgaaagcattcaacgcttgtctaccgggcatgaagctttgcatgaggatgttcgtggcttgcgcaccgatgttggagacttgaatgcttccgtggggagattgcacactagagtgggtacattagattctcgagtccaaatgttggagagctcccaagcatttgtgtatcatcgtagtcatgatgctccttatccttccactttggtgcgtcctccttctcctccacaagagtgaagacatttttggtgcttaatgccaaaagggggataaaagtgtgctttatgttttgtgggttgggactagtagtagtgaggatagtgccctcatatctaataggttaaggtggtttgggctatattttgtatgggtatgggctattactctatattgtgtgttctttgtcgttttgttaaactctatgtcatttggaccctttgtggtcttgtaatagcctatgtttatttgtgagcccttttaggatgatttgtgacttttgtgatttgattggttaagtgatgtgaacttgtgcgatgatggatggtgtatgcgatattgatatatatgtgaccatcttatgcttatggatgaatatttcttgaagtttacattgagatattgcttatgtgtttgtgcttattggaatgtgaaattgaaatgtgcattggctccatatttgttgtctatgattgatatgcacatgtttacggggagcttttgatttccattgcaatatatatatatatatatatatatatatatatatatatatatatttgtggtgtttgtcatcaattaccaaaaacggggagattgaagcatctaggtccccgttgttaattttggtaattaatgacaaacgctaattgtggactagtgctttaatttagaattgatcgaggtgtagggcgatcaaatttgctagtttactttttagtttcgccgtactattaagaggggtaatgacctagcaaagagatgattttaattgccacattaggtcattatgcatttagacttgtgctcacttttcatcacacacacacaatcacttgggatttcactggtttcggcctgaccagtggcggtctgaccagcaagacggcggtctgaccagcgcataaggccggtctgaccggcggcacatgagcggtcagaccggccccctggaggccgggatggtgctgctcgggatggccgatacagagccgacggagctgtattcggtcagaccgagccgatggggtctgaccgcccactcaacgccggtctgaccggccagtccgatggggccctctgacagcgctacaacggctagttttctagccattgcagagtagcacggtctgaccggccacatacctccggtcagaccagcagagcacaaagttgggggattttgcccccaacggctagttttggttggtgggagtataaatactccccctccagcagcaagggggctctcttggtacccaatttaattgcatacaccccttgcacctctatcacacccacttgaactttgtgttcatccatctagtgtgttagaaggttaattagccaagagtcaagtgctttgcttccatttgtagagctagtgtggcacttgattgatcatctccacgccgggtcattgcttgttactcttggaggttgccgcctcctagacgacttgtggaggagttgcccggtgacctctccgagaagattgtggaggaggcccggcgccagtttgtgagtggtttggagttcaccaccttcggagtgaaggaagaactaccctagtgatcgaggcttgggtagtcctctccataagccggctcccgccttgcccaccccttgacgaagggggcgtgcggtggcttcgtgattgagcggtggagttgggctcaccttaacgggaagtaggaaaccgacgagtttccgaacctcggtgaaaaatctcttgtctccttgtctcatttgattgtcgcatttacatttgtgcaatttacatttctagagacatacttgagatcatatcaccctaggattgctcaacattgacataggagtgtgatttactttcctagagatataattgagccactatcaccctaggtttgcaaaacataacttagttgcttagttagaattcaccctcaccaagcctagcaacttaagttagttttgattaggtgtcatttagttttaaatcgcctattcaccccccctagtcgacatctcgatcctacagccaccgccgagacaggcgagagagtgcgagggagagaggcaagagagaaagagagaaggagagagagagagatgtagagacggagagagcaagagggtttgagaagatatggacggaaagacaaagagagcgagatggtttgagaagataaggacagagacgatcggcttgccagctcggctcgcctcgatataggtgccggtttttttaaatgaccaacacctattgtataggtgccggtttttctttagaaccggcacctatagttgtttaaaggtgctggttttatgtgtgcttttagtctgcggagaaaggaacaatattataggtatcggttttaactgttgcatcacctatagtggcaatctgtatgagctttgtttaagtagtgtacggagaataaacagccatatatataaaatgactctttcaagtaaataaatgagcatcgccatcgtcctacaattgatgtttgcgtaaaatggcacacacgccgtccggtttcaacagcctaggatgcccctaataaacagaaaatgaattaagctactcggtacagagacttaattataattaattaggtgtatgtataattgttggaatgaagccatcatatatatcgatcctaagctatagctgcagattaattattgaatagctagctctacttgtttttgagaggcggcttgagcttagctagctttgctaaattgatcattaattgagaggcttgaacttagctagctttgctaaattgatcattaactcaaacttgaagaaaactagcttctctctatctcagaatataaaaatttctagcatttaaaatttgtcacaaaaatatatataggaactctgttacacacttctcatatcaagcaatcacaactatctgatatcatttcatttctcttcgtctttcttaacttaaccaatcataattgaacatcacctacttataatttcatctcttttattaatctctataaagaaaaccttaaaacctagataaaaagaactatatatatagatatgtttatattttgagatctatatgtctatattttgagactgaaggagtatacgatagctaatacaggtaatattgatatggggaattttgtcaaggcgggtcagggtcacagcccgtgcgtcgcgtcatcagaaaaggggcagggcccgggcattgccaggccaccacctgaaggccatcagccaacacccagtactatccagctatagcgttgtatagcctcttcttgcatgatcaatcaaaatctaatggatgcaagctagatgtcacagttagggcactgtcgccacaatgtcctctcttggagggcatatacatgcactaattattattaattcttggaataactagtctggatcaccatgattataactccctgttaaatcctgacgcgacagccagatgaacagtgtgactaattgtgtgcatatggattagtagttaatttgattaattctgcagccaaattgacctgtgtttatgttgatgatgatgatgattatgatgatgatagcaactgcagatgaattcgcactctcgttcgtacgtacgttcaaaaactacgtcccaactaatgctagctgatgatgaattagtctctccgggctccattgatctttcttgtgtgtttgattgatcatgttgactgcagaaaagtattggagctttgctgtatgttcgttgttgctgtacgtgtgctaatataattaggctattagcagtagtttttgtgtactgattctctagagctgtagcgatcactgatggtgaagtagtcggttgttgcgatattcttacctgtccttttttgacattttcttcccttccagtacatgtacatgtaacagtctctcgtattaattgtgcactacctccagtgaaaaatatttgacgccaaatatatgctccctccattttcaattataagggcccctttgaatcgcaggattaagaaaacgtaataatagaaaaatgtacaatattgatataaatgtaggtgtaaaatagaggattgcaaaacacaggaatgacggtttgattggaccgcaggaaaaacacaggaattagaggagagataaagactcaaagaaaagtttctattaggtagaacctcatgttagttttcctacaaaatttacatggcattaggtattccatagaagttttataggattcattcctttgattcaaaggaatatataagaaaattcttgtaggaataaaatcctctaaaatttctatgaatcaaagggggcctaaaacgcgtatgcatgtatgtatgtaattaattagcacatctcatatcttatatgtcaaaaaattagcgcatcccatatcctttagtttgtattttaaatcatatattctcaagatctctaattttattggattcgcgcatgcattatatttactagaattacataaacgaaaagatgatgataattattttttggttttttagttacaccgtattactccgtactacattttaaaatagatggtatagtgattagtgatttgtcataatagtaataatatcatatgtgtatatgcgcaaattttagtgattggagtaatgatttgaattgtacgagtatatcagtgttataatttgatggtggtgaatagtataattagttttgttggtgaagtaattattacaagagaatgggcggctataattgttgggaggagacacgtgtataagttagaacaggcagcagacagcggtctctgtcgagcgtcgcgacaacggggcaataacttggaaagcgattgtcggcatcacctacgggcgccacgtggacagcatcactcgaatgtgggcccagcgccgtttcacaccacgaacatcagtatacgatctcaccggtttccaaacgtactccccctttttcttggtggagattaaagagatagctaaagttaaatagtgatggtttgtgtttggtttaaatgaaatactactagttgatagagaaattaaataaaaaatgattatcattggttgagttagaaaggaaaaatatgtagtacatatcccattgaatctaggaataaaatttttactcttagatttgaaaatgattacaaatggttgagataggaagaaaaatatgtagtgcaaaacacatgtacactaaaaatctagaaactaccatttaatctgggagtacaatttttactcttgttgatgtggaagcttccatttctagatccaacagtaatttctaggttttcacagatagaaaagtagatagagagattgctactctgcagtagagaagggtgtgataccattttttttattttttatgtacttttatccttatattaaaaaaacacgtacacataaaagtatgctctgcatgttagcaatgtttgtgtgcatatatatatatacaactgtacattttttatgaatcataaattaattgtctaaaatttatatcatcaaatctaaaatatggatatcaatagtgtgacgtatatacacatgcttctttatagaggtcatatttttatcggaagtcgaagacatatattagtattgcaaagaaagaactcatatgccattaattaagctatatctggtaattaaacccatgcaatgcatgctcagtaaacaagactcgagtggggactacggagtggctcgttttcagatctgacagaagagatgatgaaatgatcagaaaacgtcgagcattctaattaagagggctagccgtcaaacctagctacaacttaaaaatacgatatttgtgaaataaatcatcaagctaaaagtatggtcagcaaatattaatcggcactaattactccttttgacaaaaaaaaagaaaaaaaagaaaagaggaacatatcaaccaaaaggaaagtaactttgctgcatgatggctatatataattcgtgcagccataaagaggagcaaaagatctaggtctctgcaggcatgtcgtcgttcttagcttctttgtcttcttcctcgtgcggtgtagctctagatcaaactatgcaattaatcccagtcctgtaattaaaattcatgcaagatttggtgaaatttgtggagaacaaaatcgataatcctagctactagttgcgccgtcattatcgcattgcaacgtataactgtcttgtgatatgtccacgcaatgactagtacactgctccctcctgatctcctctgaattaaaaaaagagatgatgatatgatgatgatagaacagaaaaataaacagtgctagcgctgagctgctatatatctgacttttcttcgttctaatgatgatgagtcatcgtgacaacgcccctcttgtttaatcgaaaattaatcaatgactcgatatcgaatctgcgattaagaataatgtcaatgcgccgatcgaatcggatgctgtttcttgtgccctacttttgggcaaagcaattaaatatatatctgatattaaccggttaattaatttactcgattatactattagagaagccatgatcttatatttagccgtcgtacctaccaatactaaaagcagacaagaattcaagacgtcgtccaaccacagctctgcaacggctgcacagagacaagactcttgcatacattgctttctttgtttagggcaagagggcgccgccatttgcatggagtagttagggttaattagttccatatactccagtatcgcgaaagctacgtacgtacttcaagtactatatataataaattaattggtacgtatatacttgctaagtgagttttggaatcaaataaattaatgcaaaatttcattgtacatgcaaaatatctgcagaatttttatatgggattgatcttaaggtggattgggcatttaataaacaatatgcatattttgtagatacataattatgcaagggcacattcagtggctataatgaatttaatatccgttgtgctaaagagcgcacctcgcagtaacccactcgactcgctcccctccccttccctcttatgtataaaaggttaatcccacgtctcgcctttacattggttttgtcgctaggatgtccatcagtctcctcccgtcccctcccccctctctccacttgatgaaaaaaattatcctcatctctcaaagaattgaaaagatcttgcaagtaacttttttccaatgctagcttcctctcatcttgatccattttttctaccataagtgatgtgaatttctttttttacataaagacaagggggatgggggtacgtgtggacgggatatcaggagagtgaggaagggggtggatggtacaggtggagaacctaccaacaaaattaatgtttgggtaaatgtgagtaatattttttttttacataaggagagaggggaaccagtctctttaccaaaagcagtgtggtgtggctccttttagcacgcactcgctccccctctctctctctctctctttatctctctctaagatataatagagtgagcaacaaaattgtccacggcaataaggaaatttgccacgtacatgtcgcaaaggtaacctttagctatattagacgaaatttacgttgaattgtacttcttttttttaactgaagcaattcacttaagttgtcatcacaagcgcactaattctgtgatggaggtgacattaataataaaatccagcgagagatgtgggtgacaaagtgcagagtggagacatgtagagacatggttctctttcagtaaaaaggtatacgtgttcaagtgactgaaagagcatgtcaatgtacaccttataaagtattgagctacgacatattgctttagtttttagctcatctatcacccaattcagtcaagtgtgatcgagagatcaaatgtttttcaaagaatcaaaaggtgctcgacctaataatggccgatatatatcatgttaattaatcccaaagggatcaaccaggcagctagcagcaagcctccgcgagcaagaatcggctttatttggtcattttattaacttgttaattaattaaacatgtttaggtgagggattaattaattaactaacgggaggagtggtgcaactatgctgtcattaattaatcaatctagggtaaattaatagcacactgacccatctcgtttagcctctgcttatctcacagcccttggagcgatgcgtctcccggccaaaattctattgcccgatcgatcgattcggatttcgccgaatctaatgatgtcaatcacgcaatgatttaattagcctaatctcgaaagccacttctccaccactcattttgttaattaatctctgggattatattagtaactagctgtagtggaaggtggcatcatatgcagcatgcaaagatttttattaactatatgtggaaggggtagatgattaatttttgtataaatgtagtaaacactttggtagcacagttaacgccttgctataataggagatgtacacatatatatatacacacacacacacacgatcgtcgcaatcattaaccattctaatacgtatacgtatctgtagtgtgcaggtcggccggaggaaaccgttaaacaaacattaacttttgaaaaattatttaatctgcttttgttctctttttgtttggaccttctccgtgcatggaaagtttgtgttctaaatgtagaagcttgctttggaccaatttgggttgatacaaaagtttcatatagtagcttttttgtagtacgtaggccaattgatcatgtgaaatttatttgatcatatatatctcttcctattttaattcaatttaataagcctataaatcccacataaaagcttccttacatttctacagctaggttgcctttataaaagagtacttactttccatatatactccaccttttgtacatcttgtttatatggtcaaatggatataataaatacatgcaactttccctattcttttattgattgtgtttttttatatggagtgcttgaaatttatcatacagcctataatataattcttgggaccaccaaaatcgccacataggtatacgataagttgtcttggtacatgtaagggtaaaaaaaaattttcacatatgggctatggtaaaagggtagaaataggaaaataactttttttcccaatggtatatgtcaaatttagccttacattattaatttgttttctcctttttttttcttatactgatcatcgtataagtttttctaccaaaaccaagaaagtctgattttcctatattttatttaatgagaatgtgatggagaaaaatcaagaagcatgcacactttaactttccccacgcacaagaaacgagagctttactgccccaagtgcatgcatacacttctggttatatgatgataatatatatgtaatggagggaataatatataagcgaaagtcgccatcaatatggaatggcatgtatgaggtgattttagtggacccaccaccaaagaactatattaggccacataacaaatttcaagagcttatttatagaaaaaaaaagaaaggtcgagtagtaaattgaccccagagcaaaactttagatgccatagatgccataaattgttactctccctctgaaagctcttctttgataggaaaaaaatttcataggaactacacattataatttccgttaaatatacaatcatacatatatatttcatccgtttcacaatgtaagactttctagcatcatccatattcatatggatattaatgaatctaaatttatatgtgtgtctaaatttattaacatctatataaatatagacaacgctagaaagtcttatattattaaacggatgaagtaccttgtttctacgtacgattcaaacatggtatataagataaacatgtcgtcgtctgaacaacaaataaatattttgtctcgatgtcctcttggtagttgcacgccgaacgttctgcccatttttcagcgtaatcggatagaattgaaatccatatcttcgtctgcttctagcagctagcatcagcttgtccgtatgcttcagagagaggaaatatcatcgccgtccacaatataatgccgatcgaacactgtactaagatatatataaaaaattttgttgctgaggcaagaactagaccggtgtcgttgctggtccaacttggccaatggccatatatatatatatatatatatatatatagttttgcatatatatatatatatatatatatatatatatatatatatatatatatatatatatatatatatatatatatatatatagacacacacacacacaccccctagtaatagctggtcccatgtacatatatatgcttaattgggttagctcgagctaactggggtgccaaaatgaatgctagctctagtttaagtgcatgcttggtcaagatggataggggatcagatctagtttccctgtatgcgccccaccaaatcatcacggccattgatatgtcccctgcctctaattaatctgatccactccgttaaatatataaatatataaatatatatatatatatatatatatatatatatatatatatatatatatatatatgacgtatatatgttgttgattttatttggtcttgacactttgacttaattctatcaattgaggaggttttatccagatggctagaatacatgcagttaattttagttctgcagacaaacataagtgaaactattataacaagaagttttatggtgtttgtataaaaaggaataagaattcgactctccataataaaatgtttttaagtattgacagaaatttttaggtaagaaactaggaaaaaaagtaattttgctagtagatggacaagagcaagccggattgtctttgatattatttgatagtattaattagttttcccatcttcagtacgtgatagttatttatgtatctatatattatataatctgtgtgtgtttttttaggttatattgtgtccccaagaacatattgggttaagatatcttcatttcttttgtgttgttcccatcaacttgaactgattaactgctgcgcctaacctctaaattaacctgtggcgctggagtgactgagggaggagagagagagaggcggaggagaagaaaaaagaaagactatgttcgttttctattttcccctactgatatgcccatattattaatgattaattactccgctgtcatcggctataatagtttttattctgtatcttactcctctcttaatcaatggtacatattggttcacctctcaataaacaccgtaataatttatcgtgcaaaaaaaaaggtaatcaaactcagaatggggtgtgtgtactgaagaaccatgtcaatgtcctaaacacacatacacataaaaaggaacaggtggaaagtatgtatagattgattggatatacttagttaaatactaaagtcaatgcatgaaccacatgttcatatatattgtattgtacttaaagtatcatcaccatgtacaataataataatacaacgtaggagtgttggtacgtactcaacgatcagtaacatgcaaacacatcgcacttttgttaggtgaagagacagcaacgtggcagtgtgtgtatatatatattattacatgcatggtattgaccattggtgaacgtgcatgaattaagactacacggtcagtacatgcaaattgtagtagtagaaatgtatcaaatcatcaaaaaagctgcatacattgcgtaattaactgggtttaatttgttgaattttccgatcgatcgatgtgtcttcaacacatcaaatcaatgcagaatttcaaaaggaggatgcatggccagaagaaagaacaagatgatgagctcatcatcgaagtagtatatatgctttgatagctccaggtaagacattgtacgtatggcgccgtcgctgtcacacaaacaaaaggagaagagaaaaataaaaatttataagaaagaacacaagtctctttcgcgccactaagaaggcaaccattttttagggtttttttttttctaaaagatcgatcgagatgtcgaacacgaaaataaaacacacgtatatatcaatcggcatcgagtaatgaatttgctggcatcgatggatcggtcgatgttaattcagatttcagagtgagagtagtaggcagcatgtcaccatgcacatgcatccatccatcgatatatctatctacctagccattgggcccggttaattgcaaattaaggtgcgacgacgagaacgagtttatactacaagcaggctcctggttcaaaatttcagttctatcggacctcccctccacccccaacccccatattatattattttggtcaaaattttcaattttttaatttattgaatttggtaacattttgtttaagtttgacttttttttgaaaattcaaaaaaaattggatcgacgtttcaaaaattttggtatatcggcgtcgctgatagaaatgccgaaaatgaaatattgaaccagagcatgctagagttcagaaacactggttatgtagatatttttcaatcatagatagagctttaattagctgtatgattttatcatgattgtaataaatgcatggttttaaatctctaactatagataccgctatcttcggttatagctatttgaatagagatatagttatttgttcttgcatacaatttaaccgctatagctgctgctataactgtttgagaagaccaactgttaaataccttagcccgtcttttaaaacactgaataaatgtaatatatgtctgtctatatggtggtatttctttttctatcttatcgatggtctgttatgagttggctgaagttatctggacacatattgaaacaagtggctatagtctttttaagcaaatcaaataatatatattgttattaattatgttaaataaatctagctaggccatatgtgcatgcatcatcagagattcagaaacaatatttccttcgcctaattaataattagtcgtactctatataacttataagctgtactttttaatgaaaagatatcttgaatccatgcatgcataatgaagcatgttcaatttactaatccttacgattttacaatccaatcatcatgctgtcgaattcccaagaatcagcgatatagcgtatctcgtgaaagtgatatcgggggctccatttcttcgccttgttttgtccatttcttcctcctctgctgctggcatgcacgcttctcctttattttttttccatgcatatgatctcatgaacagggccatcttgtttgattcttccctttaaaactacaaaatgctttctccttttcatctttttgagttgacatattgtctaacctatagctacttttaataaacaaacaaattaacaccttctagaatgatgagttttttaactttaaagacagaaattaatcatgttctacacatatatagtactatatatatcacctgcttaattagtaactgatttaatcctgagtatatatacatgtggcagctgaggaaaagaagtaattaaataaattagcaacgaacctagctagtcggctagctctaggtaggtatatagggcgtatttttggatattttcttggcatgagccggctaggtttgctgctgtgtttgaatgaagaaaataggtctcgtcgaaatcagagtagggcccacccgtcggtactgcctccaaaaggccaagcaaaacttcaaacacgtcgtcatgcatgcatggagattaattatttgcaaggattaattttattaactcgatcgactgcagtatattgcatcatttcaaatgcataactaaaataatactccctccattttttaaatattttattgagaaacacaggacaaacataaatacataatcactcataagtcataacgcgcgcatacttataccctcattctttttatatgatgttggtttgttcaatagtactctctccgtttcaggttaattataagacgttttaattttaattaaagtcaaactatttcaagtttgactaagtttataaataaatatagtaatatttataatattaaattagtttcatcaaatcaataattaaatatattttcataataaatttgtaatgggttaaaaatgttactatttttttttataaatttggtcaatcataaaacagtttaattttaaccaaagtcaaaacatcttataacatgaaacggatgtagtataaaaaaacagattatatgatcgattgttttagactatgtgattagctgcaaaataattaatccacatcgactcgcgcaaatcaaacgcatgcatgggtcgatgaatgcagcaatgcagcatagtgctaagtgctaactacagttcgatcgatccagtcacgatgctgtgatggatatatgattgaaattattagttttcgatcgatgatcgatgcagcgagagccgtacggcctaactgatcgtgctgctcatgaatgaaaatgcattatgcagatgggagtcatggagagaggtatgggctccaaggaggatctgtcgagaggtcgatcgatcgccggcatgcagcttgattgatctgcaaaacattttctatctacccttggattcatgcatgcgtgatactatgatttaattcattacctcagctcaatatgatgcataaatataaccgttgttatactatggttgagttaaatttcagcaaaatagagagaaaaattcgaccaacttgtaataagtcattaggtggaacaattgttatacattatttttttttcttgtttttaagtagttttcttgctttgtaattaatccatgattttataattcatagctatccgtcatacaaactctgcagtaattagatatagcttctttaaagtaaatatcgaaatgaattcgatgatcttaaaaaaataaacagagtggtgactaattaatgtattaggccggtaataataattcaaacaaattgtttatactagagatttaaaacaatctaacctttatatgtctaagcatgtagctggccaattttaaacaaattggtaaaactaaatttctgacatttagaaatcatcatatggttaaacaagggagccacacatatagatatatacagaacgcaaaccacatggacatgacaaagattttaatgggatatattattcgtacttcgaatggaattttatctgaaagttcagcatcggatagaattaagcccaataacatttgggctcttaatgctggtgaatcctgcagcagatgtagaacagccagatgtgtgtcaagcctagttggtgggccagaattgcaatcaccgaggcccataaccacatacatataggccggtacttgtctcaggcccagcccaatctgtgaggctgcaatcattccattttggaaaaagtacaccggaggtccttcaacttgtcatcgagttacaaaatcgtcccccaaccgcaaaaccggatatatgaccacccttaactcacgaaaccgttcactttaggtccttgggtggttttgaccccgggtttgtccgacgtggcagctgaatcagcgtgggacccatgtgggtcccacatgtcaggaggccacatcatcagtcatcaccctctctcctctttctttcccctcatctcgcccttcatcggttcctcctctttctcactcttctcagcggcggcgccggctgcgaggtaggaggaaggaggacgtcgacgtcggcggcggcaagacggggagaaggggagggcgtcgacgccgcgcgagtgaggtcgaggatggagaccacggcggcgaggtgagcgacctcacggcatcgtgcaagcacggcagtggcccggtggagttccgcggctgccaaagatgggcccgacgggtgtgcag

SEQ ID NO: 24313 - DNA, 2072 bp, Oryza sativa
ctctcccgattcgtagccgccaccgcgtcgccgggccgcggatctcctctcccgcctcgcagccgttgccgccgccgcctcgtcgcccggcgccgcgtcgcccaccgccggatctcctttcccacctaggcacggcgacctcctcccctcccaccggccaccgtgcagagagaagcaaagtgacagagagaggggatgaagggagaggagggaaagagatggtgatgatgtggcatattgacatgtgggacctatgtgggtcccacgctgactcagccgccacgtcggacaaacctgggtccaaaaccaccgaaggacctaaagtaaacggtttcgtgagttaagggatatcctatatccggttttgtggttgggggatgattttgtaactcgatgataagttgagggacctctggtgtactttttccttccatttttacctcattgctgtcaaactgctatcaatgctaatcaacatagtacaagattgcaatatttcattttttttttcacctacaagcaagcattaactcaagggactgtccaccagttgatagaaaccctttagaaatcatgtaaattttaaaccattcgattactttaagattcatacaaatcaatcaaaccctaaaacccatttgttcctctctctctccgccccccttctcccaactcccccacacgctgccaatgctatcacaggcgtctaatcgcgatctgcaccatctccaccaccttcgccccagcgtgccaaggtctggctggccgaaatgtgtcaatgactctggcaaggcctcccaatcttgccttctttcactccctctcctctcttttttctcaagccagcggggtgagttgcccccgctcagctagatccaccaccactgaccgtcgcttctaaccattccttctgctttgtctcctgcagccaacactagcccgtcgcatgcttatgatcccgtggcttcggcggcgccgcggctgcctcgctgctcaccacgggttaccctcccatgtccgttcctctaaagccgacgacatccccccttccccctccctccaccccaatgaccctaatccgtaggtccctagtgaggcttggggttggaaaagatgaggaggttgtttgagctgaaggagaagggtggtaacaggaatcacaaaagcacatccgatgatacaaaatctacaacatttggaagtccattttctatcaatgaaggttagcagtttcgttaattcaagttatcgacaaacagggtgcacgattgcaaacaagaaccgtcagccataatctcaaaggaacaaagcggctattaattacactgaattgaacacatgaaacgccacattcatcgatcgaaaatgcaaatacgtacaagatgacacactccatttaattaacacaaactaacagtttgaacttgaacaaacactgatcctaaattatcgacagcaacgacactgcttgaacaaccctgaattaagcaagttaattcgagcaatcattaatcctaaatgaaattacaatcctacagtagatattacgcgcttgatagtttatcaaagtgtcaaaccaagccggccatggccatcgcggcagccgacacgacgggagcgaagaacgacgccgcggcgaacgcggatcccgccgccgctccggtgtcgtagtccgtcgacggcgccggcgctgctgccggcggcacggcggcgaggacgttgatcatgagcctctggccctcgttgcagcggccgaggtcggggctggcgaagtaggcgaagccggggacctagaggtagaacaccctggcgccgtcgcccggcacgggggcgtcgccggcgtcgacgccggccgtctcgttgcagtggtagtaccccgccttgctcaccttgatcaccgagtcgttcctgtactcgaactctgccaccacacgccatggatgcgaatgcgaatgcaaaattaaagaagaggagatcgatgacgagttgacgacgatgagatgaaactgccgttgattcgttaccgatggagtcgccgacgtagaaggcgatggacgacgcccaccgggagt

SEQ ID NO: 24314 - DNA, 891 bp, Oryza sativa
cgatcgatggaccgattgccggagatcgaagaagaaagaagcggaaactgctcgtacgtgtgattgatggtgtgccgcggcgatcgacagaagtggcaagaatttataggcggaggcgcgcgatcgatcgatcgagccgttgagagggggagcgtcggcggcggttgcgtcaaaaagcctcgtcggcgccgcgcgcgcgggagggagtggagaacgtggccgtttgaactcggtcgtctccgcgcgctctgcagttgcatatgcgatgcgaacttgttcgtgtctgcaccgtgaagacgaggtttggaattcagcccatttgtttttcgtcaacaatttcggtccataggggtgtatgggcttgaattacggcccatacatgtggaccggtgggccggccctttaacgataatgggcctggagttgtctgttcattattaagctttggaataagttcactttaggtccctctatttcttcgtcagttcgattttcatcccttaaccgcaaaaccgggtataacccgtcccccaacttacgaaaaccgggcaaacgaggtcccctagcagtatggagcgtagttttaattgactgacgtggcacttgcatggctcctttgactgatattcgtcccacgtggcattgacatggcgtttacatggcaattttatccccacaaaataataaaaatcgtgggacccatatgtcagctacacacaaaataattcctctctctctcgcagccagagcaagcgatgggtggggccgagaggggcggccgggccccaaccggagtaggccggcaaagcggcgcgaccggaccaggcgaggggcaaggcggcgctccacgcactccctcttcttcatcatcgcgccgcggcgccgcctcac

SEQ ID NO: 24315 - DNA, 18736 bp, Oryza sativa
aggagatagagagaagaggtagtgatgatgacgtgtgggtccacatgggcccatcattttttattatttgtgtgtgaaactgacatgtgggtcccacaagttttattattttatcggatctaattaccacgtaagcgtcacgtcaacaacacgttagacaaaaacctagtcaaaatgagtcacataggtgctacctcagccaaaaccagatataatactgttgaggggcccatttaaactgttccgtaagttgggggacccgtcgtatccggttttgtgactaaacgaaaatcggacaggggcgacaaatggagggccccaaagtgaacttattccttaagctttttaatggacctctgttaagacccacaagtttatgtgggcctggtaattatctggcggcccatccagaattccagacaaggctagtcaactcggcaagggtttcctcgccgttgccgtcgccgtcgccgtcgccgctgccgcttccgcttgcgtgccctcgtcgccgtcgaatcgctcgcccgtcggtcgggtccggtgacctcgctgcctccgagatcctcctctcctcgcctgcgcgctcttcccgtcggctagaagggctgcttcttccgtcccggctccgtcgccatccccccgccggcggcgacttgggcggcctcggctacttcgcccttgttttccggccaagttgaaggttccggttccgtttccgatcctcaggtaaaagagcacatacttctccaatcatttgaatagctaacagcaatccattgtgcatttgtgcttcatgcggctacggatgtatccatcaattagttgagagataggatcgattcactgtgtgttctactgatgtgtaaatgccgctatgttctgcatcatctgtgctgtgggatttgctatttctgttactttgatgcggccgcggtaatgtataggagtaggaaggatttattggcatttcaccaatcgtccttagttaggtagctgatgcgacgctgaagttggctgcactgcctcaacagtataactgagggcctttccttgaatcattcgtgtgacttctttcacattcctctgttgtttggaggaataccaagggggatgggctcatctgtagagtattttttaaaatatagacagtagcatgtgttctggatcataaactatgcgaaattgcgagccaaaattttgatgcaaggttgctttgttacaaatatgatctgtatttccttgatttaaaattaagttgttgtgtaatttgttcaactacaaagaatgtaaaatcttgggactcggattgttggcctgtatttcacgcataaaactacaaatattgttatgcttttgtttaactcctcaggggttttgcagccagcactcgaattttcatcattgttttaggcatttgatattcttatcagttcatcattctaaaattaatctactcggattctaatagattttgagaaaatggatcctgaagatcttactgactctgaggaagatgaagatgatgacatgatgttttttatcttgcctacactatatcttgtttctactggaagcgaagagccatgtcatacatcgaagttcagtggtgcagagtggatttgtgaagtgcttgaagatgaccgtggtgaaggctatgccaaatttcgaatggagcctcaaattcttcagaaattttcagaccttcttaggtcaaagaatcttttgcggaatacaagaggcgtttctgtggaagagcaaattggcatgtttatttatatgctctctcgaaatgccagctttcagaaaatgagtgatagatttgagcacagtagggagactatccatagacatatcaaggcatgctttgatgcaatcacctcattgacagatgagtttgtcaagcatccttcaactgagactcattggaaaatatcatctgatccgcaatatgggccttattttaaggtaggtttaacctgtctctttgcattgtatgaagttctacacttctctgctacatctgaatcagtagtgtgtttccttgcagaactgtataggggcaatcgatggagttcatgtacctatcacaatatcagactatgaagcagctccatatcgaaatatagaagattccctttctcaaaatgtgatgctggcttgtgactttgatttgaattttgtccatgtgtgcagtggccacgaagggtctgcatccgacgcggcagtcctatatgctgctgtggagtctggatttgaagtcccaagtaacaagtattatttggttgataggggttatgcaaacacaccatcttttcttgctccttatagagaagctgcataccatattgaagaggaggagcagagcaattgtcagccaagtgactacaaggagttgttcaaccttcgtcactcaaagctgcgcaacaacataaagcgtgccacagcgctattgaagatgaggttcccaattttaaatgtcgcaacattctatcagatagaaactcaagcgaaaatcccagcagcagcagtggtgctgcacaatataatgcagggccaaaaagatgatgatgatgatgatgggtgggcatttaaccaggcaatgccagtttcatcccgtagaactgtagttttacccagtggggatgatgcttatggcaatgatgtcgaagaactgaacaaccaatgtagcatgggtgatgctttgagagattatattgcgaagaagatgtggacagattatgaaaggaacaggaggtaggtttccctattctgaggccaaacaacatataggtgaaaggaaagagctgctcatgtgtgatttgtatcttgaattctgatgtttatggttaaagatggaactaggcaatgccctgtagaagctgtactcagttgacacccaccagtaagatatggcattttcatgtcctccatttggctatcaatctgtgtggatgttgtggttgccaagatagtgccttgctagcaaacatggcgtggcatttaactaccgccacgccagtataaatggcgtaacaaaagaggaattgcctatgcatccgtcgggtgatttttgagaaaaattatctccctttagatttgcatcttacggactaaaaaaataccaactagaaatttcaattgtcaacaatcaacaaatactataaaatttccaactaataaaatgcttaacacgctcaggcacagcttccagattacacccgaatttaccgtacgtaacctaatttaccccaaaatcacacgaatttaccctcggggactcaaaggtggagctgaagtctagctaaacagtttcagctctatttaaaatgagtgtggagctgcttggagtgtgttctcacaaaatgaattagagaaaatgaactacagaggtggagctgggtttaggctgctctacaactccactctaaacccaattcctaaagttaaatttatgagttggagctctaccaaatatgtctatctttcctaagtaagatagaatatgcgatactatttttatatttttctttattcctgtgacgtgaaggctttactagtagtagtactttgaaaacagatcaagctgcatcccggcaacaaatcattgaactatacaagaatttttattacatgataggaattgctgcttgaaatgcatcagtaaataacagtgtgcaaatgtatcgtgttgtagcagcaaaaacatctgtagcttactgctgtagtgatcaagaaacttcggaagataaattcggcagtgctgcagacaccaatttattacctaacgttcatgcttcattcctcagtgttccacttctattgacaccattttattacctaacgtcaaatgctcgtggcgaaaaatgcttcctttattgacattacctcactatatacatcatgtatcaatggccgatcttttggcgactcttcagagcattccaggccaagtttaaggagttgtagagcacagatatccattatacctgtcttgtgttcatgcaattgcagggtatgattagaaggttgttctgtcatttcaggaataagcctggggtcaagtatgtctttgatctgtgaaagtgatgcattgacatacatgcggagtgtgaagccatcagtaaatatttcattggtagggtgtcttcctgttagcatttccagaagaataatgccataactatagacatcaccctcagttgagatttgactgcccatgccatactctgcaatgttttgaaaccaaaaagctcagatcaccagtaaaatgaaccatattgttaatcataaaatactgaagtcctttttattaaatgatactctgctttgtttgaaaacaaaagattcagataaccagcaaaatataggagtaccatattataatcataagagatttttttagataatgggaatttttaaaccccgcttctacagcaacgggggtgtataatcataagagatataatcgtaatttcgttatattaaataaatgattttctgcagtgtgctctgaaaagtgaaaaccaactcaccaggagcaatgtacccaatagacccccttggcccagccatgcttcttgatatgctttgagttccggatgaatattcacgaattgaccttgccagaccaaagtcacagacgcaggcaacatagtcatggttgaaaagtacattgcttggcttcaaatcgcagtgaacaacaggtggaatgcattggttgtgaaggtattctagagcagaagcaatatcaaatgctatgctaatcctttctcccaaactcaaatcaccacatggatcaaaccttgtgtgtagtcggctttctaggctaccattagccatatattcaaatactagagccttgaactcactgcccatcggatcataagttgagcatgcagttatcaccttgacaagatttcggtgacggatgttcttcaatgctttgcactctgccataaagctatccaatgcaccacactgatcgagcttgaacaccttaacagcgaccatagtgtcttctgtatccagtatacctctatagactgtcccaaaatgcccagagccgactatgttggctgcagaaaaattatttgttgctttgctaacatcactgtatgttaactttttcagctccatgtaggagtgatctatgtgctcattggatttccccttccttttcaggaaaacatttacgatcaacaaatataatccgaggattgaagaaagtaagacaatagatgtaaaaactgcccacattggaataacgagtttatgttttctttggatgctaaacaaaacaaacagtcatctcgtccattggaaaattgggtgaaagggtgtgatttccttggcaaaaccccttatttttgtcaagaaaatttccccccactggaattggccccttcaaagtgttggattgcaaatttaaaatctggaattagggtaaaggtccaaaagaatccgggtttggccccaaataatttgttcgggaaaaattccagcctttggggcctttgaggttttgttaatgatgtgaatacttccctttaggaggttgcttgctacacgaagtgattccatcggacgcaagaaccaagtgtagatgggatcctgcctgtgagtctgttgtgggaaatgttcaaagaagcaagatttatcaggctaccaaattttagtggtatggagcttatgaattggttgtgtgataaatcaagtagccaactcaattgatttagcttgacaaacatgtctccgcttatgcttccagtgagggcattacttgaaaggttcaatgccaacaattgttggcacctcgctaaagttgtaggtattcttccactcagttgattttctgataaataaagttcagccaattgattcaagttaccaatggattgtggtatttctcctgaaaatttgttttgtgaaaggctaaggacaacaagattgtttagttggccaagagtatgaggtatgctccctgtcaatagattgttatcaagatagagtagggacatgctagataggttcccaatctccaagggaatggtgccagatatatagtttgacgggagagcgagtgaagttaatgttttcggcaggtcggctacagagctgggcatgtccccacgtaggttattttcaccaaagtgcagtttcagcagattggagcaatttttcaaggatgataggaatgcccagtctccagcttctaactggtttgagtacagcatgacaacctgcaaatctgtcatcaaactaaaagaaggaatcacccctctcaaagagttgttggccaggtacagaaactgcatgttggaagcattagctagagatttagggatttctccaacaaaatggttgttagacatcatgagaacttggatgttaggaagtgtgtttcctatgtcaggaggcatcatcccctcaagattgttgttggccaaaccgagaaaactgatggacgacatgttgtaaatggagggatttacagccccagaaagattgttgtaagagaggtcaagatattgtagcgccgacagcttactaaaatccggtatacttccctgcaactggttttgtgcagctaaaaatgctgtaagcgatgagagattcgctagagatggtggtatgcctcctgacaggctatttgttgtaagatcaaggttggtgatccgtgaagtgaacatcgttacgggtggaattgcaccagaaagattgtttttcctaaggtatatctccctgatggttgagctgttgaaaagtgctgcagggatgctcccgtagaggctattgttcttcagtgaaagatagcggagtgacgacgcattagccaagaacaatgggatctctccggtcaggtagttgtccgcgaggccgacagactccaacgccgatgagctcccaagcaatggtgggattctgccatggaggttgttgctggttaggtccagggatgagaggttaggaagcgtaccgaggcctcgtgggatctcaccactgatcgcgttgaagctgaggttgaggtactggagcctggccacatcggctgtgaatgtgaggccacctgagaggccattgttggggaggtggattctcgcgagggacgagaggttggagatgcagggtgggatctctccggtgaggcctcctgcctccatgtccagggccacaaccacacgaggtcgttcttggagcttgatggagcaagtgacgccgcgccaggtgcagaaatcgggtgagatggtgttgctccatgtggagaaggcggacccgtttgggcttgaaagatgtgatttcaggcaaagcagtgcttcccgttcatcagctaatgctgtcagggtggagaagaagaggattgcagcgactgcaaccagagctgcacatgccatcttgcttaatttgctggtgtgtattttggacagtatgctggtggtaagttatgagatgcttgtgattcttaattatagtggactaggatgcgtcaagatcttctacccattaaaaccatatattggccacatctttgacccatgttgattgttggatggtgccatattcttagtcaaatagtgaatgcattaattcctgttgaacatgattaggttgcgtgcatggacttaattacggagatcttgttgaattaagctttgactagattgttttattatgcaaactttcagaccttatttttcagcaaaataagtaatggtaccttattagttagttataccaactgacaatttgcctgcctacgtacattttccaacatccgtctgacggtattttgcgacgcggtgtagaccagttctgaacttctgatggttcatttgaaaagcatgatctttttccaatttcacctaacaatccacaaagtaaactgtgctatcaaacctcttacatattttgtgcattagacaaacacttttgtcctatggtgccctgttgtcaggaaaaaggaatatcaatgctttataaaactaattggaggaacatgatggatattaattttaaacgtatttgttattttctttggcagatcactaatctatatttgtagagcttatatcgttattactttggattatgtcatcgaacatgtcaatcatgggaaaattgtcactgtccacaggtatgaaatagttgaaacttcaagaatagaaaagtaagaacaaatttacgtggtaatttcctcgacaatggaagtccattccattacattagtcaacacatgatctgcctcaaagtcgtatgaaattgataagtctggaaatttcaccttatcctttcgataccaatgatgtatctttgacatttgtgactggtttaggcccagtcactgctcattggtcgttgataagaaaacatcatataaaaacttctaaaatttataaataattagttataagttcaaatgcagtggctctacattcgttagactcataattttatgatcttaattactctgaattaaatgtagaacatatagtactactccctcagtcccattttaagtgcagttatgggtttctgttttcaacgtttgattgttcgtcttatttgaaaaatttatgagaaagttaaaaaaagtcgcagataaagtattattcatgttttatcatctaataacaataagattgctaatcataaaaaaattcaaataagacagacggccaaatattggacacagaaaccaaaaaaatacacttaaaatgagacggatggagtagagttaaaacttctaaaatatagtatagctagtaaatactacaattggtcacataacttgtaaaattcatactagctctaaaaatggaaaactcaacggggttgaatttcatagaacacactctttattgctgtaacccaaatctttatagaacttagatataaactatacttagaattatttaacttaaataaagtataactaacatagagcttggtaaattcataactcacaaatgctaagtgataaaatagaattattgcttaggttagaattgttgcttaggtttgagtgatgtgggaatagttgatcttcaggatggttctactaggggcctacccctagtcggtttgctgtgtgctaaggtagataggcttttcactgaacctttatctagttgtttctaagaccatgtttggaaccagggactagagtttagtccctgtcatatcgaatgtttggacactaattagaagtattaaacgtacactgaactacattggacatatagccgattgctcaaaaccctagcgacatcggctggaattaccccattagcttgtcagccgattggctctttgatctgctatttatatatcttgtcagttacaagatcgtactgactggcacgctagcatatcatctattttaggacctgtattggagttaagcggatctcccaggccttcgtgtttttgtcgacttagttcgcgttaacgcagatttggcactatcgaccgagcgcggatttttttatcaacactaccttgtcatatttggtgattaaagaatggaacggctttgattcaagttactcctgacaagtaatttgttttttttctttttgctgataaggaacgtaactttaatttttttccttaattgattctctcggatcgctcaatgtgtacgacttctcaccatgacattgattgtacatttttctaattctacttgtcataaggcttatgtggagctcatggtagaaaataagaatggcgtacttgtataacatacattgtaaagtcaaaaatcggattcaagaagatagctagttataaaactatgatcaagatatgcatgtgtgtggaaatgtgaaagtgaaatgataacccctttgtatgatcctcctccttgcacttatttagtgaacatggctatttttctcccttttttttttctttttttcatgctcgagaatattttgtctctttttctttgtgagcatttctctttttctcatcaacatttttttttggctcatgtctcattttgtatgaatagttagaggtaggattgtaagcgtatgaagtctttatttggtggatggatgactgatgctgattttcagtgtagaagtatcacatatggtagatgcatgcatgacatatttttgctaacctctagtgtagagggtgagaaaatatagtgggtatcagtgttaaggataaaacactgaatatagtaggtatcttctatagttgggtttgtactatacggaagtaccatatacctaattatacatgggaatgtatcttttgattaagagaatacgataaatccaaaaagaaattgtcttctcgggatagaaagtgtcaggaacccaaccgagaatgctcatgttacattctcaccccaaacgtggagcgttggggaccgcatctagatttgagagatattttgcagtgcgccacctcccaaaggcatagcggtggcgcctacttggcgcgtgtgtgcctccagcgcgcgtttcggacgagaaggtatagttagctaatcaattagttttagataattacaatttgaaataatgacggtagtagttaagattttttttcatgagatttttctaactaacaaattgaaaagaaatctatacctgaagtcaaattttcaaaattttaaatctagatttgaaatttttaactcgaaatttaaattttttaagtcaaattttgaaaactttcaacttttcatcttaaatttgaaaacctttcaactcaacttcgaaaactttcaacccagatttgaaaactttcaaatctagatttgaaaaaattcaagtcaagtcaagatttgaaaactttcaagtcagatttagaaacttttaactacagatttgaaactttcaactcagatttaaaaactttcatctgaaaattcaaaacatttaacttaaatttaaaaactttcatctcaaagttcaaaaattcaactcaaatcttaaaaattttcaactcaaatttgaaactttcaactaaaattgaagatgaaagattcaacttctaaaataaaaaaatcacaaaaaaaatgcaaaaagaaacgaaaaaacacagacggtagcttttccaggaaaaaagttacggacgtagacgctacgcgtgagccttatgggcctaaaaacgcgcgcgcccgaattagctctcgtggcggaagttctgcatcgcggtatttgaacggcggcctgaagccgcgtcctcatgcttcgccgggattgcgtcgcctggtggtattcttgattttctcaagtttggccgtgctatatgtgatgtcaggaaggatgccatcaagctcttgctgttgctcgctgtgttaatttgattctttgggcaagctgagagcctgagaatggacttcaacggttgttcggtggaaaggcatgtgtcaaaacccaaaaccgaatcagggagcttgtcaatagggtggtggacggttccgtggagatatttgaggaattgctcgtgcaggtagagctgcagtgcaatatgcatgcatagctgcacatgacttttttttctttttcttccgcggggaagctgcacatgacacatctggctggtgtgtattttagacaatatggttgtggacgcagtgtgacgtcagcgttcgatttacgtgcaaaactattttaaactgatttttcttctaaattacttatccaaatcctgatctaattgcaccattaatttcattacaattaaacttcaaaacaagaccacacgtggatatattccgacgaaaaaaatagcttattattgaattatttttaaatattgcacgatgttccaccaggtatatcggaattgtttcagtaagtagatcgaaaatgtttcactcgtttaaatcagatgttgtttcaccttatataaaaacaatgtttcagaaaatagcgaaagaatgttttagttcactgcaacattaaatctatacatagtgaaacattgtgagtacactatgtgaaacatttttcggtggaataaaaaataaatcaaattcccttaatagggggtttccaaaatacgtggtttttttttttttgttgcaatggaatgtttcgttcactacaacattagatttatacatagtgaaacattatgagtactctaggtgaaacatttttttgtggaacaaaaaataaaccaaattcccttaataaagagttttcaaaatatgtgggttttttttgcaaaagaatattttaattcactgtagatctataaatagtgaaacattgtaagtatactagttgaaacatcttttgtggaaaaaaaggggagggagaagtaggtgggtccagcagatacgcatgtagggggaggggagcgcccgatccggctccccccgcgccggtcgctcagagtagagcattatcgtatggttgtaagttgagacaatcgtttatttgacaatatttcaaaacctaactagtaatctagactttttttttttttgcttatttgaccctgcttttcacaatgaacacctgtctgactctgctttcattgcaccgttaaagtttcattaaaaaaagaaaaaatatataattacttttcataatgaccaaaataccctcgaaaaacccaatccacatataaccatgtcccttcagatcccctctctctctcttgtatcccgtctctctctcggcgagtggtggtggcgacacactgaggggataaagcggcggtgttggctcgtcgagggagggagcggcgggctatggagggaggggatccgcaccagcaccggctcgcgaagggagggcggcgcggagaagcggcgctggctcgtggaggcaggtagcagcagcgtcggggcgcggagggagagagcgcccccgtagagggaggtgcacgacgcacggaggggataagcggtgatgtgcctgcatgtggagggagggcacgactgtggcgccggtccgtggagtgaggagcggcgatggtgccggcgcggggagggaggcgcgggtggtggtgcgcttgcgtgtggagggaggagggggcagtggcgcgtggagggaggtgcgggcggcggtgtgccggcgcgtggagggaggaggcagcagagcgccatcacgcggagggaggcgctggcagcgttggtgccagtgcacgggggagtggcaactgttgcgtgtggcatcggcgactactgttatggcacttgccgtgaatttgttgtttggttatcatctctgttggatttgactataatttgtgtttctacatcattgtatgcaatttgcacggctgcacaaccaatctttaccactggttggcaaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcctctccgccgcgcatgccaatctttttttccggttggtgtaactaaccgggactagaaatatatctttagtcccggttggtaacaccaaccaggactaaagataatagagaggtctgacattgcatgttgttcttttaaccaggactaaaaatgatctttagtcccggttggtataaaaaagtagctctaatctttcgaaccgagactaaagataatctttaatcccgatttttattgcaactgggactattgtggtttttgctcgaccgagtaaagatggtttctccagtagtgttgggatccacaaaataagacaatatgctgtcaaaattttgttaaaaattctgccaaattttatttgccttattttgtcaaaaatccgtcaaatttaagtcaaatttgttaaattgattcaaaattttcaaatttataaattgaagccaaatctgtcaaacttatctctaatctggtagatatacagaattcgttacaaatatgtcaaaagatccaaatatatgcacgttttgatgtaacagggtcaaataagtagagcaaaaggggccatttgccctttagttaacaccgttaactcgctttaacggaattgggtaagcattcatcttcaattttgaaaagcatggttaaataagcgaactaaaaaaagtatagtcatattaataagttaagcttcgaaataggataaaatgagcaattgccccttttaagttttgagatgcttttgattcttatagtggactaggacatttcataggcttttagtcaatatgattttaagatggcgtagctgcagatgacattttctacccatgctgattgtttgatggtgccagattcttaggtcttgtttagttgggaaaaaattttagggttagttgtcacatcgaatatacggacacacatttgaagtattaaacttagtctaataacaaaataaattatagattccgccagaaaactacgagacgaatttattaagcctaattaatctatcattagcaaatatttactgtaacaccacattgtcaaatcatggcgcaggcttaaaagattcgtctcgcaatttacacgcatactgtataattggtttttttttcatatttaatactttatacatgtgttaaaatattcgatgtgatgggtgaaaagtttttgttcgggaaactaaacagccccttagtcgaatagtcaatgtattcctgttgaacatgactagattccgtgtatggacttaattacggagatcgtgttgaattaagctggaataggttgactattgtttcgataatgcaaactacattaagaccttatttttccgcaaaatgataagtccttgttagtaaaatcaatggagagaacttccggcggtctgactggacctgtacgggcagtctaaccgggcttagaaaccatgacgtggagcaggaaaccaccgagttgtgcgaatggaagtccattgcattagttaacactctcttaataaattaaatattatgaaaataataatttagaaaaagtggtataaacaatgaaatcaaagaaacatttttgagaaaacatttatttttaaagatatccacaacaataattcgatatataactagctgaatggaaggtgtgctgagcggctcaatagtcaattctcagttgtaccggaacgctttaaactttcgaagaaacttcgtatgtattttaacttgtccacagggcgttgaacagattgggaagatcgcgaagaaaaaacatcacatcatacatggaaggtcgatggcttttgaaaaatttgttcggtgatgacttgacgttttcttagttcgcaccctttatattgaacggaaactagcaggatatgtagaacaacgaagaaagaagattaaggctctgtgtttagctatcggtgaaagcggagagatattcatttctgcccctatttgatcatggcttttagataccgcctgtttcttatattcgtgacggtggagatcgttgtgcttattgtccgaagcacagcatcagattttcggtcaggttcatcaggtgagtacaatatgagtcgcccttcacaccttatatatatactatatattagacggttctgtaaaatcgtcacagtttttttttttttactctgcgctctccagggatagccggatagaactatctgagatgaaatcatctcggacgggttttgttcaaggatattaaacttttgagtaagtactctgcagtgttttcttaataatcgtgtaaaaacaaaaaccatcttgagtactctctatctctctctctctctctgtcgtaaaacaacttactttagagttaaactttgtgttaatagattgatttttatcttcttacctacatccggtgcataaatatctttttttttatctcttcactatctccgtattctagcttgtattttgctttaaatttagaaccgggtattgatggtgccggataacgtattacacataatgtatcctatctaatattatttacttaatttatatctctaatacatactaatattaaatatagagagacaattatagtgttaaaaaatagatacattaatgaaaaaattatacaatattgtatctaaggtcgtaatataatgattaaccaatcttttatcaaatatggatgtacaatatattttcatatatgtttcataatatgagacatacggccagatacaagtttttcggtatccaaactatatttttttatgcgtctagatttgaaattggatagtatcggttatcctgttttctctcctatattcttaccgcaagcctcaagtcgagtgggtggtcaggaaatacctgttccattatcactcataatttagagggaacacatatatttgtaggcttatatggcatgatgccttccgcgttttgatagggaattctaatcgattaatcgtacgtaattttttttaaaaaaagtaaagataaaatgattcttatttaatctcttagcactattactatttgtaagtacttaatcccattccaagcatgctatatattacagatcagtgggaggttggcagagggagttcctgttttcaataatgtatatttttcactgttttcaaacaaacatcagaagttatataaaattagaaagacatatagaatagaagcaccgaagaactgtactgacctttcaaaataagacttcatgtaattttaggtcatttcctttagttcttttccttttttttttcttcaaatgggaggattttattttcagttatagttttttggcaaggattttaagttatttttattttattttggcagtcatgtttagacgcattatcttaaatctgtggtaatgtcttttctctttatactagtgaattaagtcgcaccttggtgcgactatgaccattctaatatgaatggtatgtgaaaagaatattaatgatattatacattagatttgaaatcactgtttattgtcccaactcatagatacttatttcacttctaaagatatttcttttccgtatttatgtttgattttaattgttgtcatataatatttttgtctaataggaatcataagctcaggtggtgtttcagctgaacctagagcttgctttcgtgcaactataatcttcctacctattaagtgttgttaaactagattaataccctgccgtgttgctgcggaaaattaagttgcataatatgtacaaataagatgtaatttgattatcaaaactaaaacaatttgatacaattttgagcctaaaaataattaagattgtatgtttttaagagagaagaaagaagaaacaatttggaccatagatctacaatccaaatgttataaataatttgggtgatatggcttaaagagagaagagagaaatatcattaactatacttagtggggattaactatataagtatatatataagtatatataggataacaattaacaataaatacccatctttcggctaaaacaaaatggtgagcgcatcgtataggcttaggatttatattcatcttctccatgccgtttcctccttccgattccccagacccttagcacctttattgttgccacttgagccgccgccttgccaccctattctctatctcaatgacatgtaggtccacatgtgtctatgacatatgggtccagtggcaaaaagttaattgccacatctaaatgtggcaaatggttaaatattcccttctttgttgcacaaccccttatcttcctattattttctacttatcctcctgcttttcacaaatataattttgttttacatacttaaattaatgttcagagaaagtattggcaaagaagtctaggtgcaacacaaatattttatcttgatctgtaataaacgtgtattgtcataaaaataaataatttactatgattatgctaagcttgtgatattatcgtaagaaccaaaattatagaatttcactattcccttggttcttgggtctatatttaagtaaaattgcacaacatggttgtaatataatcttgtaggctgtgtttgagaagttacttttgttctatatattgttttgaatattgctaactaatttaaacttttatatgtaaaataactttatcccctcaatgaacattatttgatgaataagttcatccaaggtcccttaacttgtcgacgaatccgattttcatccttcaaccagaaaaccagatacaacggatccctcaactgtcaaaaccggtgcaatataggtctcatggcgttttggacggcggttttaccttacgtggcgcctacgtggctaaattgacccggtcttcatctgacgtggcataaatgtggca

SEQ ID NO: 24316 - DNA, 5901 bp, Oryza sativa
ctccctggcatcctcgtcctcgaggtcatccctggctccgccgccgccggccggccgtgtcgccgaaccgccggcgcctggagagaggagaggggagatagggagagaggaagaagatgaggggagtgaatgataagtggggtccatgtaggacccaccattttttaattaattattttggtgtagctgacatgtggggtcactctttttttattaatttctaaatcaaatcgacctcctcttcgccttcctcatcgtctacgtccaggcactcaccgtcggtgtccccgtccaggcacagctccccggcgtcctcgtcctcgaggtcatccctggctccgccgccaccggccggccgtgtcggaagaagacgaggggagtgaatgacaagtgaggcccatgtaggacccaccattttttaattaattcttttggtgtagctgacatgtggggtcactctttttttattaatttccaaatcaaattgccacgtcaatgccacatctatgccacgtcagatgaagaccgggtcaatttagccacgtaggcgccacgtaagctaaaaccgccgtccaaaacgccatgagacctatattgcaccggttttgacagttgagggacccgttgtatctggttttttggttgaaggatgaaaatcggattcgtcgacaagttaagggaccttggatgaacttattacttatttgattggtcatatggtccaaaggaccatttggtctgttcgaccaaaccagcccattaggcctatttgagagactaatgtgaggcaaccacttcatcaaagagtgttctcagccttttcctactcccgtaattttgataaattgaccctttgaaaaagcttattttgatattgagccgtgtcaaaaactaattttaaaaataggctgttttctcgcgccatcgtacttggcgctgagctacaacgtattagcgccactttctttggtgctgagatgcggtccgacgtgtcacgtaaatcacacgtcatgcgatgtcagagccaaagaacctccatggtctagtttgtataaatagtatgcatgtacgttcttaccgtacggtatgtctatcctggtggtgaagggctgcctctcaaaactacaggtcaaggaatcgaaccctgtagcttcttatttttctttttttttccttttaggatctacataattatgtagcaaaatagagggtgaaaaaaaactgaaagatgtaaatttataccaactattaagctataaataccacatacataattttgttccttccatatttaaaaataaaataaatttaaaaaactaagctataaatactgcatacataattttgttccttccatatttaaaaataaaataaatttaaaaaacatccatatttaaaaataaaatgaatttgaaaaacatgtgagatttttaaatagaacagcaaaagatgcttgtacttatatgggaaaactttagtgactgagaatcgaacccattacctcacagtatttagcacccagagttctccaccaagctatcttctctttaagtgcaaaggaagcttgtagatagctaatatttgtaaattgaacagagatcagcgcaaaatactttggcgctgccctcggatgacgtgtaaaatccgcgacacctgtgatgacatctcagcgccaatgatagtggcgccgaaatgttatatctcagcgccaatctctatggcgctgagaaaacagcctatttttgtaattcgtttttggcatgattcaattttgaaataagttttttaaaagggtcaaattgtcaaaattacggtactcattgtatattttaccccttttagaagacgtactcctcattttgatggctagaattcttgtttggtattttgtcattttgtgaatccaactgccattatttgatagatgacatgactcattttggttgcttattgagtttcaattttcacttaggtagatgtgtaaattactttcccaatttaattaatatatatagtccagtactactagtagcctctcctaatgtttttcatcaaaaaatattctaaaaattgaatagttattatatttttaatcatgcttacagccaattctcgattcattttttatacggaattcataacttctgcttctatttatcgctagtcattttcaccgacatgtaaacgattcttgcagggtcaagtccgatatgcaacgcatgtccatgctgcccatgcaaatgctgatcattaccatgtcgtcgttgttctcttcgtaaccgcattgatcaaattcaattgttttgatgttttgtatttcctcatcaggttctattttgtaatataccaattcagaagcacatacatgtagtacaattcaacacatcaatcaatggcttaccatcagctgataacaaccaaaaccgtacccttttttttctcttttttttaaaatttttttaggctcttcaagttatcccttctttctataaagttaaggccaaaagctcaaaccttgtgctttcacgtcatcatcaaattgtgaaccgttggatgaatgtattagattgcttctcagacgttggatggaatgcagtatagagcccaacccatcagtcaccgagtgagtctcttcgcctcctcaatgtcaaatatagcccacatgaacacatcggcctatctccacacacatctacatgtatccagtccgtcaatccgtataaaagagttttatggctgaacgctccttcagttgatatgtgctacctaaattatctataaatttttgatagggctgctaaaaaaaattctccaagaaatctatttgtttcttctatttcttcttgagattatatctcttatctaacaaattgatattaaccaagtcccgcagcaacgcgcgggggcatcctctagtaagtttaagagtaggatctattttgattctctaggtagtcccactaaaaaatgattttcctgtacagggactcatttagattgcagacggatcataattggtcgcgtctgtaaaatcgtcctccatttttgtgtgcgactccttaagaggatcacacggaaaaatcgatttttgcatgcagatctattaaatggaccgcacgtgaaaatgagcatatttttcacaggcggacctattaagaagtccgcacgtaaaaatgcccctccctcttttccctcttacccatttcaaattttcccctatttctctcctctcctctctatctctttctcttctctcctctcctctcctccctctcgacggcgacagcggcggtgggcgtaggcgatgacgacggcgcgcggcggcctcctccacgctctaccgtgcacagcgggcccctctagcggtggagacgctggatctggcaggcggcggtcaacccctgtatggattctggctcccctcccctccccttccttccctctccgcccagatctggcagaggggagtggcgtcactggcggtgtcgctaaaaattttaaatctaaaataggaaatataggagtaaaatttagaaataatagaaattcataattaaaaaaacaaagaatgttggaaaaaggagtctaaagtccatatacaaacataattttaaaataacaaaagtttagtattagaaaataattaagaactactccctcggtcccaaaatgtaagcatttttagctatgaatagctaaaaattgatatattttggaacggaggtagtatcacgtatatacaacacaatatgaatattacacatggatagtttggtcaagttagtacaaaatttaaatatgttgttattttaagaaattctaataataaaataagaaaatatatatgttattatatgagagaaaggataagaatactagccgcgtaatttacggggccctatactaatctatctatctattatattattaaaacagccttgaaacgaggcaccacgttcgctgtggaggttagaaattcccacattaatcggagaaaaagaaaagaagagttcaagtaggaatacaatctaaaaatagctaaaattcagaattaaaaatatgcaacattaaaataggagtccatataggaacccaatacgtgattaattaaaattcagaataaaaattaaataaattttgaaattagaaaaagaaaaggaagagttcgagtaggaatataattttaaaataactgaaatttggaattgaaaaataaggaatattgaaataagagtccatacaacaatccaatacgacattagttaaagtttggaataaaaatataaaaaaaattgaaattaaataaaagaaaagaaaataagagttcaagtaagaatacaatttaaaattaatttaaattcgaaattaaatataagcaaaattgaaataagagcacatataagaatccaatagtagattaattaaaattcagaataaaaaataaaataaaatccgaaattaggaaaattaaaaagagagttaaagtaggaatacaattttaaaacaactgaaattaaaaataaaatatcaaaatatcaaaagaacacattacaaaaaataaaataaattctgaaattagaaaaagaaaaataatatatcaactaggaatacaatttataaataactaaaattgttgataaaaaattaagactattgatagaaaacaccatctaaaacacatgacgagattaattaagtaataagcctagagaggagcagagttgtggcggttgataatcaaatagaatcctaatgacaattaaaaggaaggacgatgggtaggtcgtgaagcaatcggtcaaggcggttggcggggacttttagaaagtaaaaaaataaatcccaatgataatcatatttgatttttaaaatctcaattacaataaaaatgagagacagggggcagatcgtataggagtataattgcagagcagccaatgattggtgggtcttctagaaagtaaaaaatgaattctaacgatagttatgtttgatttttacaatcccaatgataatatatagtatgcggcggacgagtcatagaaaagtatagtggcagcgtttgacgggatttctaaaaattataaaaaacatgaaacccaacaagacaataaactctaaaaactataaggttcaatttttaaaggttcaggcttccaaaaaataaaaaaataaaccccaataataatcatgtttgattttaaaatttcgatgacaataaagaagggcggcagcgggcaggccatagagaagtacagtgacaaagtcgctaacgttttggcggaacttctagaaagtaaaaaaaatgaaccaaaatgataattatgttcgatttttaaaatagcaatgacaataaagagaagatgcattggacggttgtagaggagtataatggcagcatttgacgggacttatggaaattataaaaaagaagctcaactggacaataaactcaaactataagtttttggatccattttttaaaggttccaaggagaatgaatagaaatagtggtagatcagcatttgacgggacttatggaaattataaaatagaagcccaactggacaataaactcaaactataagttttagatccattttttaaaggttccaaggagaatgaatagaaatagtggtagatcgagcaagctaataaagaataatatgacagaagtaaggggtagcaactatgtgacatttaaaaactataaaattagaaacacgaggatgattaggtttggtctttcaaaatcttaagacaacaagataactagttaataaattttaagtaaaatcatattaaaaagtatataattttatatgggtgctagccgcgtaattacgcggctttgaatggaggcaccacgtttactgtgggggctagaaattcccacatta

SEQ ID NO: 24317 - DNA, 39544 bp, Oryza sativa
gggggctagaaattcccacatttatcggaaaaaaagaaaaggagagtccaagtaaaaatccaatttaaaaataactgaaattcagaatgaaatataagcactattcaaagaagagtccatataagaacccaatacgagattaatcaaaattcagaataaaaataaaataaaataaaatgaaccaaaacggtaattatgttcgatttttaaaatagcaatgacaataatgagaagatgcattggatggtcgtagagaagtataatggcagcgtctgacgggacttatggaaattataaaaaagaagcccaactggacaataaactcaaactataagtttttatatccattttttaaaggttccaaggagaatgaatagaaatagtagtatatcgagcaagctaataaataataatatgacagaagtaaggggtagcaactatgtgacaattaaaaactataaaattagaaacatgaggatgattatgtttggtcttttaaaatcctaagacaatgagataactatttaataagttttaagtaaaatcatattaaataaatatataattttatatgggtgctagccgcgcaattgcgcggctttgaaaggaggcaccacgtttactagggggctagaaattcccacattaatcggagaaaaagaaaaggagagtccaagtagaaatacaatttaaaaataactaaattttggaattaaatataagcattgttgaatgaagagtccatataagaacacaatacgagattaatcaaaattcggaataaaaaaaataaaatctgaaattagaaaaggaaaagaagagtccaagtaggaatacaatttaaaaataactgaaattcgaattaaaactaaggaatgagacaagagtccatataagaacccaatacgagattaattaaaattcagaataaaaaaataaaacaatatccaaaatttgaaaaaataaaagagagttcaagtaggaatacaattttgaaacaactgaaattcaaaaataaaaaataaaaatattgaaagaacactgtacggtattaattaaaatttgaaaaaaaatttctgaaattagaaaaagaaaaaaaagatttcaattaggaatacaatttgtaaataactaaaattggtgataaaaataaagactattgaaagaaaagaccatctaaaacacatgacgagataaattgagtaacatgtgtataaaggggtagagtggtggtggttgatatgacatataaaatttgttaataaacaccaaatagaatcctaataacgattaaaaggaaggacgacaggcaggccgtgaagcaaacgtgcaaggcgattgctgggacttctagaaagtaaaaaaaataaaccccattgataatcatattcgatttttaaaatctcaatgacaataaaaaggagaaggagcgggcggggtgtataggattatagttgaagagctgccgacgttggcgggacttctggaaaataaaaaatgaattccaacgatagttatattcaatttttagaacccaatgacaataaagagtaggcggcggatgggccgtacaagagtatagtggcatcgttttatgggacttctaaaaattataaaaaaagaaacccaacaagaaaataaactctaaaaactgcaaggcctaatttttaaaggtttagaacttctaaaagtaaaaaaaaaaacccaatgataattatgttcgattttaaaatctcaatgacataataagggatgtagaatgcgagccataaagaagttgttgatgaaaaacacgaggcctgggagatctgcttaactccagtgcaggtccaaaactcgccttcgggtatgctagcgtgccagttgatttgatcctgcaattaacaagaaacaaaggcaaagaaaacgtggttaaatccataaactatagccgatcgactaagtgccgatgacatatcatttatcttcgagccgatgtcatatatgcatcgatcggcagttataggtagataataaagaactaaatctactcgatcggctgtagatattaacaatatataatccttatgtcgatatatacttaaatcaagtgattgggatagatcggtcgccataccgagacagtataaatcacttagattaaaatatatactaacaacaagactatatatgttcatagcatagccgatcaaatagatctagcacgtatcggctaatactccgatacaactctatattaaaatattaaaccaagcaaaatataccaaacaaaagcctaatatacttaaatgcaataagatcttgacataaagggcagatttaacatgtcggtaaagcatataaagcaaatatagttaaatcaggtaagatcggctgaaaccccgatactaccctaatcggcaaccaagaagcaggctagatattgagattttaatcatgactcataagatcaaacaactgatacagctataagtatgaaaagaagagcaatatctagacaatcaagccattggaagtttcatagagtggtagatatcatatataatctaaaccaacatcgatatcctaacctaatcggctgccctctattagcagatgttagccaattgtaggttagatgacgatacaggggcgaagccaggataaatggtcgacggggtcaatactaatttagtgtatgatacattgttagatcttctaaaataatggggggggtttcaagaatcgctccataatactttgcttgcctatttatctctactacataaaaacagaatttatcatccaccctgaaagaaaaaaaaaagggggaaaaaccagacccaacagaaaactaaataacggggaaagtaatttcatccctcgaggggatatccctcgtttcgttcatctcatctaaatagctagattaatacgaaatatatcactccacaaatatgcaagttaaaatttaacttctacaaattgaaacaaaaataacaaatataaatgcgaatgtacgataactattttcagtttattttttttgttgtaacttgtagaagtcaaatttgattttgcatgtttgtagagtgatatatttcttatcaacctatgttgtcaatttttttataactatttagatgacatgcaaacaatgaggggatatcccctcgagggatgaaaatccatatcctaaataatgctacgagcaaccattggcccatatgagattgtcgcaacgcacggacatgtctataaattatactacctccgtttcagggtataagactttctagcattgcccatattcatatagatattaatgaatctacatattatatataaattcatttatatctatatgaatgtggtcaattctagaaagtcttataacctgaaacggaggaagtattaaaaaccggacataattaatatgtaaacaaagtagacattaaatgcacaaatactcactgctaagattaccaaaatgtatattgggcctttgggctgacgtataatcattagcgctagctaattcctatttgttgcttgctaatctcaaacgtgtcgtttcaagttgctaattaatcaggctataacaaatcatggttaccagggtctagtgtttttatcgaccggggtcatacacggtaaaattaagtggagtaagaaacgtacacaagaaatcgtcggggtcagtggaccccgatagatggctatagcttcgcccctgtgatgatattgccacagattatacaacatatatgataactcgacgaattacataaacaaaattagagtatcgtaaagatggaagtactaatcttgagaatgcaagctgccataacaagttttacctattgttgaaaatcgaaaccgatgcagctcaacccgaaagcaagaactcgtcgaaataaaacgaaagcaaaaaagggtggtgatgcgccgagattgtattgaacgtgtgtgttaattaattacatggggttcgggatctatttatacccgagaattacaaactatgtccatatcggacacgactcttatctctaacaaactttaagataccataagcctttgcggcagatttttacccaaacatatctctaaggaaattacataaaatatctaaattaatagatacaattgccttccctggactctatccatgcatggcaattatcttgaagcatatcaactagacccgatgtcgtccaccaagtcgtattgtcggaatcggctatatcacttaacccagtctaactcggactcagccgatcccagtcgtagccgatccggattccagccgattcttactctgtttccgcgataatccttatctttgattccgcttcgatctaatcttcctttctgatgctgatattaccaaatttggtcgttaacagaagtacaatgccaaagccgttgacggtttggcaggacttctagaaaggaaaaaaataaaaccaaacgataattatgttcgatttttaaaatcctaatgacaataaagataaaagacagtggacgagccgtagagaagtataatggcagcgtttgacgggacttctagaaattataaaaatgaaacataacgagacaataaactctaaaaactacaagatctaacttttaaaggtttcaagaagaatgaatagaaatagtagtaaatcaagcaagcaaataaagaagatatgataaacgtatggggtagcgcaattacacaggccacctagctattttttacaatactactaatagaggagataaagacagttgcatccatacccccggattgggttgtcgttttgtaacggtagcttgctgcctactacaagtagtcgtttcgtttggctaagacagggactaaaaaattttttttagtccatatcacatcggatgcttatatactaattataaatattaaacgtaggctattaataaaacccatctataattttggactaattcgcgagacgagtctattaagcataattaatctataattagtctgtgtaatgttacagtaaacattctctaattatgaattaattaggcttaaaaaatttgtctcgtgaattagctttcgtttatataattagttttgtaagtagtttatatttaatactctaaattattatctaaatatagagactaaagtaagtccgtggacccaaacaccacctaaggctcggtgtacagattaggcatgcgcatgccgtgacgtgactgggactccacggaattagaaagggcgccgtcggtcaaacccgcctgcctaccgttttgtttgacgagatgacagtactccctccataaaaaaataaaaaaaaataaaaaaaaaactctacacaagtgaaaattaaacgaggtgggcgccatgtggaaaaaacccatctccgaatctaaggcgttacactcgccccaggttacgtaccgctactctctctctctctctctctgttaagatcatctttatctctttgaaaaaagataaggaaaaataatcacctcgatcgatcactttgccgcccgttatatatggccttgtttagttctaattttttttttctaaaaacgtcacatcgaatatttgacacatgcatcaagcaataaatatagataaaaaaattaattacatagtttgcatgtaaatcgcgagatgaatctttcaaacctaattagtttatgattagccataagtgctacagtaacctatatgtactaatgatagattaattatgcttaataaatttgtctcgctgttttcatgcgagttatgaaattagtttttttcatttatatccgaaaaccccttccgatatccggtcaaacatcagatgtgacacccaaaaattttcttttcgtgaaatcgttaatttccgagacgtgggggaggacaaatccaaaactcccaacctgatcggcactggtagttcatagttggatgcagggatgcccacccagccaccgatccatggaaccgatcgacgcgtttgcttatttgaccacgtttttcaaaatcgaacaccccgtttaaccctcttttcattacaccgttaggatttcaattagaaaaaaaaaatatttactatttaaattgaccaaaataccctcgacacacttcaaccctatccaggccaatcctatctctctctaatctcttgcgagcggcgcacagagggagaggtcggcggcggcggcggaacaccgcacgccagtggctgcggcgacgccataacatggcggagtggtggcggctgctgcgtgggacttcggaggcggcgtcacacggcggagtggcttcggggggcggtggtggctgcggcgcgcggcaccgggggcggcggtgtgtagagggaggtcagcagtggcatcgtagtgaggagattcggtatcataatcttcggttcacaaaaataacatgttaccatgagatttttaaaagttacatatcaattgtattataggtacatgcaatatacaataaatatactatacttatatttgttaaaaacttttagaaaaaagatttatcgataaatatatatatatatagctattctcaaataacctatttcagtgttgtggatgacggaacacggatgtcggacggagagggttccgctaaacgattaatcggagtacgggcgaataattggtatttgacggaaatttaatgttttgtacaaatatatgtacataactcataatagcttattatttttgatagaagaaaaacttcaagcatgctcacctgttcgagattcaaacagaagattaaaatgacaacaacaaaatatggagattggatttgaaagaggattagatgaaaagaactaaccctagacttgcaggttgtagcttcaggaatgagttgcgagggtttttgattacaaacgacgtactgtagctatatattgctaggttacacaactaatgggccagtatcgtgggctggctgggcagggccttccggccttgtcacatgatttggccgtttattcggccgaatagtcggaaacggccgattaatcactaatgacggtgattatacatcctaaaacgattaatgtttagcgttttgctcattcgtgacggaggggtcggcgccaacgtattaatgcccgaatatacggccgtaccaaccgttatccacaacactgacctatttgggcatggtaagctggtgtttggatccaagaactaaactttagttcctatcacattaaatgtttggacgctaatttgaagtattaattatagactaattataaaactaattatataaatgagagctaattcacgagataaattttttaagcctaattaatccatagcacatgtttactgtagcgtcacatagtctagtcatagattcgtctcgtaaattagtccagagttttggaataggttttatcattagtttatgtttaatacttctaattaatatctcaacgtctgatgtgagagagactaaaattatccaaaccgaagtattggcaggcatacatgcacggagagttggagacgggctggcatggcccatttggggagacagtagcggagtacggaggagcgacggggcaagcggagccagcgcgcgaattcccgtgagacgcgtacctgcatgcaaggcgtggcgcgcccaggtaggctcgcgctgccgcggggtgacctgtgtactgtgatctatatcctctcgctgccgcgtgtggttgccgactgtacggacaccccagccagcggcgcgacgccccacggccttactatgcccttctcgcattggaccgtcgaggagtagccgtagttactcggtaccctagtacttgccctttccgtagcgtgatggttgcgttgggttaattggccccccagctactcgagttcggacacgtcgaagccccattggcccacaccgccaggtcactccacatcccaaccaacgcgattcgtccacgaccatgacatgcgatcaccccaccccctccctcaagtccacgcacgcgcgccgcgagccaaaaaaaaaataccccaaagcgaccgcggccaaggaatgaaaaaggtcgcgagaacttgtggctgggagggtccagggcgcgcacacgcgtcctccccctgccgatcacctttgccacctctcgctacgctatccccgtataaaatttgcgtcactccaccatcccctgcatcccgcatttcctccactgcataccaacaccaaccactgtactagcactactagtatagcaagaagggtgatgacgacgacgacggcggagggcggtggcggggtggcgccgttcgtggcgaagacgtaccggatggtggacgacccggccaccgacggcgtcatcgcctggggcagggacagcaacagcttcgtcgtcgccgaccccttcgccttctcccagaccctcctccccgcccacttcaagcactccaacttctccagcttcgtccgccagctcaacacctacgtacgctctcgctttccttccatcccattccctgcttcctgctcgctcgattatattcaaaattctgtcatcaatggattgtgcaggggtttcgcaaggttgatccggacaggtgggagttcgcgcacgtgtcgttcctgcgcggccagacgcacctgctgcgccggatcgtgcgacggagcagcggcggagggggagcgaagaggaaggaggaggccggcggttgcggcggcggaggggaggcggccgccggggacgtcgacgaggagagcgccgtggtggccttggaggtggcgcggctgaggcgggagcagcgggagatcgagggccgcgtcgccgcgatgtggcgccgcgtgcaggagacggagcgccgccccaagcagatgctcgccttcctcgtcaaggtcgtcggcgacccgcaggtgctgcgccgcctcgtcgacagggacaacaccaacgccgccgcctccaacgccgacgactccgccgtgcatcatcaggtcaagaggccgcgcctcctcctcgactcatcctccaccaccaccacccacggcgaccgccacctcgtcaccgccgccgcagacgggttctacgccggcggctgcggcccggaggccgcagctgccgccgcgttcgtgccggacgacgcggtcgacttcaccggcctctacaccggcggcgacgggttcggcaacgccgtcgtcgacgccggcgtcgactacccgccggcgtacgcgttcccggtggtggacagcggctactaaagctgtaaccgctttgagattcgtgctcttgttgccgatccaacgatttgtgtacgcagtagtattttccgtttcagtttgccctccccaaagtgtttggacgaagtggctgtgaacggcgaaggaaggaagctaggtagctctcctagtagccatgttgggttttttcccccttgttgggggtttttggtctcggtgtgtgcctgacttgtgggccagccgggtgtatatgcgcaagcaaaaaaaaataatagtactggtagtatctaagttcaacaaaatttgctccgtttgaacaaaagatttcaaaaactacagaaacaggaaaagcacagtattaggaatcgaatgttggaatcgaatgttgagtgtgccttgtttggatggttatgaaaggaaaaatattttttaaatgtttggtaccattcatttttagaacacgtttaaccgttcgtcatttaaaatattttgtgaagcatgtaaactatatttaataataaataaaagtatatttaataataaatgaaatgataggaatgtttaaaaagttaacggtaaacggagagaatacacaggaattttcccgcgatagctatctttgtatctttcactttagactatcacaaggcatcttagctcactttatctttagaccatcttagcatagcagttgtttgattttattgccatcattatgattcaccacgcattttttttagatgagattcaccacgcattgtagctcattttagctatatggtcccatatatgacgtacatcaatttacttatggctaccgttctgctagccgttctttccaacgtaagccacacattcttgttaagacataataggaagtttaagtgtggtttgctaaagctagtcactaaccgaactgaacaataatactctcctaattcaaatcgtacttcacttatttgcgttggccgtaaaataatctttaccaggtgggcaaataagtgaaatacccctccacccccattaaaaattcaatcctaactacaaacctagggtatatttaggttcataattagaattgatttttagttatgtaggattgatttttagttcataactaggattatatttaggttcataattagaattgattttttagttcatataaactaggattggttttttaacagagtagtacgattaaccatgattgttagtacaattaacccaacacattcctcaaattaaagtactatcacgttgcgacaagaagcatcaaatcaaacaccccgtaatccttttcaatggcgagtgctgacgtgctcagccggcccagcgtcaccctccggattggagcggcaggtttcgttttctccgctttcgctgtcaacctcaagagggattagctggaacaaaatctcctcatcattcgattaatttaaatcaggagcgtctccggcgagcgcaagcccagccaatcgccgcaccgtacgtgggcggtgacgaggcttcagctcggtggagcagctggcccgctgccataaatagtcacccgaacaatgctaaacaaaaaaaaaatgcagacgcagccatcacggatagtatttatcctgtacctctcgccttcacgatcggtggccgtcagctgatcatcgatgggcgatggcgtgacatatcccttgggttgttgacagaaaggtataaaaattcgtccaggtaggccgaaaggcgctagtctcgagctgatgagtttgctagggtgcatacaaatagcatgccacgtaccacttctacaattcaggaccacgatgtgctgtactatagctcaatgaagaactggttaagtgcattttaggtaactacaaatataataaacaacagaaggcacgattacaacagatccctttgtagtttccagctatagaacccgcatccgacaagtcagtactggtccctagaacataatcctagaaaaaccgtccccatcattcaggggttagtccaccccgagcagtagtaaattattactactaatagtagatggttagtgtgatgacagtcacaaagtccaagaatttagctgcagatacactacgtgttattgcaatcaggaaggagtgactttgcgccccaagtatatatcagaacctccctaacaatcttctcccaagggacttctgtaacagtttctatacaccaagatgatggggcagaaattgaagtgagggaaagagacagattgatcttactgcatttacagttagcaagtccatgacaagaccgtgacagattccaaagcaggatgccacatcagctcttccaattctacaacctggcatttcacatttccatgaattagtataggaaagggcaagcgtagaaatgtcatgttactgttgaaataattcttttgagcaagttggacatcaattttcattcccaaactgcttcatttagatgtgaaatacatgcatgagcaataaggaggacattacgtgaacatatgtggacggtttcgggaaagctgaggacgtttcacaggcgagattatcatatttcgcagagctgcagaagtattattcatggcagtgccgaatacgggccgtgctggctgtctgggcctaatatcaaccggaggcgccgcattgtgagcaggagatcccgcagacagctcaaatggtccagaggtggaccgacgttgccttggtggtggagcccatccctcatctctccgccctggagtttcaggaagaccagccaatcctgcagccagtgaataagctgtttttgtggagggctaaaagcattttaacttttatatatttaatagtggctactagcaatccaagcattacagttaacagtttttctggttggaagcataacaaaagggtgtgcacagaggaaaggatgagttatatggtatgagagaactaataagctgaatgataacatgttaaattaccttgtctcagagggtcgctgctatccattatgttgggcacgcctgagaacaggtctggctgggctcttgggaagtagttgttcgcaggttgaattgctgaacgctttgccgactcatactcgcttctcagctgatcatacatctcatcaagcttccttttctgcctggaaatgacagcagtcaattctccatataagttggatgaagcagaggtttattcatatgagaattaaactagaaatgtactgtacatactgacctggatttctcagcaaatttttcttgtagctcttgcttatccctcgacaagttttcaacctcttgttccatcaactggcattttttggccattttctggtatgcagtatgaacttcttccagcttctcagtgaactttgcctgcataagttcacacttttgcctacactgaccaacaattctgttcatcttgtactgcatctccagttccttttgcccaatgtaaaacatgacacttctgtatgcactcttcataactgattagcatcatagttagggaaaatctgaatagtcaccaagccttagacaataatcatataaacaattttgatctttcagatttttgcattactatgacaataaaacaggacaagaggctagctacgccatagattccatatagcagttagtgatgattttcaacaaaagtagcacaagaatcttacggacaatgagaaaataataaggatacgtatctgtggagaaactccagccattgacatctgtaccaatgagcagactggctgttagaaaaagaaggattgcttttatctacaatgaatcgtaagcgaacttacatttgtccaatcatcatttggatttgtatcaacaggtctcatatggctgagaaaaaaaattataatgtttagactgtctcaaaatagtaaaccactggagtccattttcactcgaacacatcaaagaagtataaaagcttcaaagcatgctagaaagtaaactccatgtgttaagcacccattcggatgaaatgacatggcaataaccatcgagatgataaatatgtatgcgtttgaggtacttttggcatccctaattgtcaaatcatgatgtacattcaaaaatagcttacaggaaagaagagaaaatgtagtatgagataatgaatacaacttcaagagtaaacaacagacctttttgaaagcacttgatcacaaatcgggcatgcagcatcattgctcagtattttcttagcatcctctgtacctgctcaacggataatcatcagcaaggatcagttatgtatactgcaatagcagcagacaatgttagtttacaatgagaaactggttaagcaaaactagtaaggaagattgcaggcatacataaaagatgaccgcaggttgttgatacagcttgcccttccaactcccgccagcaagcattgcacttcattttgcttctcactagtaaattaagtacagagctggtaatacgcagaaacctgcaggtagaaacatagaattatgagttgcaagatataaactgaatacagacagcagttgtattctgcatgtctgaacagaaaaacaaaccgagcagagacagatcatagctacctaagtatcacggatcaaatgaacaaataatcatatttcgtatgtgccatttggaatagctaaatgggataacccttcaggcacttgcactactcgcatgataaaagaaatggtgcgacacttaatactgataagcagctagcttttgtcatctttttagccaatgaattctcccactatttacagagactacagtcctgacaaagggtagctcaaaatgcactaaggactatgcattcagaaccagttctgcatcgcacaacatgtcactttcttatgagctattgcaggagagatgggattctacagacttagtagtaaaaaaagcataatactacctatgaatcaaggcttacggagcaattaatgaaataaatccaattatcttcaagtaaatgatcatttcaataatattttgcgcatgccctgaacatagaatgcagcataaatagaatggcagataaagctgtagcatctagaaccaccgaagcaggcaggactacataatagacacaatatacgagcatcatgcacgaagaaattgcaccatttccttcagagcccaacatctgcagttgaaatccaccaacgaagcactttaaatatcagcagcggagcaagctttctattgggagtacgaacagagcaaccaatcgctggtggaattgcagaaatggcgatgacaatcgtactaaatattgctcccatgagcgaccaaaccgaagccttagttcgcaaaacccgtaatattgcaaaaccgtaaccattccataaatccccagcgaactggaaacgagttcccacaggaaatttcacagccagtggcatctccaaacgcaccaataatcgcagtatttctaggtagaaacactacaatctccgcaaaacacctgaaatttgggtcaaaatagcccctaaaacaaacctagatcggatccatcaccaaaacacgccacggagaaacgaacccccacgatatctgccggtgcgattaccaaacgggggcgcgtcggttacctcacgcgaaccctcggcggcggaggagaggcggaggagcgggggcgcagcgcaacgccacctgggcctcgaaaccctagatccggaggtggggggtggggggctccctccgcgtcgccgatacgtcacggcggagatgggcgagcgggggatcaccgaatcggggcgccgccgcggcggtggcggcagcagcggcagggagggggagagagagagagagagagagagagcgcgggtttgaaacgggagaatggcaaaattgctttgcgaggcggagggggccgcgtcgcggtgtccttggtgtcagtcactgacaagatgggcccactgggctcggaggcgctggttctggggccacggaattgggctattgggcccactagtttgcttagtgggctaatgagatgaatcgtggaattttttttatttatatatttttttattaaaatattttaaaaaataatcttttgtttcgaaaatttacaaatgcctctcgcccgctgggaaaaatcaccctcacagagggtattaagggacctaaatgtaaattttccagtataacttgtcaactctatgattttacaatttaaaattatattatataaagtcaaatgaaataaaactttatataaaaattttagagctcgaggagatatacaagtttgtagttaacaactttttcatttaagatcttttagatatccaaatattcgttacaaaatgcaaaacctattttttaaaaaatctcatatctacatttcaaacgacattggatggagataaactttatataaaagttgtagatctggatgatatctacaactttgtagcttatcacttttccatttaaaatcatttggagcgtcgaataagaattattagtttttaagcaattaaaaccggtggaaagagtttgaacacaaataaaaaatttgtatttaggtcccctaaagccctctggaaggacgatttttaaaaaatgcccttccagagggcgagaggcgactagaattgtaaattttgaaaaaaatgtttttgtaaatattttaataaaaatgtaaaaataaaaaaaatcatgaatcgtggggggatgcctcgttatgtttactacacttttctgtttgggtcaaaggcgtttacgacacggaactgtctatccatttgtcgggtgatttctaaaaaaaaaaatcacccaggttttttctacccttagatttacatccaaataactaaaaaagaacacaacaatacatatttacttacacaatatttttatcaaaattacaacgcacttacatttcatatcaactgaatttgcaaatgtaattttagttatatagcactgtaattttatattttaaagaaaataacaaatacatatttacttgcacaacatttttaccaattacaatacatttacatgtcatatcaactgaatttacgaatgtaattttagttatatagaactgtaatttcctgcactaatcttgacacacgatcctacgcccaggaaaacatcaaatatcagagatgtttagcaaagtcgttgcgcacatgtcacaagttaaatacgtcatgtgatccatagttcaaactaaaaaaaaaagaggatgctatgaacttcaatcacctttaacctaacactgaactccctttaatacaacactgaattccatgagtggggacggatgaagggagtagggggtaattaactcaccaactaacggtgaaagaggatgtgactcctcgacggtgctcaaagcatcgaaactcttgcagagaacttagagtttaggttccagggtgggagtcgatgtgagaaagggtggggagaggaaggacggagagctttcacggatttagagggatagccgagggcgacgaaaatggcggtgggcggcaaacataggtgggtggcgaggcgggagtggttccttcatagttgtagaattgaagggcaatgggtggagaggtcggcaggagcgtggaagtttgggtggttaagaggcgggggggtgttaggggtgtcttcaatgacgcgagccgctagagacaaggaagatggcaggggtcctcactgctgcccggcttgggaaggtggggaaggggaggaggaggaagccagttagagcagtctcgttggcgcgaacaattataaaaggcgacgcattagtggtcgaggaggtagtggcgctcattggggaggcgagcgttcgatctagcgttacctcgaaatggccttatcataggtggtcctcctgaaggcctcgcctataattctatagggaagtcgtctatgaaaaggtatttcttaaggacaaggtgagaggggagaagagattaggacaaggtttctgtagcatacgagttgtagcataatctataccatctaaaggtgattgaaatttgtgggtattttcaggtaattgaaaaatcaaacaattctataacaaacatggtgtattgactaggttatagttactactgagcttactcggctgcactagctagctgcagcagcaaaaatcggaaggtaagctaatagccaactactagccgcaggccagcagtagacggctagctacgccatatccatagccatagcattgactactcatgagctcaatacttacctattcaatgggtctagagtagaattagagatggatagaaggtggagatgggtagaataggtaggtgggaaaaattgatgcatgacatgttgtcggtaacatattatcttttatgcagatttacgattataattgggtatatagaccttatttagataagtttaaaattttgagaaacagctggtaagaagtcagctggtgagaatatgaaaaaaataggtaggttacaaccaaatttcgttattaaatattataaatgatcagtactatggagtatatatattaataggcaaataacctgcggtacagcccaagaagattagagcatctccaacaacatctccaaattagactctccaaatactgatatagccaactctttaactggtttggatagttaaactaggtgttcacttcaacagtctctatatttacatctccaaaatgataaaggacccacatgtcagcctccattgccttcttcctcctcctctttctcttctcccgcatcggcccatcgatccatcctcgagtacacacgcgcgtgaggcgggaggcgacggctccccgcgtgtgcgaggctggaggtgacgacgggcaagggaagctggcgacggtgacctcgatcggccaccggaagagagtgggggggggagaaagaggagggagagagcatctcacgtgggacccacgattggtaagctaatttggactggccaagtttggctactgagagagccagtttggccagccagatggcttggccatccgtttagcaatactattgaagctcgtttttagtccatagctatcaaattttaacttggagagtgggatgaccactctgttggaaatgttcttagtcactatatttcgtgtactagcatatatttcacctagcagtggttttctaagtatcaagaaaaaagccaccgtccagagccgaaatggagaacaggagaatgtttgaagtcaacctgcgttcttctattggtcatgtttccgcaggtgctaaattacctggcagactgctactcgcgatgatgatgtagattttttttagttattgatggcaacgctccctctctcattttttgaataatccgatgagcaaaacgaatggaccgatgagtagtacgacacaaagcctacaggattattgaaagcggtaggcaaagtaagggttcaatttcacttcagtcaacattacaccagatcgaatatatattcaaaggtgaatgccaatttttttttcacctttcccgttacgttttaccatctccgtcctcgtattgtggttacttctaaaatttaaatcttgtttattaatttttcactctcatctcaaatgatgataatcatcttttatttaatttttcacgtaatcttcttatcttaactttaatttaaaaaacagaaagagaaagagaaagaaagaaaaagagagagaaagtaactaacaatacctaactatatgtctttttttattactccacactcacacactcacaaattgtacacactcataatccgatgagcaaagtagtacacggtaaaagtgcacacatgcaaaaacacactcacacatctatgaatatgtatttcctaatacacgtataataacactggtggagaaataatctttggtcggttgacccaaatccacaatagtcccggttccattaaaaaccgggactagaaacgatttttagtcccggtttataagaacaacaggactagatgatctttattcctggttggtgttaccaactgggactaaaaatgatctttacaccaaccaagactaaagatgatttttagtcccgattggttccgtgtcaggcgcctaggatcttataaatcgggactaaagatctaagtttaatctcggttggtgttactaaccgggaataaaaatcaacacgtactataaaatccctattacttatcctcttctctcgtccacacagcaaactctatctctttctttctttcttcctctctaactcctgccttatctctttcttccttcctctttttttgattgagcgagatcgagcgcgagagcgggccggccaggcggcggccggctcggcggcggcttgcgcggtggcggtgggcggcggcgcggcggtggccggccggtgcagagaggaggcggcagcggctggccgggcggcgcctctatggttttttttttgaatttgtgatttattgcatgatcctgtgatgtatttgatttgtgtgcaatgtgaacttgtgatgtatttgcgatgaattttgtagaacttgtgatgtaatttgatttgtgtgtaatttttttaggatttgcgatgtatttgatttatgtgtataagtaactttaagatttgtgatgtggatttgggatgttactttgatttgagatttagggatatgcatgccacttgattcgggagaaaataaaaaaaaagaaaggggaccatccgaactgctgttattctctctttagttcgactagagatcgatcttgtttcgaattcgtagtctcggttagataatcgggactaaaaccaacaacacttttttattttactaaatttttccataaaaaacatgcatgcatctgcgcaatatttatgtgtaaatcctgatgggttcaatttatcgtacacaccaccacaccatctatgcttccccgcagctaattaattgcatcttgatcattgattatatggacggaggccatctcgatctgtcgtgatcaccacagttttggctggacggtgtacaattgcatgggagcacagtagcacagccgttttcttggtcttcgagacatatgactcgatcgcgtcggtgttgcttaacggcgggggtgcaactacgacgacttcaatgaacacgtgtacgtgtatatgtgtcgtacgtgctaaacaattaataagcacatgccttcaattcgttcgttcggcaatttctcacgttttgctctggtgacatgcatgtggaaatatatatgtgcatcgatgtcgttctcaatgcaagtcacatcgatctatcttcaggttttactaggtgcatatgcgtggatcgaaggtttggcgtgcggctggtagaaatcgaactggaaatctgcaaacatgatcacacctaccatgtacgatctgagcaacatgcgtactccctccatccaaaaaaaaacgaatttatgacaataaatctagacagatgtatatttagattcgttgtactaagatgtatcacattcagtattaggttggtttttatgggaaggatggagtatatctttcttgactaatatgagatctttttaaataatttaattcattctaaccaattattatggaggttacatgacaaataactaaagactagaaaactacttcctccgtccaaaaaaaaatccaatcctgagtttgaatctggacataccaattctgggtttgaatctggacatagagaatctagacacatagattcaaaccacacatagattcaaacccagaattagttttttttggacggagggagtaattaaaaataccaccttaaatacatagatcgattttcttgtatggttagccagagtatatatgtataacaattatttgtcacaatggctcaaaatcttcgaaatcaatagctaattctttgtcgatttaattattttgttgctactatcaccaccggcgactgatgttaaccaaagcaaattataacatcaggagagtaacttttactatgaaagaaagtaggagagtctcatgtagcatatataatatatataaatattaattacaagtcacatatgtacattatatataatataatatataaatcagttatttgtctagattttttttcaccatcattgttattgaacccgatctggcgggtacaccaccacaaggacatcgtgtcattagggaacttccaatgcaacggttataagaaggtcatgacatctagaatatcgtcatcactattctgaatatctagaacaatgattttattcagagagtttaccctaaggtacaaatgagggaggggcatcacgacatcacctatggaaagataggtggcatctccaatgtcatgactctaacgacaaccggcttttccacagtggcgactagaaatggcattgtagccacccgcacccaccattgccaccaaatctggccggggaaccttagtcactaatagagaagcccaccgtcaccacgtccaccactaccgcacgtcatcctcttgttgtcgccgcacaaggcatggctagatccattggtgggtccaagagcagcccgttcacttgacatctccacactaggctaccaccatcctcttgccttgccttcctgcatgccactgtcccccctgcctcgccagtgccacctgtcacagcctcctgccacgccatgtcctaggaacttctagctagagggtgtcgccgcaatccctaccaccactcacctttctcgaggactaccggaatccgacgctcccctctagcgatggtgaggaggagatccacaactatgtcgcctagtgttccacgatccgcaaatactaagtcatttactaatgtgagataaattaaatagtctatttgacgataataatttctaactatttgacttggaagctaaagaactaaacctgatgaggacatcctccactattacccgttggcaaaagacgcaaaagtcgggcggcgaccgtgtgagcctttgaataatcccaccttgcttagcttgggaggaggaagccaccttaaaagggagagccaccattcccctaatggactagtcttttagggagattgggcctttccccgagtgggtgggcctaagaactgttggggttcggacaaccttaatttgttgggcctcggccaaccccacctgggccggattgttatcaaaaccacttaacaaatcagtgaacttctactgttgttggcacttcttctcattgtcgaagcctcgaagggatgggtggcagtgacggtgaaagataaaggggaacacgataaggtacttgggggtgaggcagaggccatagcacttgaccctactcttgctcggagcaccgttgtccctgcctctgctccaaggaagagggatggagctgctgcagtcgaacgggctgcaccgccctgcatcgccaccattgctgaggagccaccctgctgttgccctaactctagatttggctgcccatgaagccatcccagcttcggatctagccgtccccgctgtcagcacatgacgccgccgttgagaaggaggaggtcgtttggggagagggagaggagatcaccgtcgaggtggaggaggctgggagaagcgagagagaaggggcaagggaatctagggatgagcgatggagagagaaatgtggcaaacgatgaggttgagaaggatccagaggcgaaattaaataaacgatcgagcgattcagatgaaataaaaaactattttgtcggtggcctccacgcttcactcgaatgtctcaccacgatccatctgtgctggttttaaaaagaacgaaaccaatatatgacatataagtgtcggttataagaaccgatgaaacacatataagtgccaatttttattaatgaatcgatacaatatcattagtgccggccggttttattacaaagaataaaatcggcactaataacatctcattaatgccggttttttatccttcagcgctcccacgggcatgcgcgtgagcgggaaaagccatatgggtgccagttcttgtgtttccggcacctatacgcccgttccctatttgcttttctgtagtagtaatagcttctgatcttgattgcaatatgatcaaaaccgcctaaaagaaccaatttatattaatttgggataattaaatacttatctcgtgggaggacttaaactcgtgggaggactgaaaggttttttggaacaaacctacagagggattcgccctcttgtagtgaaggtagtagatggctcttaattacatcgcaaatgtactataataaaatttagtttcatccgtcatgatctctccagaaaagtatttcaccgcttctaattaactttatctcgagtagcttttgcaatgaaaaagacactacacactatccgcctctttcctgcctaaactctaaaaagacatggaattcctgatctagataacgtaaacatcgctagctagaatgtcaaaaatccggctgcgccaacgattcattccaaggtacacaccgtcgatcggtattcatcacggacaactatcggccggcccacatatgatcacgaaacaggatcaatcaaagaagtaaataaaatgtacgaaagcgatcggacggtcggactttatcgatatcgatcggatgggcacccggtccggtcgatcgacgtgacatccatagccatcacaaacgctagcttggatagatttgcaagggaccagtagtattacaagctgggaagggctagctgcacgtgaggaaatttgtgaaaagagagcaaagctagctagctagagctagccagccaatatatttgatagaattttctacgcctctgtttgctgtactttattgaatctgtttctgttatgtcaatttcagttaatcatccagtgaagacagaatcaagtttgacaaattttgtggctattattttcttacatgaggtttctacatataattgatacacgtactgcatgctaagaatctatgccttttctttttcgaatgaatggaagaatggattaatgcatgcaacacgcttctaagcctctaaactgtccgatttttgtaaaaactagagaggtatatcaatttattaaataaatattttcaattcaattttcaactatacaataattaattaattaagttgtaccatcgaatagtgatcacaaaatcatccggttatatgtatataaagggacatttaattatttgccacttttaagatgtgtcaattaaggatttgccattcgctatctatgacatgtaggccctcatgtatctatgacatgtgggccctcgtgtatctattacatgtgggtctagtggcaaatcctctagaaccactcgtaagagtggcaaatagttaattatttcaaatcctattttactataaagttgatgcccactaactactaaaacttaacatgcaagtgtgtcacatcatcactcactagtaattattatctagagtattttaaatatcatgctaacatgacatatcatttacaattttgttgtatttttagaactcaatatgcaagcaatgtcaaatcattatctccatatcattttcacattatttaaacatatacatctaccatttatataatgtgtcgggcccctttgaatcaaaagatttatctaggaatttcataggattcaaatcctataggaagttttccaaatcctatgaaattcctatggaatggcacattgtatgtggattttggaggaaatatagcaagagctctaaccttttggaaaattccctttgagtctatctctctcatccgattcctgcgtttttcctgcgctccaatcaaacgaccattcctgtgtttttcctgtgttttgcaattctctgttttacacttcaattcctatcagaatcctgtatttttcctattcctccattttttcaaccctgcgattcaaaggggcccgtaacatgcattattccacatatcccgtagcaaagtgtaggatatcaactagtatacaatatatatagttgaaacccacattaattattaattattaattataaatagctgccacagaaaaccacccgtatcactcgtgacctttcactaatttggattgatggcccattgattttattttatttttgcttttgattaggcatatctctataagactatgtgtattgtaatttggaaaatgctatgttcacatctcaataccctattaccgcaacacacgggacgctatctagttaacatcgatgatttgtcccatcatatcatattgtatcagaaattttacaaataacaagagaaaaaattataattaataggtatatgatcctctccctttcaaaagtacatcaggtttgcacatgatctcagcatgctggtgatgcacaatttatatgcattctcttttcctatatagttggtatccactacaagcattaacactataaagaagcatccaggttaagccatatcatcgataatcaatagccgtcggatcaaatgcatctttgtttgtttaactgtgcatgctttaagtaaggaaactgccatgggtaattaggcacatcaatggatgacccacttaagtgctcctggtcatacattgcatccatccaccatattaagccactgctatatccgttaaccatctactactcaaatgccaactttacactttattattttagaatgtttatttttgatatttcaattcttcaattatgtttgtaagcacatatttacaaagttgtttatcatcaccataaaatctcgcagcaacgcgcggggtatcaaactagtactattaattagaggctcctttgaaaatccccacatcaataaaagaacaatttagttaggataatttatatttttgtgaaattagaataatttaataaattaagttaaaatgttagaaatttgtacattaattgaaaaataaagttgtgcaacatctctaaaaacaattggttggttgccatacattcgaatatggaacaaaataaagaaaatgatcgcaaaaaaaatcataaaaaatatacaagtacctattggcgccttctaatgaattcctcctcctgctagaactacgctctatacatcaatgtcattaagagcaggtaaaataatgagttgcaaaactatgccacatcatcatattcctgtgtagaggggagagaagagaagagggatagaagaaaacgactgactaatttgtagcccggcgatagagattttttagttggtatcgctcgcttgcagctgctcccggcgattaaaaacacacattgtggggcctgtgcaaccacagtggatcatactacccctccacattgccctccccatctgcatcgccctcccctcccgatccccttcctctcgatcgcctccgccccattgattctcaacgcgcgagaccaccgtgacgatttctcttccgacagtgcaatgtccccctccggctcctgtgcttctcctcccctctctctgacgcagctcctgcgcttctccacctctccctcccgcactcgcgaaactacctatatatatgacaaaaaaaatccagtcgctccaaaattccccatcgcaatatttcgccgcttccgatctccttcttccgctggccacctcgaccacagccctgctcctcttccaccttgaataatctctcccgcccccgtgagaaattcctgcctaaaaccatagttccccaccaccaacaccatgtctcaccggacgaagagggaggtagcactagctccttaggccatcgtgagctctactggtccttagaaaagtgtgtgaactatgtggtgttttgtgattacttctgtagcatacaaatgttaatgtcaaaacaaaattggctacaataatgatccacttcactcttgatcatacacattgacatgtgctagttataattaattattttatttatgagatgtagctagccaacaagcaacctattgtatgagtagttggcttcagcattagctatagaatgaagtgtagccggcaataggctataatattagccttgctctaattagcaccaaatggatcaagcagagtccccaattaaccatctagctagatccccactccaatggtggcatctcctcccttgcagatgatctcctcgtcctctcgagctaataactcaaatgcggacacccaacgagatgtacctcgatcggggtgtgtgtgtgtgtgtgtgtgagagagagagagagagagagagaagggtttgcattgttgacaaggaccagcatgaggcaaattgcagaataattatagcttgtaggataagcaatatgacttagggcccattagcactttcaaacggtccctaagtcattgccatcatagtaatggatgaaactaaatttatgataattattcgaggacacaagcgaacgaattaaatattagaaatatgataagttgatttaaaagagttcactaataagacatactaatgaagaaagttttgcattaatcataccgtttagaaacttgaaaagcatgcatgaacgcgataatctgacaatgataataaaaaaagaacatgcccttagctagagtacgtttgccaaacccaggggaagagaggaaggaaaaagggggagaagggcaaggggtatgtatggatcagcctaagaacgaggtgcagataagggtagaacacaaagtggagtggtgcttcagggtatccaatcgcatggatcatgttggacgcccaaataaaatcattgtcaaattaaaatgtagatcatattgatattagtatagtgtgactcctaaaaattcagtgaactcaacagcaatattgtatggcttcaaccttggttaataaaaatgggtgcacatctgtaggtcggcctatccattccgggccaagctaaaaaaaaaaaaggtgaaaaccaataagccaatagtgaaggagagaatatttgacccgaaaaaggccaagaatacgtaccagcagtgatctccagggcgctctcaagtctcaaagattctaagctttcccttctttttttttgaaaaaaaaaagttgatccataagcctattgaaatcacacacatggcaaaaaggatgtgctgtcacatacaaattaacagacacacgcacagcacacacgctagagatgcgtatgtagctttatccatatttcattccaattgttagaaaaggaaaaagaaattcctttcaagttaaaaaggaaaagagaaatgcttacgacctgtgtacgcatgcctcaattctttttcaatgatagaatcgagatgaatccagtctctatatatgaagatatacttaaaaaaaatacacgtgcgttgcaatgggtgaaggctatatatcttagggcttaggctctgttcgcaagagctggttcacaactccctgctctcgttttccgtccgcgcgcttttcaaatagctaaacggtgcgttttttgaaaaaaaaaatctctacggaagttgcttaaaaatcatattgatccatttttgaaaaaaaaaagaaaatacttaattaatcacgtgctaatggaccgttctgtttccgtgcgtactgtttgggtcaggaaccggttggagcgaacacagccttaatcttattattgttatacgatttagctaaactgaaattcactataggaatttacttgaatattgtttttacaagatcatgagctacaataattaggagtccgattgtctcaagttagcatgcgagttctttaaagagaattcttatacgactctttctatattttcaaaagcaaacgaatttaaaaacctacccaaatacaaatatgtaatttcaaaagcgaatgaacttaaaaaccggctcaaacatgaataacgtatcaaaataccggcaaaaacatctttaatttttataatagtagagatatattttgacatacatattttgttttcttaaaaacaaacacaattgaatcgagtctctacatcaaatatgtagttgaacatacatctgccgtcctaggaaatcaaattaaagacacgctagaaataaatttgtcagacctgtcaaaatctaggagaatttgtcaccgaagcgccggccggagaacgatgcatgcgaatgtgtgatgtgcaaggtcggcagtttgtaccctataaatagcacgcaacccttgtagcttttgtcccaacacaacacaaaccaattctatctacacagctagccatcgccgacgacaacacacacccaaaaaacatatacagcatatataccagctgcaagctcctgtagctcgcagtatttgttctcactgctgtctagctcaatccccagcacaatatagctagctagcaattcgatccaattaagcaaatcgtcagaaatggccaacgattcattggctacagggcgtgtgatcggagatgtcctggatcccttcatcagcaccgtcgatctcaccgtcatgtatggtgatgatggcatgccggtcataagcggcgtggagcttcgcgcaccggcggtcgcggagaaaccggtggtcgaagtcgggggagacgatcttcgcgtcgcatatactctggtactattttcgtgccatctttatacaattttagtgttaatacattggcgtataaagcttttgcgcgttaattaattatgttacctaccgaattggcaccacctgatcatatatatgcatataatatatatgttcatcagttcatgcgtggatttatgctaactgtgtgaatacccatctatgttgtaggtgatggttgatcctgatgcacctaaccctagcaatccaactctgagggaatacctccactggtgagcactatatagtagctatagctagctacatcgatctcagttaattatcaatcaatttaattagtgtcaatttttttacattccataaaataaattaaaccgatcattttgcacgcacgtgcatacgcatgcgcggtataagtggctaacccgctaaacccacttataggctaaaataagccacttattttaacctataagtgggttcgcggctgacccacttacagcccccctgtgtgcgcaacaaacggtgcaaatgcagcttgcaacttgcatgcagaaaaaactgtgggtaattgtgtatagtatagatagctagggaccaaatatacacttgtaacaatgcatgctgcacgcgtgtacgtcgatcagctaccgtacaaatgtgcgccatgtcatggatgtacacgcatgcgttgtgtccacgtggtcgatcggtgtgtgcgttagttcatctcgaaccacacaatacatacataaatcgatcgatcgatcgatcgatccgtgatgcagtacagctagatcatatgtatcgggatcgatcaatatgtacatatatggaactctatatatggatctatgtgctaactagctacttatcgatatatgtccatgcgtgtatttgcaggatggtgactgacatcccggcttcaaccgatgctacatatggtacgtacaatatgcaatctctacttaacactagatttatagatcgatgagacatgagatcgagattcgaatagtataatatatactttctctgttggtcaggttaaaataaactgaccaacgttatatataaaatatttaatgaattggcgatatatatgatctgagaggcgcggttgctttgcgatacggatgcagggagggaggtggtgtgctacgagagcccgaacccgacgacggggatccacaggatggtgctggtgctgttccggcagctggggagggagacggtgtacgcgccggcggtgcgccacaacttcaccacccgcgccttcgcccgccgctacaacctcggcgcgcccgtcgccgccgtctacttcaactgccagcgccaggccggctccggcggccggaggttcaccggaccttacacctcccgccgccgccaagcctaattaatcaagctctatagcttaattagctatattacatgcatttataatttgcatgcagtatctatattatatagatcaatgtggtcaacgatcgaataaaaacgtagcatatgatgatatatatatgtacttatatatctatatgtatatgctgcatgctttaagtttaatttgtagctagagctagctgcaatattatccctgttgtgcttggtgtagtttatatatagtgagaggatgtggtgtgcgatatatgtactgttatacatacacttataggttaattatgtgatgtagtaaacgaaatggatcatatatatatatatatatatatatatatatatatatatatatatatatatatatatatatatatatatatgtatatatatatagacacatacaaacaggtatttttatgtaagatcgatgtgtgtccgtataataataaattaaaacatatatcattcatgcgtgtggtgcgatgctccacgtggtacatgcatggaacatcgtatatactccctccgtctcattttaaatgaaattgtgtgtttatatgtccaacatttgatcgtccatcttatttaaaaagtttatgaaaaaaaaattaagtcgcgtctataaattactattcatgttttatcatctaataataataaaatattaatcataaaagaatttcaaataaaatgaacaatgaaacgttagacacagaaatctacaaccgcacttaaatgggatgaacggagcatcatttttatctttatatagtcattagaaaaaatatccgtgcgttgcaatgggtgaaggctattttattgttcaacgtgaaattcactgtgagaattcatttggatatatatttttttctaaaatatcatgtcaagttaatatgcgagtttttttaaagatatttcttatacgactcattttgtacttctaaaagcgaacggaattataagaatccgactcaaatatgtatggatttttatttctaaaaatgaacaaatttgaaaaccgactcatacacggattgtatgacgtatcaaagtaccggtaaaaacatcttcaatttttataatagtagagatatattctctatttgatatggatatagcacaatttagaaggatcgaatatatgattcaagatatctgattcaattattaagagactaagacgcatttaatttaactttttactcccaatctgtcccagttaaatatgttaatgagaagtggttttttatactcccttagcctcgaaatgtagttatttctggatgtggatatggataagtgcatgttctgtagatagaaatagctactattacattttaagacagagaaaataggggttattttctcttattactatgtctattttttttacatacagagtgagttatatatggataaatataacataaaaaacatagtttagcatataacattataacgttgtaatcactatgttattatttttgttctagaatttttaatgactacttcaccctccctctcttgggcctcattttttcacttatgattatgcttattattagccaaaattgaattttcaactttaaatttggagctgattttgagattttttttcatcaaaatttatttttcagcttttgcttttagatcactaggaacatgtatataaaaattttattcacaaattatttttcttttacaaatatgtcgttttgcttatcccgcgaataagtgaaacaatggctccgaaaacatagctatatatttatggctatgactagatatataagatagctatatattttagaatggattgtatttagatgatatacaaaggataagtgcacgtgttgtaaatcgactttctcagaagagtaagtttatgttgcatgtaaggctaaaatagataagattctgcagtagatagatcaattctgtaaaagatacatatataaaaaggtgcatatccgacatatacctcacgaaaggaaaaggaagggacatatgagggtatatacttcaatgatgagataccaacgtcaaaaaaagtatctcacccactcatctcgacatgatattctgccgctcaaattcttatctccaaaatgagcgaggcttcaatccatttatgctttgagctgacttggtagctagagtaatgcagcaacatatattcatatattcatgcatgtataatgtcctgtgattatatgtggcaccgctcccctccttatagacatcgttatgatgggttttctccttctccaccacatcaatatctatgggtgaaaacctctctccgactttcggatgagcggcagcggtgaatcatatcgcatcctctatgggagagccgcttgagagaaccttcttcgtgcagttgatgccgtgggtgggaccccacattggctcgtggccgattgattgcagtcattggttgttcttcgcattttgcgaccacacttggacgagtggttgatttgcaatgcagttacactctgatgataccttctaattcggttcaatgttgccggcggtgatgtgcaatgtgcgcaagttctcattggtagaaccatcaggcgctaatttcatggagtctgtttttaggtttgaactaggactacatgtagcttgcaggattttcactaattgtggatagtgttgtctctatctttaggatggtgatctaattaatcttctttatgtccatcaaattatattatgtaatgcacagtcattcgagtgcctccccactcccttctccctcgcagccgcacgcgcacactgttataaaaccagcccgatatatacctcgaaaaccgaacgtggaagaaacgccatagaagatctaaacatgaaggcgacactgaggcatgatatttgttaacgaggttcagtcaaaacctacatccccagagcactgattacgagcggtcttccccgatccagcatattacagtgtatccgggtattcacgaccctccatcggctaggccgtcggtcagtcgtatccatacctatgctattgtcgtcttgcggttacaaccaagataaaatctgactcttactctagtccaaacacctattacaactccaagtcctaaattgcaaccgactacgtacacatattcgacacaaaactctaacaaactacaccttggcgaatatgccacgtcaacctgaaattatcccttgcgcgaacatccgtgtaccttgacttgggagggatggggcggtggttaggggatgagcggaggaaatcgtcatcggtggcagtgtggatcggtgcgatgggtagaggcgtatgagcaatgggacgacgactttggtggcggcgaagggagcagggttggaaggtgggcggcaaaaggggagccggcgcgcgtgcgacggagcgcgaagagagtggatgcacgaatgggtggttggagcgcgatacaaggattgggcattttggagtgttgatcttgtgggaggatcttaggaaacaacttagctgtttgattgttcaggactcaccaccaaaaatatcggttttctaagtagcagagatttttagatccatgacttgttaaagtgtattattctgatttcaaattacccgatcttacataacattgacatggtatgtcatacacacattcctatcccatttttttcattattattctctatgtttttgtttttttcccctctttttttatttcttacacacgaagaggaaggaagaagagaaaggggagaaaaaggaaaaataaaaggagaaaaagaatggaaaatttccaaatacccctctaaactttaatagaagtccgtttaacgccttaaactttaaaaccggacatccaaccctctaaattttgtaaaaccgttcttattactcaaggtggttttgaaaaaagaaaaataaaaggagaaaaagaattagcacccacgtgatatatgacacaagaaaatcgtggcaatttagaattggaataaccttcataataagtttaagtaattggaagatgtattttaataagagttcaaatagaagcccgcgttgaaaatgaaaccgtaagacgtgcaaactcaccgaaaacaaatctcatcgtcgtcgtcgtcatcaccatcgtcatcatcatctgatccccccacgaggcccccagtggtcctgcaccttctccatctccccccacaataataacagcagcagcatccacgactcgataattcccgcaaagcggaagccaaacccaaacaaaccccaacctgcaacccaacgcagacgagtcgtccaagcaaccaccacccgcgcccacctctgctctgctctgctctcctcgccgatggatcgcgcccgcctcgccgtgctctccgcccacctcgcctcccccgccgccgcctgcggggaggcggacgcggcggggccgctggagaggtcggcggcgtctgcgggggcgcgaggcggcgcgctggcggtggtggatgggaggacggggaagaggtacgaggtcaaggtgtcggacgaggggaccgtgcgcgccaccgacttcaagaaggtaggagcgctacgcttactgctggcttcttcgttgccgcgacctgcgccgtgatccgcgccgggttatgtggggggtgttgcgggatttcgggatgcgggttttggttggtggatcaagctggatttctgtggaatcggcttggattaggggattgcgatcttggttgtgctcaattttcgtctgctgctagtgattgggtgacaaaaccgatgtgtaaatttcgcccaatcgccacccccctttggacaaatcttctccctggagatgtcagaaagtcgaaactagcatgattattgagtttagttcctcattatagtgtctgtatggatgtaggtgtggcgatttctaattgttatcctggttgacttcgatgaggtcgcagcttacccgtttgttcacaatgaagttatcctaaatcttctagtgcttgcatgtgacttcgtagttgtagtaaattgttctgcttgattggcaggtacttcttgcgaacaaactagaatgcaactaccgaattattagataactatgcaaatgttacttcactaccttttggtttaggactaaaatttcaagagaatgtgtggacagctcaagctctgtgcatattatgatgcctttgctatatgagatcatcccagagttaaataggattttttttgggttaattgttgcagattaccactggaaaggacgacaagggtcttaagatctatgatcctggttatctcaacacagccccagttcgctcatccatctgctacattgatggggatgagggaattcttcgttacaggggatacccaattgaagagttggctgaaagcagctcatttgttgaggtggcctacctcctgagtaagtgttctgcacctttatttcctctttaatgcaaatgtagtttttgttgttgaaaacatgtttgctcttgcagtgtacggaagtttgcctacccagagccaattggctggatgggaatttgcgatttctcagcactctgctgttccccagggactcttggtatgttttgccatcttattgtgtatcattgcagtatatatggacagcttttctgtttaatttgtactaataactaatggcttggtgttcttttaacgttgacaggatatcatacaagcaatgcctcatgacgctcatcccatgggtgcccttgccagtgcaatgagcacgctttctgtcttccatccggatgcaaaccctgctcttagagtaagcactctctaaatgcactaattgagctagttgtttcttcacatgattttacttaacatgatagaatcagccaaaaattggattttttaatatctgaattatgtatgcaccatctgttatgtgtaatagtttgctgttgttaatgacatatattgtactcgtgtagggtcaagatctttacaagtcgaagcaggttagggataagcagattgtgcgagtacttgggaaggtatgacttaagaaatccgattattcttgtactagtgaagttaatcgaggataatttcccagttaaatgatacaccctctttcttgaattagtgaagtgataaaatagccagagatattctatggaaggtcatgatgcatatcacaatgatgtttctcttttagatttatataatgttatttttccggaaacaagcactgccgggcaaagcccagcagttagctttatatatgtttggttttactaataattgatgcaatattaacttgattttctgtataggcaccaacaattgcagctgcagcgtacttgagattagctggaagacctcctatccttcctacaaatagtctctcttattcagagaacttcttgtatatgctagactctttgtaagtcacatcactttggaattatttgtattctgttctctcatgtgctctttcatttttcttttgttagaaatcaataagcaattcaattttgtgattgacttcattttccttttcgactgtgatgcaggggtgacaaagaatacaagccaaatcctagacttgctagggttctagatatcctttttattctccatgctgaacatgaaatgaactgctctacagctgctgctaggcaccttgcttcaaggtagataatgccattcattctaagaattgggagtctgaccttgcctgattatttatcctgtgtttacagtggtgttgatgtcttcactgctctttctggtgctgttggagctctatatggtccactgcatggtggtgcaaatgaggtaaacaatgctgagcaatgagcagttgtcacttttgtttcttgcattggactgctaatagtttatatacacattcatcatcagaatctaaggatcaagctcacaagtaacaaagacatacagtctatgtactctataaatttgttctgttaacaatgtaaataagtcacctccttgatagagaggtttttattttcttggatttttttatataattgaaaatttagttctaaaacctttgtttcgctttaaccttgactctacatctgttatttttagaagtaattaaggcattactcaattattatgatgcagaagcactaatgccattttctaacatgccaggcggtacttaaaatgttaaatgaaattggaagtgtggagaatattccagatttcatcgagggagtgaaaaacaggtaatatataactcctgtcctgatttatattttctgatctgaaatgtaatcatggaggtcttttttagtttaatgaagtttaagcttttacctttttaaatctatatgtttggacttgtttttatgagatctgttttgttctttaggaagagaaagatgtcaggttttgggcaccgtgtttacaagaattatgatccccgtgctaaagtcatccgaaagctagcagaggaggtcttctctattgtcggacgggatcctcttatcgaggttagttatgctgaatttctttattcaagaagtccagtttatgatgactgtatgtatgtaaccttcattcagttagtgaaatatttggttaatgtttcacattgcaatcaacacccaagaaacagattttgtcaggcactataggatgctaaatgacatgtacttgggaacatgaagcattcatttctaaacagtaggtctacattttatttgcaatgaatgaatatggactttgcacaacacattgagatggatggaatacttctgattagtttctttcttgatctgatcaatgttgaataaacgcaaacagatttattagtcttttactgttcaatccttttcctgtaactagaatataagcgcgtctgttgacgcgctcgttattttgtacctgtgcatattatataaagtgcatttaaatcgaacaactattttataaataataaattcaattcccttaaaatctcataaaaatataggaaataatatacgcttgtgtgaaaaaagtaattacattcatcaaacaggataaaatatacacttcgatttttcttaaaacacatgttttttaaaatatacgcttcatttttttttcttaaaaacacattttttttagaatatgagtttcataaattaaaatgtttcttgtttatatgcactcttaaatcattgttgtttctattttttctaccatgtagcaaattgatagttataacggcgatggtggtggttctgtcaccaccttaccaactgacatgtggggaccataggtccatgggaggaaatggacacaacatatacttttaaccttgtttaaacaaaacagtggacatgatttagaccataatgttttttataacatgtctaattgacttattaagcatgaaaaataaataaataaataatatctt

SEQ ID NO: 24318 - DNA, 7379 bp, Oryza sativa
aagcacctgttccgtgtagtaattgtgttctacttgcccaagtgctacaatcaatatcatattttggttgctggctttgatcatttgatccatcgtattagaggaatcccaagaactattaggattatatctatcctttccacaatacttgaaatttgattgattaatctggaaagttatttggcaaaaatatcaagcaggctataactagcactcttcgaggattgatggtgtcacatttttgttaactaccctgtgttatcttccaaaccttttcctaatggaacaaaaaactacaataattattttctgttcgtgaagtaggattctgaacaacatggttatctgtgtgcaactgcaataacactttgataaatccaatacacctttgtgatggtttctgatgccatgtcaggttgctgttgcgttggagaaggcagcattgtcagatgattattttgtcaagaggaagctgtatccaaatgtggatttttactctggcttaatatataggtacatcagtgggaaagctgtttttctcttttctctccttttgtcattgagtagctaattgtgattgtgttgattcaggcaatgggattccctacagagttcttccctgttctgtttgcaattcctcgcatggctggttggttagcacattggaaagagtcacttgatgatccagacactaagattatgaggcctcagcaggtcagtgataggcaaacaaatttgccatgtactattatgttcccttagtatgaactccaggtcaatcatgaattatgattactcctttttgagcaacttaacatttagattttcttgtcaatcaatattgagccagattggagccattgttattctgcacagtgactgcggtgatgggaaataaatagttatatgctcttttccttttgaatatcatttggtttggctagctcttctctgggctgcaaacaaggagcgtaggattttcttatgaccacggcatagttatatctttcactaacaaagtccagcagtattcttgatatattgactccttttatacattcatcacttgatactgtgctctctatctagacctttttgggtgtattctgaatgctggccaattaattcctatgtattatatatttgattcatgcgatacataattacagatatggtgttaatcagttagttgactagatatcttgatgatggcttcttctttcttcaggtatacactggtgtttggctgaggcattacacacctgtcagagaacgagtcccagcaagccagggcgaacagcttggtcagattgctacctctaacgcaacaaggcgtcggcgtgcaggttctgccctgtaagatagcttcaaggtacagcatccagcgtacaaaataaaagcaaagcttcatccctgtgctaacaagtctacatatctgcatgaatctgggagctgtaagtcttaagttgtcaagttcacgtatatatgggtaataaactaataatgccacaccagagagcactgaggcgtgcgttgtaatcgtgctcacccaatgtacattttctctttaacttgaattctcccaagcatggagaatgaaaggatatctctgggcagaaactatgaaaatgcaaaatttgaagaagattttccagttcagtcgatcatatcaatatgccatcaagtttattggttgcattacaggaggcaaacttgcatggtcaatttcttgctcgttcttgagaaatcagaaactgccggttgtttcagtggatggtgaatcttaactgttactgtctactataattgccgtttttgtcatgactcattaaccacatggttttaaattcttatctaatcacctcttttctctttcctttgttttaattcttgatttttgtgtagagatatttcttgtatgagaaatagtttcatctttttacctcttttctcattaactttcttgctatattagatttttgcttatgtgatagtggatttaatgttatgaacactagctgagattgagggttggggccttaagcccaagcacaaaatgcattgcatcattttcagttcaccattcgtcactaaactaatccttgtcaggttgtggcatgtcactgtctgcattggcctagatatttcacacgtaggaactatacacatgcgttgttctattgctagtcatgatggcattttttggtcagattattacttgtcttcattcatgtggaccttatcatcaagcttaggtagggcccttcactgcactgcctacctaagtgtctccatccttccattccttgctgcatgttgatcagaacggtttaaactgcaatcatgtgctcatgtgctggtgggtcatctcatttacatctccttttggagttcttcctctttgttaattgtggttggttcttgcatttacggctggtaagtttccatgttcatagcggtggaacatgacctggaattttccaaggaagcatcttaaaaaaaagcattgccactaatgccctatcgcctaatctcatgcctatgcacgttttataggacttatttagtggtcagctaattacttaacattatctgaaaaataaacttgtcaagttggactactcctaagcaaaatcgaccaaaacaacttccatttgcggatttacatattactcaaaattagactttagtagactactagaagatcgatcttagcatgcgtcagaaagtccttgataattatgaatcggcctgctacctgctaacaaccaagatcatttaccatcaacatcaaccattcatagttgcttcctcagtggtgtgcgatgacttaatagcttgcatcctgtactataccactgctaatccatgcagatgaccaggtcagcagcaaacagaccagccaaagaaagtcagagtcagagagcacaacttgtcattgacaaaccatccatgccatgccagagtggactgttgtgttcttgacaacagcctctaatttatgtccaacaacagatttgaagttgatctttgttgaccagttgcaagatgtatagataatctactagtaatggtggatttgacacatcataagttgatccaaatcacctgctttcactggctagtactagtagagagtttgcaactattggttggtcatcatgcatggcatgagctcacatcattcctaagcaaagtggttttcagtccaatttcaccatcagggaagaagaaattaagatcaccttccaaccatatgcatgctaccagtagcatcaattgctgatctttaggaaaggtttggatcctcttttttcatcttttggaactaggaaagagaagtggcacttggctagcagtggcgtttggttctttgcacaaagagagttcctgtggactgaaatgtcaaacatcaaactaggtatccactttaattagtccaagtagatgaaggggaatggcatgtttttagccaagccagtagtagaatcacatgcttgggttgactggtgccacagctgatcaatacagtttttggctccattacatgcactgtatgtctgtatctggcagaatgaagtggatggtaatctaccacaggttgagagaggttacacggaagatgcacaagcatgcatactactaggtgagatcggacggtggacagtagcgatgactgataggtaattaactggaagcatagggatttttttgcaaaaattacactcctaatctccaatgtgcgggggctaatttgcaaaaggaaccgctgaagtggcatcctaattcttcaaggatcccacgcggtttaaagaagctaatgaaaaatgttttgagccgaagctctattttctatggaccaagcaatgcagtcagatacgtacatgtgctcaaaaccgttggaaggcgtgcaaggttaactagcaggggttggctatcggggtcacgtgggataggttaaactctgtttttaagatgtgacggcctcgtacattcgtttggcacgaggaatgaaatgatcctaatgatcctacttttaaaaagatatcttatatatcagccagataaaaaaatggtttggaatagtccatcaatttaatccgaatcttgagggaatattctcctgagatcatccttcagagatgatagagagaatagtgggttagatttatccgtcagttctaataatattttctatgagataccatcccatcccacttatccttaagccaaatactcgaaaaaatagattctaacctaacccaacctatctcatcccttaaaccaatactttagatctatcaaaatgtgtgactcctactacctccatcccttagtataagggatattcactattttcttgtaacgtttgactactcatcttattcgaaaaaatttgtgcaaatataaaaactaaaaagttgtgctcaaaatactttggataataaagtaagtcacaaataaaataaataataattctaattttctttaaataagacgaatgatcaaacagtgcaaataaaatattaaaatcctttatattagaaaacggatggagtatattttatcaagcctaaaaaaatcaaaggttgtactctaagattggatcgtcgacaaaaggaagatggagtctagcctcgatgtggtttgggaaaccttcggagatatcatctctttggtttttttgtcttttctaaattatttattctatgttttcaaaacatgtgctatcataacactttttactgtaatacgtacgaccatttgtttggattatttattaaaattttaaaaatatttaatttatctctccagtctgtctaataatcaaaatcaaaccagaccagaccgtacttaacggtatcaatatgtaaactagtactatatccgtcctaaaatacttgtcgttttgagtttttctttctaatatttgatcatttgtcttattcaaaaaattatagaattattatttattttgtttgtgatttgctttattattaaaatattttaagtatgacttattttttttataattatactaattttttaaataagatgaatgattaaatattaaaataaaaaaaatcaaaatgtctaataatttgggacggagacactagtattctcgttgttaataaataaaaagaaagacaagttgaccggacgtagaaactgtacagtagaaagaaattccgtactactcctacttcttatccgcgaacaaaaaaaaaaaaacacacgatcagcagcagtgtcagcgcgcattaagcgttaatcccccagctggtcaaaaacccgagcctgctgcgatatggcctaccgccgctgcgccgcacaaccacaacccatacgcaactccacccaaaaaccagcgtcgcatcgcacgcgcaagcgcagcacgagcacagtgaggaggagcttagcttagcctagctagcttagctctaccaaaagctctctgtagcttgcttgctgcccagtattgggaggggccgaagggcaatggtgggaggcagccgtctgttcctcctcctcctcctacctttgctgctgctgctgctgggcgccggctgcagagatggccgccggtgcgccgccgcggccgcgcagactcagaggctgccgcagcaagaaggtgagttgcgtacggcggcggcggcagctagctagctttcctctcagattttgctcttcttcttgttttgttttttggttgttgttgctaatttctttgttaattagaattaattactgtagtaagcatgcgcctaagtgtgttttcgcttagctaagcttgagctttgtcttgagattcttgtggatttttttgctgctcccaatctgtcattgcaaccgcaactacaaatcgatcgatggcctccacacgctggtagttgatttttattttactacttcgtatttacaactagcagcctctaccaatccccggaaacaagaataataaaaaaatgtttgtttattttgatctggagataaactgccaaagatttcccttttctttaccgctgattttggcgtctcaagatcatctgcaaaattcacccagatcgcccggaagggcactcaggcatttcttctgctctgccgcatcagatccatcagtgctgctcacttggggggcaatgcctcaagaactcgtacagtcgtacaccgtgcaaaatggcgaaatgccatttttcttcttttcttattgcgcctgtgatcctcgggtgaactgtgttcaggacgcatggagttcgtgccgaattgttgcttctctcaggacgtttctaaaaaattctctcatccagcttaagtgcaaatatatagcattccctgaatcattcagggttgaaatgcaaattggtattcctttaggggcataagagcaaatagcatcgccatttttcgccttttcggttattcccccaccaaaattgtttcctccaagggcccccaagataagggcaagctgtgcgatcttgtcgatggcgaatctgagcaggaagttgttttggcttttgagttttgacttggccgctctcttcgtcttgaagatcccatcttgcgccagagctgcgggttaggcatatgcagtggtgaacagattgatctagtccaatgggtgctgcacgccaactgtttgatgaaattgctgagtacccagggtgcacgccgggcaacttcctaggagtgccaaagttggctcggtgcgctggcaggagacgttggctgctttggcttggctttatgtgcaatacaaaccatggtgacaatgtgttgtatgcatctcatgacattacgacaatatgttgcctggtgattgtattgagttggtaacagcgatggtttcgcaaagccttcctcttgcaaggaatgatgaaccggagaatggcagtgcacaatgctccgcgcttgcaatttttcggaggtttagttgctagagcgcaatgagtcatgggcttgagctgatgggtgagttgtgcaaagccatggcctactgtgcatatatgcgctacaagaaattgggcacttgagggaaagaaatggcatgtttgatagctcaatgactcaaagttaatgtcatggccatggcctatgctggtagctatgtgtggagagaaataatttatgaatgtctcacttcacttgctaacgaggataaatatggagttctgggaggctgctaccatcaaacatgaggcttttgtgccaacattttagtttttttactctctaagcaaatgagaattgcaataccaaacttccttttatccactgcttgataggttctctagctcactcattatgcattgttccgtggctttgtactgtttaagtcacaaattttgacaatttgaccctttctgaaaactaat

SEQ ID NO: 24319 - DNA, 3927 bp, Oryza sativa
tcaaaatttgtgtgtttaagttgtatattgcaacattttgaaattctcatgcgggaacacttgatacttgccttgttggtgctggtgatttctatttgtttcttttgagggaagcaaacaaacaacattgtattgagactgctgagttcttacatgctaacagaaatacaagctaaaatttcaattgccttttcttttgcagttgaagcacttaagggaatagcacgcaagcttaacaagatggattgggacttcagtgtggatccatgcactgggtctaaaacttgggttaatgccagtgattccaatagttacccaaaatctagttatcctaattttccagtcagcaatctgacatgtgattgttcattcaagaacaacacagagtgtcatgttatcagcttgtaaggataatacctattattccacttcttttattgctctagagtggttcttatccagaatagttcaactgtttcagtgtctttcgttgttcactaaaatgttttttttattctttgttcatgcacatggcagggaacttatgcgtcagaatcttagtggagttctacctgaagaagttgtcaacctcacttatttgacaaatctgtaagtgcttccatccagctacttaaatttaagaacattcaccagcattcataaataaaagtctcactttccctgcagtgacttatcacgcaatttcatccaaggaccaattccagcatcatgggctagcctacctgtttttaatctgtatgttttgcatgatcctacatcatatcgtcagaatgcctgtaagtagtcatttgttcaactttctagtgcaattacaggtctctccagggaaatcgcatatctggaacagtacctaaggagcttggacgcatgcccttcttgaaatctatgtgagttgtggttgcacgatgattacaagcacctggagcttgctgggctgaaagtgtatactaaaatatggcaacatatcctatgcatagaagctcttacgtatacacacgtgcacaccaactaacaaatgtcaccaaaaaatataaaaaaaatcatacatgtactttcaatagtattacacataatggtaaaatcttaacctcaaattcattatattttagccgtaacaaaaaagaacatctgacagttttaaggttgtaattctgtcagaattttatcttttttgttactctctattggaagatgtgactttgcgcgtagatgtaatactattggaagtacatgtatgaatttttctagaattttttgtgataatttttagttggtgtacacggtgtgtacacgcgagggcctatgtccataggatatgctcccctaaaatattagaggaactaacttttgaacctcaaccatttgcatgcagaaatctagaaggcaatcagcttgagggtcatattccaccagaattcggtaacatcatcagtttggagagattgtaagttcctgtactgatacctttatataattatttacatcctcattgctaaggaggttcacttgtcttgcgttgttgtttaagacatatacttatgttgttaccgggaatggaaattcaaataaccagacttctttatttaaagttaaatttgcaacgactttgaaaactagcatgaatgtgataagtaaccatacctaattagcattaatacatcgttgctgttcaattgttcccattacagtttatatactgttaattagaataacacgatgccatgttttgaatgattttttttctccttcagatgctgataacttttatcaattaaagaaacatgaatatgccttgaaaacgaagtttctcattatttttccactaaggctgtctaaagtttcttgaattattactcattttcctcttacagtttcatttctgcaaatgacatcacaggagagttgccttcaaccttttccaggctcacaaatatgacagatttgtatgtcccacccttatttcaagaaaatcttttcttgactaggaagttctaatttttgttgtaatttggaacaatttcagccgaattgacgggaccaatatctcaggaagaatacccagtttcataaaaaattggcaacgggtcaacagaatgttagtttcactctgatgtagaacatttcacgagttgcagttgaaatggatgaaaatgacttttgttcaatgttctaatttcgtttaaatcttctctcttgatttttcagagacatgcagggtaccttgatgagtgggcctattcctccagaaatttctttgttgaacaacttaacagaactgtatgaatgtttcatacctatgctttattattttaccactgagtcacaactgatgtttttaacaatatatcttgtaaccattacataatcaggagagtgactgatttgagtggaccgagcatgaaatttcctcccttacaaaatgcacagcaccttacaaaagtgtaagtttatctttcagtgatttttactagcttacattagtacttccagcagagaacggcattgtagcccggtggtatgggagcttccaggtgctcttgctgggcagagttcgagtccctcctcagctctggttttctcaccatttcttctctcttaataattgatgctaagttccttcttagtatcccacattgagtgtccgttcaaaaacactagtacttccagcacaatatggaattctcaccatttcttgttcaaaaacactagtacttccagcacaatatgaaattctcaccatttcttctctcttaaaaattgatgctaagttccatcttagtatccttttgggtgtttgttcaaaaacattagtacttccagcacaatattaaattctcttatgttacagggtcctaagaaactgctccatatatggtgaaataccaccttaccttggacagatgcagtatctaatactcatgtaagtatccagccattattttgcttcaaccattaccttttagagtgaactttcttgttcatatggttatggtttttctgtttgcatcatcatgggtgagacgagaaaagtcagttgttagaattggaaatgtcatggtttattattctaatatgaaatatgggtgtcttttactgcatgcgttggacaagggtgtcttttaccattatctatttcacttgtttttgttgcactattagggggtaatagtattaaggggtaatcttggcataacctattgtctccttttacactgaatgctgataattacaaatacttgtttctctgacatgctaactcattctctactataggatgttgtataagttttactgttcattgaagctaacatatgtggccacacaaagccctggtgttttgctcaatgccatgattacaatctgtattaatttcagggatctaagcttcaacaagttgactggtcaaattccacaaaattttgacagaatggtggcactacaactacaatatttgtgagattaaatccttgagattttactttatgtgtcaacattttttgtttgattttggacaaaataaagtgtagaattctctccaacattggtggttttgtttattgcttttggaaggcgcctcatttcaattactataaataggtacttaagtgacaacatgctgactggagatttgcctggttggatgttgaaaaacaaggcaagcaacaaagtaaacatgtgcgtatgctataatgcaatactcttctgtgcacatacatatatgctctctactggtcactcttgtttactttttatagaatgaaaatcagttgtatatgtcactttctgttttggtgatatgttcttggataacaactgatgaatgcttgcagggatgtgtcgtttaataacttcacgggtaaccctccaaatgaatgtcaacaagcaaacgtgtatgctgctcatttg

SEQ ID NO: 24320 - DNA, 10829 bp, Oryza sativa
tatgaggatgactcatctcgaataggaacatcaacttttgttttatcaaatgacagaaaatgggcctatagtagtacaggagattttgtgggtaatccagatgctgattacattgctagaaacacatcagaactcacactggatcaccctgagttatacactgaagctcgctctcacccctctcactgaaatactatggagtctgcatggaaaatggtgaatattctgtagaacttcattttgctgagattgtgtttacagaagatcatactttttccagcaatggcaagcgcatttttgatgtttttatccaggtaccattcccttaatctgtaggatttgccattttcctttatgtcataatcttgctggcatcttaattctttgctactcttagtttataccacttgtcttacttcattattaaaaaaactatcagaaattttgtgttgaaaagccatcattatatttggagaattcatattttgtctggagcaaatgattgtcctactaacaaaaaggatcaacaacaattgcttgctgcctaggggaacagttgtctcagttatagaattcttacttcattcttaataactatcagaaattttgcatggaaaagctatcattatatttggagaatttatatattatctggagcaaatgattgtcctactaacaaaaaagatcaataacaactgcttgctgcctggggaacagttgtctcagttatagaatttaccatgtttagtggcagtttcttggtcgccccttggtgtttagctcaggcgcttttatgtttccttcgttgagagttgtgtgaagttgtgtgagttgtgtgtggtgtgtgttgtagggctctagccccttttctctcttcttaatttaatgaggcgtagttctcctgcgtttttcgagaaaaaaaagaatttaccatgttttaatgtttgaaaaattccaaaacagaatcatgaatgcacacagagttgtgcaaatccacaaaatccaatttcaaatccattatttgtattaagaagcgacaaagatgaaaattggataatctgaaatcgtcagcaacccaagtggatataaaattatgaataaaatatggaagtttcttttcttggttactttattttttgttggtgtaagttatttcctgctcaaatgatttcttgggcacctgtcctcactttcttgaatataccatgcattatttaattcttgttaaagtagcatcatacaaatatggattactgttctcttaagacattattaactaagatttgcaataatctgccagggtactaaagttttgaaggattttaacattcaagatgaggctggtggtgtccatcgtgtaattacaaaaactttcacaaccaacatcacagataatacattggaaattcacttctactgggcaggcaaaggtaccacaggtgttcctgaccggggtgtgtatggtccattgatctcagctatatctgtgatacaatgtaagttctttgcactcccaactaaactgtcttctttccaacattttacatgtgcttttcaagctctctaattacgcatggatactgtttaatcatatcttctcatatgcttggaaattagctaactgtagtacttgtacagtaaacaggaaccatcatggaatctctactggattgatgattactataatagtagcagcatgtttgattgtcatacttgcgctaattctttgctatatcaaattcttccggaaaaagaatctgaaaggaaatggtaagttgatattcattttctaccttgtcctacatactatatgaatgtatgttatcttctctgtctggtttagcatgcttgtcattgattctaaactatgaaattcataaaacccctaggttttggccttttggggaatttgtagcgtaaaaccttaggttttcccatgtataaagcaacccaggtttttgggcaaaatgttcaacaaaaccagatttatgcaaagtacacatattcttataatgtgtggtattttcaaaagcatatactctattcgttgagaaaatgcctaatgtttctatgcacacaaaatactgcataatatttttgtccaaatattatgcacaaatactataccatgggaattagatgatgtaggatgtacctgggttttatgaagcatttccccccaattcatggggttcttcgaagcaaattgcaaaacttacgaatgccccaaaacctgggatgtgaaatttactaattttgaattcaagtatcagcccgtaaacttattattgaagcaaccaacttgagcaacataaaccaaaattgtgttaattcattacataaggaccaaggggatgctatcctttttctggctgtattatgcagttgaaagtttataactatctctaaactagaagaatgtcaataaaaaaaaattgatatgctcgtcagctaatattgacgacagacatccaaaatacactagtgtttctaccttctagttttaatattttactgtgcatcacaggtttacaattcttttaccatggaaggaagaccgatacttcagatcttcagacacggacacagtacttctttagcttaaaagaaattgaatctgcaacgaaaaattttgatcctgcaaataaaattggtgagggtggctttggacctgtttacaaggtaaaaactgtgaacttaaggttttctcccttaaggtgttagaatacagaaaatttactttgtattcatgacatcactgcatatggtatacacattttgggtgtgtttggataatgggaaatggggggtggtattgggaatgggaaatgaatgaagggttaagattaaatggaaaaggagaaatgaatggttaggatttaaagatgtcttttggtgggtgggaaatcatttcccctatcccattagccaaacactgcctttgggataagtaattcactgccactgcaacatactcagatgatcgaacataataactaagaaacatataaataataataaaggtgaatcgaccagcactcagatgtaataaactaacagtaggcattttaattcagtacctctttcattcctttctgagttgtaacacactgttaaccaatcttctatcttcagggtacactagccaatggtactacagttgctgttaagaaactctcttcccagtcgagccaagggaatcgtgagtttttaaatgaaataggaataatatctgccctaaggcatcctaaccttgtaaggctctttggttgttgtattgatggagaacagctactgctgatatacgagttattggaaaacaatagtcttggtcgtgcactttttggtaagactacataaattcagatgatatttccaaactggttttcctgccccaaaatgaatttccctacaattatctagttcaacgctcatcgtagttggtaagagcattctattctaatagtgtaccaatttttaggacgtggagatcatcaattgaaactagactggccaaaacgatataatatctgccttggaacagcaaaaggcttgtgctatctccatgaagaatcaacattgaaaatcatccatagagatattaaaccatcaaatattcttcttgatgaaagactgcaaccgaaaatatctgattttggtttggctaaactgaatgatgaccgtgggcgtatgagcactcggatagctggaacagtgtaagctgtcattctatatttttattggctacttcacctttcattttctattattgtatattgtaaaaatctttattatccaacatctgataccgttctttatttgaaccagtggatacatggcacctgagtatgccacgagaggttgcttgacatgtaaagcagatgtatacagttttggagtggtgacattagagattgttagtggaatgagcaatacaagtagcatgtcagatgacgaatatctccatcttcttgactgggtatgctattttagcttctttttttctgttactgcttttgtcttttaggactcgaattcataaccagccgtccagccccatagaattgggtatgatcttatgggacgaatttctgtcatagatatgttatcttttataaagtcagtttgcttaactttggagagctctgtcacattttaggctgataatatgctgagtaattgatgatttggattggctgttcaaaattatgttatgataggaataaaggtcaattgtaacataaaccaacaacattagttccaaaaatcgatcatttgaatggcagctattctgctatagccaatgaaataagaccaagtttcttggtactcacccaacggataacaatggataatcagtctgtctagtagctactgagattctgtcaaacaaaggctaacaatgaactaggtgtgcccataaacaattttctcttgatcaggattagcccacaaacaaaccaatattcttcatgccagaagaaagaattgcctagtgctaactgaaagtgtttcacatctgaaaggcgaattacccaagaaatttagccttgcattgcatgttaatatcaccaagtaaactgctgatagtcctgctacacattttaaacacgaatctactaactggatttattttctgcccacaggctgaaagattgaagcaggaagggagactactggaaatcgttgaccagcgtcttggttctcactactctcaagaagaagcacttaggatgctcaatgtagctcttctatgcacaaacacatcacctgttcagaggccaagaatgtcttcggtggtgagcatgctctgtggccaagcccctctagaggttgtacctgatgaagatttgagtggatacatcaggcccagttactcccaatccaatcaatccatgaacaacagcctaacggagtggtcctacgcgccatcgagcgatccttcgatcttgctgcagaacagtatggagagtggttacctcccatcttcaagctccccttcttcaaagctgtgagctgcagcaccaggattagctaggatgaaatgttggcaattgttttgagcccaatgcagcaactgtacatatgcatatgcatttgctctgtctgtaatcccctgtagtttggcattctgtcagttgtcctcagccttctcatccatggcatatgacaattgatatcaatgatgcattgccatgatgatatattcttcacaaggggactggaagcagatattggaatctgatgctgctgatgtgatggtacatatgaattgagcaacttctcaggggcaccacttgagtttcttgtttgttagccttggtcatcatgtatctagtaaatgcaatgtacaactaatctgtgcaaatgtggatatctagtaagttttttttttcttttcttttctagctaggaaggttattgtttggtgggcaagtagagaagacatgtaacataataacagttcagtgcaaactagtttctgcccttgttaacttaaaaaagaaggaaaaagtacactcaaggtccctcaacttgtcatcgagttacaataccgtcctcgaaccgcaaaaccggatatgatgtatcctccaacttaaaaaaccagtgcaaactaggtctctggacggttttcactccggttttgtcctatgtaggagctgactcagcatgggacccatgtgggccccacgcatcagccacttcttccctcccctctccacctctctttctctctctcctatcttttccaaactgcacgggcggcggccggcgggcgcaggcggcgtggggaggagctgcgtgcgggcggcgagcggcggaggctgggcgggcgggcggcggccggcgggggaggagctaggcggcggtgcacgagctcctcgccggacgaacgctagaccggctccgccatgtcggccgcgaggaggtggcgcgcctcgtcggctcgctcagccggagtgccgccgccgacgttaacgcaaatgacctgagaatttgagatcattgccatcttgctgttctccttcaagccctatcaacaagattgacacgattaagcactggatcgagatatgatcgatcgagcagcaccgacgaactagccgccgatcatagagtcaaatgctcacatctcaaaagcttcaatccacgtggacgaatcaatccattaaacttgtacgcatgcacatcacgcacgaacaccacaagaggacatgaagcttcacctgcaaatctctctataaatacatggcaaaaccatcaacctagctagcatacagcaacttacacatgggcctcgtgcatgcactcctccccttagcaggagctgctcctcgctacgccgccgccagcgacggccgacgacccgggcctcgtcgtctactggggccgccacaaggaggaaggctccctgagaaaggcctgcgacaccggccactacaccaccgtcatcatcaccttctacaacgtcttcggctacggccgctactcgctcgacatatccggccacccgcttgccgccgtcggtgccgacattgatcaagcactgccagtccaggggcatcaccgtgctcctctccatcggcggccagggcggcggctactccctccccaccaacgcctccgccgccgacgtcgccgacaacctgatctggaacgcctacctaggcggccaccgcgccggcgtgcaccgccccttcggcgacgacgcggcggtggacggcattgacttcttcattgaccagggcggcgcctaccactacgacgacctcgcccggctgctcaacggctacaacaagtattatgatgacctcgcactgcaggtttaacgtgctggtgagctccgccgtctcggcgaccacgctccacatctcctccgtgtcattgtcgtcgccggcggccggcccatcaccaattcaccatgcgagagacgatgtcgctggtgaggcccatcagcgcggcgtcggcgtcgacgtgctcgccgttggcggcactccgactgagcgagccgacgaggcgcgccacctcctcgcggccgacgtggcggagccggtctagcgttcgtccggcgaggagctcgtgcaccgccgcccgccgcctgccgcctgccgcccgcgcgcggctcctccccacgccgcctgcgcccgccggccgccgcccgtgcagctactccccgcgcgccgcccgtggagattggaaaagagaggagagaggaagagaggtggagaggggagggaagaagaggctgacgcatggggcccacgtgggttccacgctgagtcagctgccacatgggataaaaccggactcaaaaccgtcttgggacctagtttacactggttttgtaagttgagggatgcgttatatccggttttgtggttcgaggaccgatattgtaactcgatgacaagttgagggaccttgggtgtactttttccaaaaagaagtcatgttttgttcattggaagttcattttggtggggattgggcctggatttgggctccctaaagtctctctggatcactggatgggtcttagccttggtccatccacgcccatccaaacaagagcctaacacaaattaaagcccatccaaactcactgaacctgaaattgatcttatgaaaccaaaatcggagatgtgaaacattcagcagcactgcttgattttctacctttctacacgggtttctatttaagcaccatgaatccgtgagaatatatactgtcaaagaccatgcaagatctaatcaattttaacatctttcaactattgctaccacatatcatagatttcttcgaaatgctactgctcctagtccaagaaaagacaccacatcaaagccaaatgcagaaatgctagcaaaaggctcattttataagtaattccggtacgctttttttccaagcacaccggttgaccatggttccatttcattggtactattttttctcctcgattacatggaagacacatgtcttttgtcacttgctatgtacatggccaaattaagctcattccctatttcaaacaaaattaagttcccttcttatttcaaacatgtccttttttttcttgataatttagatgtcgaaatactgaacttcataagcatggatagaggggggaacttatcatactcacctatttaaaagaaaaccataatctgcaaggaaacactctgcaattttatcacgtggtccaaaacatactattccacacacacatatacatagattttttaagttctacatatataggaggcagagaagttccacacgaattttataggaatccccacatctaaaaacacacatcacagaattcctataaaattcctgcgttacaaaggaggccttgtggcacgtagccgagacgacaacgaactaacgctaattaaattactactatatatgtgtacgtcacaaatagtagttcatccatctcttcccttttaaatgcgatgcggtgcatcgatcaagcatctcgatatcgatctcgaacagaaagtagcagtagtagtactggcagtagtaattaattagggttcttggtggttagctagatagaggttaggtggaggagttcatccggttcatgctcttgaggaaggagccgctcttggtgatctcccggaggggcttgttggtgaagcggatgatgttgtaggcccaagctccggccaccgcgccggcgaccggcccgacgatgtacacccagatcgacctgtactcgccgccgatcatcgccggccccaggctccgagccgggttcatcgatgctcccgagatcggcctgaacagaaaatgcacatgtcatcaatctctgatttttttttttgaaaaagaattatctgaatctctgaatctctcatcccaaatctttattagggcttgttgatcattattgtccaatataaaatgatgctggttaaaggtaggtaaaagggtacaaatgaattttcttcaacaaaacacaaaaactctgtttcagctttttttacggactctaattaatctcaattatggacatttgtttataagaattgactaaacattatttatacattaattgaaaaaaaatagataagaacaagttatctaagccttagtgaaattgtgaaaagaagaaattgtagtttgagaaccgtgtaacaaaaatctacaaattcataaggtttaagtcgtagacccgagtgttcggtacaattccaacttcacgggataaaaatcttacgggctgtttggatgggactaaaattttttagttcctttcacatcacatgtttggacactaattagaagtattaaacgtagactaataacaaaacctattccataaccctggattaatttcgcgagtacgagctgtatcaaacggggtccatagtatcatgtcacaactatggttgtgtttagttacacgttaaaattgaaggtttgaaaaaattagaacgatgcgacgaaaaagttaaaagtttgaagagaaaaggtagaatctaaatagggcctgtatcaaacggtgagttattgagaggcaggcaccatgggtgaggagtgaagtggagtggagagtgtgaatttacaagctaggcggccggaggtaggaggagtaattaagttgacattaatgcttggttgcagtgcagtgcatggccgatcttcactgcaccaaccgcagcacactcaaagccctgcgctccacatgaccgaatttattggttggctttggctccttcaaaacgcactctccctaccgaaaaggacgcatacatctgatctagtctgaactctgaatctgacccattgttttcttaattttgactggaaattatatactactactactactatggcctggtttggtttagtttctaactttttctacaaactttcaacttttccatcacattaaaacttttctactcacacaaacttccaacttttccgtcacatcgttccaatttcaactaaacttctaattttgatatgaactaaacacaccctatatgtttcatgggcatggaaagaagtggatcgataccaacacattttcagcctctagatcctctttgaaatactttccattgtgaagagtaattaattaattatcatcatgagagagatgatgcgtgaaagaaagaaaaattaaaacgtacccagcaatcagcacgttaagcaggatggttgcaccaacggccagccctgccagctccccgatctgcatccatgcatatggtcaacagaattatcacttcaaaactttcagattaatcaggatcaaatcgatcctaattagtggagcaatcaaattacagatatatagaaactaattaaactagataattaattagcggagggagcaattaaattaaatgaattaaaatcgtgctaggtagcttacggctcggttgtcggtggcgacgccggagatgacgaacatgaggtagaaggtgatgatgaactcgaggacgagcgactgcacgtcggagccggcggggagcgtgccggggaagtgctcgtggcggccgccgaacatgagccggagcgtgccggcggcgagggtggcgcccagcatctgcgccgccgcgtacgccggcacctgccgccaagggaacctccggcacgtcgcgaacgccagcgtcaccgcggggttgaagtgcgcgccggagatgtgccccacggcgtacaccatcaccatcaccgccagcccccacacgatcgccacccccgggaacgtgatctgcccgttcttgctctggttgatcgtcaccgccccgcaccccgcgaagatcaagaagtatgtcccaaagatctccgcgatgat

SEQ ID NO: 24321 - DNA, 22165 bp, Oryza sativa
  unsure (1)..(22165): unsure at all n locations
gggagttgttgtcacctcctgccatctctctctctctctctctctctctctctctctctcnacagatgcaggtgagtagagaaagaagaagaagaagaaggatacaactgcaatggcaatggattcgccgatgacccgggctcctatttattggcgccaagcaagctaagatctctctctctttctctctccttccatggcagcagctgatgctgctactgcggatagtaatcactttccaagccgtttggattgaccgagcccactttaatctcctggttgttggtgtgctccgttaactgctggtgattatccatttaatttaatcgtgatcagggattaattgattagtatctgtttggtttgtttggcgtgtcaaaaaagaggattatctgttggtccaatgagaggccgaagggagtaacaaaattgggattcaaagcccacctacccaccagtggcagagtcgacaatcaagtgaaactcttcacaaatgttttactggaggcacagttgatggaagaccgtcagaaagtatggctaatcgacaagcccgggaatcccctggcaaaattttcatcatgtcatattgaatgtttgacatatttatagagtattaaatataaacgaaaaaataactaattacataaattacgtgtaaattgtgagacgaaccttttaagcccaattgctccatgattaatttgacaatgtggtgctacagtaaacatttgctaatgacagattaattaggcttaataaatttgtctcacagtttacagtcggaatctgtaatttgttttattattagaccctgtttagatggggctaaaacttttaagtccctatcacatcggatgtttggacactaattataaatattaaacgtagactattaataaaacccatccataatcttggactaattcgcgagacgaatctattgagactaattaatccatgattagcctatgtgatgctacagtaaacattctctaattatggattaattaggcttaaaaaaattgtctcacaaattagctttcatttatgtaattagttttgtaagtagtctatatttaatactctaaattagtgtctaaatacagagactaaagttaagtccctggatccaaacaccaccttagtctacgtttaatactttaaatatgtgtccgtatatctgacgtaacacgctaaaactttacacacatcatgccatcatggatctaaacatccccatagtactgaatagttgagtaaattcccaaactatatataactttttttctataaaaatataaagaaaactattactcccccatccaagtataaggttttttctgatccaaattttataccatagtttaagaggattattgtaatgatttccatggttcccattattttcaatgatgcttggaaaggaaatatgaacaatataaaatttatgattaatatctgaagtgactaaaatggaatctctcgagctaaccttaatattggctaaacaacttataaatctttatatttttggaacagagagagtaaattattttcttttcaaaaaatacacatgtacacccacgacaatagatttgtgcctacattgcatgcatatattctttaatggataattttaccattcttgagaaggtaccgggaggtactatattttttatttctagtataaaatttggtacctctaggtagtaagtatcttgaggtaccaaaattttagtataaaatcttggtacctccaggtactttctcaataactataaaatttctctcctttaataatacagtacaccctttcaaagtaggctcaagaaacagaaggcaacgataaataatccatgaccaaaaactacaatattgtcagctatgcatgaaagtcatgacaaatagactcatcgattggggaagagtcctactgcgatgctcccccataaatgaaccattgatcacatttaatcaaaagattcagatctatttatactatcattctagttagcagcagtggaaacgtagaggggcatcattgtaaagaaaaagtgcgaatgaatataatcctcaattagcagtaactaaactttttttccttctttcttttttggctttttggtagaatatgagcgatgccaacacaatggatgaccacatatcgatctgggcagggaaaaacctaaatggcaaagttaccaatcatcattatactagtaaattaccgatatacccttaataacgaatggtaccggtagagagcaccggtgcatcactcatcgggaaaaacattagcgatgtaggggtggaatcgtgggtacatgactccaaccgctaggattcaaatcctagtacccacgaatattgtacatatgcaggtgtgcttttaacggaattttagtaaaatcatggatgtgctgatttcagtctctttgagagtgtgctaaaagacgcattcgtgggtgtgtgagtgtggatgttgcgtgtatagtggtgtttgtgcgtgtgcgtctgcagtgtaatcgaaaaaaaaaaactcatcgatcattcacactagtggagtgtaccagataaattttcgtcgatctccgacaattttttgccattctaattaattttcaagatgggattgaagagtgttgagatacccagaaggatatgatcgtacggcagaaaaagcatggccaatgaaaaaaaaaacgagcttttgtgttggacaaataatgcacggccatggctctgtgaatcctcttgtcgccaagttaaaagttgcaataaatcgtcgatcggcacattaactttcaacgtctcccagtaaatgcgagtgctttatggcgatccaacaaactggtatggccatgccttaattggtttagtttttatttttgaatcttgattggtctaatttaattgtgaaataaatagctcggctcctattacggtgaaataaatgccgtccgattgttaaatttaaatcatatattcacatgtatactatatactccctccgtactcgtaaaagtaaatcgtttaagaaaatgtttaagttaaactttgagaatataaatcataaataattctcaagttgttgagtttgaaaatgtaaaaattatatgaatagatttgtcttggaaaatactttcataaaagtatacatatatcactttttaataaatattttttatagaaataagaagtcaaagttgtgttttggagaccgtgtcgctgtacaaaacgacttcctctacgagtacggagggagtacatgagattttctggcatttctcataagtaaatcatacatggtatatactccctccatttaaaaacagagagattttagttttatcgtaaatcaaacttatctaacttcaaatataaaagcacaccaatacattaaacaccaaattagtttcattaaaataaatattgaaatatgtgccttgatagcttatttattggtatcacaattgttaatatatttttctataacctagttaaaattagagaaatttcacttacacaaaactaaaacctcctatagtttagaacgagtgaatactctttaactttgaggctgcattaatttgtaattatgcatttttgttcttagttttgacaatatttgtaattagaatccatgcattctaaaaaaactatttaattaagcgaattggtgtacttcaccttcacctagttaggtttcttgcggtggaatctatccatcctggctcatgtcctaaacttgagatggatacttatatgtacggttaattattctatagtagaagccaacaacaagatactcatcatgacttcatcggtcagaagatatagacgtgggtagggctgaaaaaactcgattagctacctcggtggctcggttcaaaattgctcgccatgatttgatctttttcttttaaaaaaatattcaattgtaaacgaaagttatttgcgctttggcttggctccttacttcattaacaagaataggcacaattgatagataaaaatataataaactagaaaaaaatgcccgtgtgttgcaatgggtgaagtctattttaatcttgttatatggtttagttaagatgaaattcactgtgggagtttgcttggatatatatatttttagaaaatcatgagctgtagttaggagtccgatcgtctcaagttagcatacgagtttttttaaaacatatttcttgtatgattccttctgtattaccaaaagtgaacgatcttaaaaaccgactcaaacacaaatgactaaccgcgaaaacatcttcaatttttataatcgactcaaacacggatgacggaccgcggatagaaacatctttaattattataatagtaatagatatatagatatagatatagatatagatatagatattgattataggaaaataactttgaagaatgctagataaaaagttgaccaaaagcttcttttgcaccggaagtgcgggtgtatgctttcatacaagtgagtgtatatcagtcggtactatgtttcgaaaaaaaaaaacaaagacacgagggtagcatgcatgcatccacggtgtgtactatattaagatgaattgtgcgcataattaagcacgtacgcgtacgtccacacataataagcattggtgcgaaatttcaaatttatgcttgcttcgaaaattaagattgattgaaatttggaagtttcgcaccaatgcttgctttcatttggaagtttcgcaccaatgcttgctttcatagttcacgctaaaattggaagtttgattgaaattggaacgatgcgatgaaaaagttagaagtttatgtatgtaggaaagttttgatgtgatagaaaagttggaagtttgaagaaaaaattgagaactaaactcggcctcattaaactataggatgtgtcacatccaactaaaatctcttattatgggacggagggtataaggttgtactatgttatttttcaaaagttaagggttaggtgagatgattttcttcactactaaattacaaatcgttaggcgctctaaataagttttcacaggcagatagattatcgttcggaactaaaggccactgagaatcgacaatgtttgtaggtttttccacacccacccatcaggctgacctatgaaagcctttttttttatgcgaaaaataaaataaaaatctaaaaaatctagtagtcgttgctcgcggtatccatcatgagctccttgccagatcggtcgtcatcacctgagctcctagaattggagctgcatactagcccccatcccccctccccaatcgcaatcgccagatctggcaacctgttatacccaccaccacagtatgtggatgacccctcgcggtcatcgttgtacgtggttggggtcaccatcattctcgtagccttgcgatcaccgccgctggtaattattatggtcgaagtcatggatctagagcagctcatgagtcgccgccccgtaggatcggccaatggtggtcgatccggtgctcccaagcaccgccgttgcaagatctgcttcctctaaccgcatctgccttttgcctttttcccgttcgctttgagtgcagtcatatttcacccagagcgtcaggaccagatctaatacgttgaggaagactgaagcaacggcgataccactggtaggaaaggatgaaaggccgaggagggggtgttgggagagagagaagacgggagtggaggtgaggagaggccgaggagagggcagagatatcaaggaaatgagcgagagtggagacagaggaggtcacttgtatggtggaaatgagcgagagtggagacagaggaggtcacttgtatggtggtgttgtagatttttaatagggtatctatttattacgtggaaggtgccaaagttttgtagcggtgcttttcagtcatcttattggttaagttcaaatttgaactaattagtttattagaatattagatttccgtatattgaaactggttcgtagaaatgtttactccctcataaaaaaaacccaacctaggatatgatgtgacctaatccaagactatgaatctggactgattcatataatagatcacatcctatatatctaggttgatttttttaaggactgagggaatatattattatatatagattttaattagaaaaaattatagtattttaaacagagaaagtactgtgcaaagcaatagccgccgacgacgacggacggcatgcagcaacaaccgcagcaaatgcagcgggagtgtacaggtgcgaagctggctggagtcgcaaacaaaggcctctcatctcactggccgcccgtacgtgcttcattcagtaataatggcggctaagcttgcttgccaggacgagatcgagcagccagcctgcagggcgccattgccatcgccaaaatggagaaaatatagttagctgctggcgaggcaggcaacccgtgttgggaggaggccattgataagccgaaaaccttggtgcatgtatgcgtgtgtgttctcgcataattaatcagtaatgctcatcatattattaatgctgtacatgtactccctagctagagctagtacctagtagtatgcatattggatcatcagtatttgcgcgtggtcattaaatccttaaacctaacacttcaattgtcatccacgatctgggtccgttaatcacttgttattacgcacactacggagtggcttgaatcgtactagctagtacaggcttgttttttttttcttttgttttgttttcctttcgatcatcttcatgcagggaccttattgactactgtacttggatagttcgatccgactgctagccaatcgctctattcaatcgactagttcggtcgatcgccggtcggcactgccagccttgataaccaatagttaagggggctgtttggttcactccctcactttatcaaactttgctatactttttaagatatatgtttgtttcactttcaaactcgtggcatgccacagttttttaattcaaaggcccacatgtcatacaactattttttagccaaaccatgtctaaggcgtggccatcaatttataagtcacatatttggctagattacatatttggctaagtttggcaagaaggtttggtaatgtttgggagggaaccaaacaactccttaacctttactatagttctgttgttgggggacgacatcaggaggggatgaaatcaggcgctgacgtcagcgcccaatttacgtgcaaaattaatttaaattgatttttctcttaaattacttatccaaatcatgatccgattgcaccattaaattcgttgcaattaaatcttcaaaacaagaccacacatggatatattccgacgaaaattttttttagcttattattgaattatttttaaatgttgcacgatgttccaccaggtatatcggaattgtttcactaagtagatcaaaaatgtcactcgtttaaatcgggtgttgttttaccttatataaaaacaatgtttcagcaaatagcgaaagaatgtttcagttcactgcaatatttgatccatacatagtgaaacattacaagtacactaagtgaaacatttttcggtggaacaaaaaataaaatgaattcccttaataggaggtttccaaaatatgtggttttttttgttgcaatggaatatttcagttcactgcaatattagatctatatatagtgaaacattgtgagtacactaggtgaaacattttttatggaaaaaaaaataaaccgaatttccttaatagaggggttccaaaatatgtgggtttttttgttgcaatagagttgtttgtgtgtggacacgtggtgggccaggggagtgcagacatgcacgcgcacgcggggggcggggggagcgcctattttcctccccccgcccggtcgcccggtgcacagcattatccctattgttggtttggtttcacttactcactgctgaaaaagcgattttcacggatgaggtgcttatgttttttcaagcgaagatattttcttttagcagaaatccgcctgcaaaatgtgtgggtggggggtggtggggggggggggggttgatgatggcggtccacatgtgaagatcaaggaacatgactagtcatggccaaattttaaatttgtttttttctccaaaaaaatggtgatattattaattaaataaagtgattacaattccggaggcacaagattgatcataaatataaactaagaaggtagcccgtatattcacgcgtgcatatatcataggctgcatttgagatacttgtaagtaatagaccgattgtattagaatgtcgtatttgttatatagcaaactataggcatgtggatctaggcctgccactcggtattcattacccatccgatatccatacccacattatttatgtagggtataggtaaacaaatttacccatttaaaatttggatttgtggagtgtattacctattttacccactttgtacatacccattttctatgcgtaaaacttgcacctaaaatttttaaactctcattcacattacaaaatcttatcaaatttgactttaatttggagggatgatttctgaaagagcaattttgtacaaattttggtcaatttctacattaagacccacatatgtctcttctcttatccattggtgtacccatacccattgggtaatacccacttaatttaggtatgagtaattgctagtgttatagataaggcatactcaatagtcttggtttaggctcgatggagcccaccatataccaagtcttatacaaaatcatgctttattacagaaggtatttcgaataaggaaggagaaacagagttttacttctccctaattctattttccatagttctatttgaagaaggggatattcgagggcataaatacaagatccctagaaggaaggagaacatgcaacacgtctagatagatctagacatgccaaaacaaaagacatgcccaatccggaaaaaaaaaacaagagggatataacgctacctccaaggctatctcactgaatttatattcaaagacgaagacaacattagccgtcgactatgattagatgaggatgagtaaaattagatatggatattggtttccaaataccctccatgctcccattaaattaatttcagttatttgtgtccattatctattaaagaaactagtttactggtgaatcggctactgtatcacacatccttccgaccatgcatgtagcgatgtgatgtacgtaagccatcaattttcataagttttcctaattaacacgcaacaataaacaaggctgatcatgccggtcactgaatgaattatgattattagcactccactagctagctaattaacgagacctaattaacgtacgacgtacgtggatattaaggtagccaaacctggagaactatatagtacgtatatagtatatactactagctagcgcagcatacttcttcagatgttttgactgatcaaggaaaaagatcgacgtaggaccgactaattaatttgcatgtattaatttatactccctccccatcttagacaaaacatcatttttctcatataaaattatttttttgacgaaggaattaaccacgtatatgcaaactatatatactgtgtggttactggccttatcgcggggtacggtaatagaaaaaccacggtaacctcctcaaattcaaataaatttaaaaataatttaaatttttgataaattttgcacagtttcgtacggtttttcacgggttaccgcgcggtaaccgtgcttaccgtcggggcgcggtaaccctggccccggcggtttggaaaaccctggatctgacacatgcaatcaatagatgcatatgactagctagcttgctgcggattcatcagttcttcatgcttaattacgtgtaagtgagatcatgcacacgtttggacgtgccgtacacgacctggtagtagcattggttgacctggagtgaacacgaacacaacgatatactatatatacatacatatcaacccatgcatatatgtggtatttttttttgtttgaacattcatatatgtggttagacgaccaaatattcgagtcatgctttgtatctaagctatatagatagaccaaatatactacggcgcatgtgttaggagagatcgagggtagtctttacgcatgtagtgtgaatgtgtgatccgtacgtggccgagcgcaacaaaagcacgtcaatgcggcgtgcttacagtttttctttttctattttctcttctttccttccaactgatggtagggaataaaaatgcagggatcctaattagggcacacgtaccagggagagaattaagttgcgcgcagttttcgactgcatggcgacaaactaaggttaaggttagggtttcgggctgggggaagggagggtggtgctgggaggaggaagtgtggggaggatttagagggatggcctaggaggaaacagaccaacagtgagtagcggacaaggccagaaggcaaggtggcgatggcactgctggaggcgccgggtttgcagtggacaatgggctggtgatggtagcagggataaagtgaggcgaaggggaaggggagggtgaggaggccggccgggcagggcggcacgttccgccctttcggtgccagcaaggctggggcggcggcacggtgggggtggcggtggagctaacctgttaccagaggaaggaatatggagctatcattgtcgcccttcgctcgcatcattgtcgctcaactgcaacccctcttctccgtcatagcaaatcactagagtgaggaggaagaagctcaccgtgaggctgtcgcccgctccgctcacgtgcgttgagtggagaggggaagtgaggggaggggagtgcatgagaggggggaaatggggtgagatagggggcgtgcactcatgcagagggagaggaagtgtgcacgacttcccctcctagctcacgtgcacttgataggaggccccttaaacgtgcttacaaattttccttttctttttctttttggtattgctctatggcatgtgatatttttttaatcaatagtaattcattaaccgaaaagtaatgcaaatttaggaacagttgtatatcggtattcagaaagacttttacatattcagaatagttgtataccggtataaccgaaagatttttgcaatgtcataaaactatttaaaattccattaattttgcaatggaactttgttaatattttttatctattgtatgagatatgcatattgtcatttttagttatctttattcttttccagaattttactagatcattgatatgttgatacaatcaatttgaagaattttatataattccgttaggaattttctcaaattattgatgttatgagctaaaatttgagaaaatatgattaagtttcctacatggtatttttctatattagttcctatatttgacaaaagtatgattaagtttcctacatttgactacttataatttcaaaaatttgagaaaatattatttctttgttcctatggtattgtcaaatttgagaaaatatggtattgtcaaattctaacatggtatttctttgttgctggtttcacttcctttaatattatttttctatattagttcctatatttgacaaaaatatgattaagtttcctacatttgactacttataatttcaaaaattttagatataataacgaacgttatcccatcatgctgatgaaatgattcataattctgtacctctatcctttgaattgtttccttcaacttaaactttattagcttatatgttgcctaattgtactttataagcaattaattatgccttattcaatgctcttgcatggtgtttaattgtacttttctgagcatcaaattcatttaaatttctcatttgtctacttataatttcaaaattttcaacaacgaacattatctgatgaaatgaaatgaaaatgctgatgttgatgaaatgatttataattatgtataaatcattttattagtcaaatgagaaattttacaattatgtataaaattgtccgtaactacattaaaacgtactgctaccatattctccccttctttttaatgtataacgtcgttaactttttatcaacatttgaccatttatcttatttattttttatgtagatataaaaatatttaattcatgtttaaagataaaaatatttgttttacataaaaatattgtttatgtataaatcaaggtcgccatgagccaagggaaaaagcttccgatgaattttccatggtgatttccactttccaccctgcattatattaggtactggcgtgtgtatattctaattctcccccgtgtgagcgtcgtcgtcgttcggttttgttttctaaagtcatttagcatttttttttttgaaaaatagatgcaatagcttttgggatgtctattacaattttgatagaaaaacaccactaaaaataatggatattcttgatgttggatcgctttattaagatatgtgcgtctggtttgaggttcatactccaccttatttcttcctttccagctcgtggctgccgataaatgctgatgaaatgatttataattatgtacctctatcctttgaattgtttccttcgacttcaactttattagcttacatgttgcctaattgtactcttctaagctattaatcatgacttattcaatgctcttacatgttatctaattgtacttttctaagcatcaaattcatttgaatatctcatctcatttcttaacgaaacatgcaattgatcatgtaatgaatgtcaaccagtttggattattttttggtaactttttcaacgaataagtacaatttatctatattatttataattcataacctcaaaagtaatgcaaaattcagaaatatttgtatatatgcattctttgaactatttcatttcacttcagccatgttctagtctttgaatagttcatttcctacaattgccctgtatattcaaaatttgttgtatatttaatgaacatctaaaattataactataactatggagacactgggaattataaaatctaatgtctaacgcgagcatcacaaatatttggatgggtattatactatccaatgcccaacgcgagcatcacacatatttggatgagtgggatccaaaacatgtgcgatgctcgtgttggatattggaaaatataattaccggggtgcccacactaatatgaatggtttttagatactatttactaactagcatgcttattttttttattcgcattatcttatattaaaatcacagtgttttaattgtgcaattttatcacatatgcactgtaaattgttgaataatgatattatagttgtattatattcaagaaaaaaaattatgtagtattacctgtatttatagttacaatttatgttgtctagtagacatgaataaatcaaatgagttaatatgatcttgtaggagttgaaaaattgttccgttctattacccagttttatgagctaagcagaatgaaagtttgattgtgttctctttgcatctgaacttcccatgatgtagatttgatctcgtttcctagtagatccaccccatgctgtttacatacttgtcagctcaatttgagtgaggagatggagtacatgtcaaatcaagaaccaaaggatagagaaaactttccttttgatttcattagattgatgtgttcttccatatgtttttgttttcatcaacttagttaacttatatgttgcttaattgtactttcctgatcaattcatcatgacttcaatgctcttacatgttgcctaattgtacatttcttagcatcaaatttatttgaatttctcgtctcatttcttaacagatcatgcaatcgatcatataatgtatgccaaccaattcagatctttttataagtttctcaactaatcagtatatatattttctcataatcatttatgattcataaactaaaagtaatgccaaatttagaaatagatgtatacgtatatcctttgaactatttcattccacttcaagacactctctattatttgaatagttcatttcctgtagttcccgtttattttcaaaaaaaaaattataggactaaccaacaaaaacttttcataatgaaaataattgaacaagcatcttaaattataactataacatgaatgatgttcagatgctagcatgcttctttttcatttacattgtctttatattaaaaatacaatgttttcattatgtaattttataacatatgtgatgcatattgtttctactgctattataaagagaaaattccttctatacccctaaaagtttagcaaatcccttctacgccctgagttttgtccactcccttgtatgcccctgaattttggttttgatccctttcatacccattccgttagttgaccgttagttgaatgtttaattcctatgaaaatgaccattttgcccttacacatgaaggaaatctgaaaattgtagactagctatattgttggaagtgtataattttgttatataagactattatattcatgattttattgtacaaggtattattcatttcaaagtttatttttacataatgacataaaaaactaatatttatttacttattaaaagagtatatgtagcattttttatggtacttagatcaacattttttttcctgtcctatatattaggaatgttttccaaaactatgcttatcatttaaagaaaattctatacatactttttaatatttattaaaatgtctatgtacaacaaacttacgaatgttataatcacacaacaaatttctatactttcaacaatatagtctacaaatttctacatattcctcatgtattgaagggcaaaactgacttttctatacctattaaacggtcaattgacggcaagggtatgaaagggatccaaatcaaaattcagaggtataaagggagtgaagagaattcaggggcatagaagggatcggctaaaatttcaggggtatggaaggaattttctctattataaaaggtattacaaatatagtaattgcaatgaaaaattttgaatcaggtaactgtggagcaaagtagtttacttgttagtttttaatgatgtgattttgtagaaaaaaatattgatgatatctttctgttgtcctaaaaattgtcagcataaatatttaaaaagaaaatatagtcaattacataaaatttgcatatgaatctggtttaagaagattgttgaagtttttgatatgttatatgaatagtacatgtttttcttttaacagaatgcaatttacttgaatcaatggtagctatgaataaaactggtttaggaggatcgtagacctatgaaaaacatgtttgtgtttggttggctggtatcaacaaccatgtacttcgatattaggagttcgaccttcctcccccatccctcaactagcgcatgggtatacaatttgtttcccttctcacatgaatcttggggcaatccaatattattatcacaaatctaaaagttttaactactaaaaaacgatttttttatacgagagcccctataggttgcgcgcggaccataacagatcgtgtctacaaaaatcgaaccccccatcttcgcatatggctccttaagaggcacgtgtgcaaaaatctattttcgccggtgggtcacttaaggagccacatgcaaaaataagtctattttctcatgtagtcctcttaagggaccatatgaaaaaaaaatagattttcacatgtggacctcttaaatggaccacatgaaaaaaatacctccatcttctccggatatattctctcctcctctttcttttttctctcatcactaaaaaaaacttttgcctcctctcctatcctctcctctcctctgctctctctccttttctcctctcgccccctaaccgagtggcgagcaggagcaacgcgtgcatgacgagggccggtggtgacggctggcggtggacccggcgatgccgcccttggcagtggctccggcaacgatgacggcggggtttttcgaattttttttcaccgaatttatttttgcatgcggttggtatagttgaccgtatcagaaatctcattttcgtgtgcggttgcgttggccgtatgggataatccgatttttgtggaccttttggtgtaagtgggctactcatctgtacgtaaaaatcactttagcctcgcggaaaaaactactttttagtagtgtttgaggagaaaaacactggtggaagttttttagcaattaaataaattaacagagtataacactatgaaagtactactatatccttaacactacgataagataatcgaccatatacacgtcctagaccaaattaatctctctcacaggcctactacgacagaccatatacacttaatccattataaaccacagttgacgattagtagcaagttaacagaggactaaacgctactacgactacgacgtatactactgccagtagtgtactagttagtacacccggtcactggtcatcagttggctggtcgatcgacctctcttccgggaggaaaatgtgccgcacattacgctctaatcaaccaccacggtcttactgactgattcatccatcagtcttctctttgaattttccacttacatctgatcttcgtctggacacagccagggttgactccatccgtcattgctccaacaaacttcatgtcactctacgagctagagctagctagctaccggtaatttcgttatatgtaaccgttggatagtactccctccgttcctaaatatttgacgccgttgatttttttaaacatatttaatcgttcgtcttattaaaaatttaagcaattattaattctttttctatcatttgattcattgttaaatatactactaccactcaagtttttgaataatattcacaaaagtttttgaataagacgaacggtcaaacatgtttaaaaaagtcaacggcgtgggaatgagggagtacaagtgtagtactactagtgttcacacatcatccaagcttactgctcctgcagagtcgtgggcagatctacagtgttagcttagatgcaagacaacgtcaataatttttaattgaatttatggttaaactgtttattcataatactacgatttatatatatactaattaacatactatgacactacactagtacgtatgttattatgatacaggaggaccaaattgtatcagcctctgtgttcttttttggagggtctgaacctgatatttttttcgagcgattcttctatctgttttgttttgtaaccagtgtcgcaatcaactctttaattaatcggtgccatgataatcatagttaacaattaataatatcaaagtccctacatattaaattctccaggacaaaggaaaaataagcacactgatgagctagccccagcgtctagattgtatagcaagatatctgccatttggtccttccctaccgatgcaaaagacgattaaattcagacatgacgtgttgccgacatctctcagcactagcaaagatcgtctgcatggcttttcaccacaaccaaaaacttccagataaaatggagatgaacacagcacaggtcacacacatgcatcacaatgcacgtttcatatggtaaatttgtgttcttcctcctaacacacacacacacacaaaggcttataatatgcagggatatattcagctaatccttttttgacttgttctttctttgttccctgatggaatgttcaccatttggcagggaatttcttgtgtttacatgggctttttcaccccctactaattagggctaagcttctgggtgccggtgccaccagtttctagtcatgttgttgtcagtattagtgtgattgtgacattgcttaacctgccttttaccatctgaatgtgatcaaagttaaagtactccacacatttagttggagcatctgcaactgagatcaaattaacgacagccgttgccttttttttttctctcactggaatatagtagtatatatagtggagatgataattaaccgtgcagcttatgttgatcgatcgatcgatcttgactgctgcatgctcgtagactttaatttgttgtgcagatggttcttcacgcgtgctacgtaaaaagcaaagctaacgaaagcaattcaattcaagcactgcatgtgtagtttgttcaacacttagcaaagcagctttaatatttcatgtgctttttgtgacagttttatctgagctttaacacttgcctttcgtatgcacaggagaaagtgagaaacagagtagcagtacgtagttttcaacgagagacaaaactgcttaacagtatctgcttgtttatactgatcaaagtctcaagctagcaaaaaaagattaaaactgtctccctggaagacattaatctttcagtataaacaaagcactgcagttttaatctttcagtataaaaagattaaaactgtctccatgggcctccagggagacattacgtgtgtcaggtacagaaagcgtatccagatctgaaaaaatgctggtccattttgatgtagttccatcatgatgatttatgtactggatctcaactgccatctgattattgatacattgatgaagagcgatgaagcccctgactttactgatacacagcttcctatcaccaaccgtaaaacatgtgatcgcattgtcattggagatcaaattaaagcgacacagatagtattaatattcagtattcccttcgattataattattcgacacaattaagtatttgtattaatatttaaaaagtttgtataaatatatgagaatatacatacttaaaacatctttaaattaaaataaaataagtcacaataaaatattttatattttttaataagacgaatggtacttaattagccgagcaattttaccgtccttgaggaggtaagtggtacctcgtagtacctccttaaggacaataaaattactctaattagaccgttgtaattcatggatacgttactagctagtataaaaagggctacaaattaaattggcttctgttcatcgtccacactggcacgtgcgtatgcttcgagtctatcagcatcgcgtgggatcgatccgcttacatcgtcgcactcgcacgcgcgcaaccgatcgatcgagaggcccccaaccccaagtcgcagccgttactggctactgcgctgccatgcccgtgtccaactgatctagtagctagtgcgtgtgctcgatcgatcactcgatcagtagcacaaattaaccagcaaaactatcggttacacattgacacttatagtgtacattatatctattcacctatatatctgcaattctaaattatctggctgtgtacataaaaagacgtgaatatgagggaaggacataatatcaaataattagaaagagtaaggcttcaaactcagatcgtctagcccaccaccttgtgaagctagccggaagaccccaggtcgtctggctgtgtacatggccagacattgaccgtgtacacgacccgatattttggaattatatatataggcgaatagatatactatacgtatctatgtgtacatgattttgtcgattagtttgatcataaatatttaaacgattgattttggcgatgaagtttaaccattcgtcttattaaaaaaactataaaatattttagtgtgatttattttatttttaaagatgttttaagtatgtatattcttgtatatttatactttttttaaataatacaaataatcaaacttaattgtgtcaaatatttataataggaaggaatacaaagtagtatttctacgtacggtaccgtttgggaatattggcaaacagtaaaattcccaacttcgtgtatataggataagctggctaattaggtccctttgaatcaaaggaattatgaatgaattttataggattgaaattctataggaaattttcctatgtagccctttgattcaaaggattgaagttttccaaatcctacaaaattcctatggaatggcttattgcatatagattttggagaaaacttagcaagaggtctaacctcttgggaaaaatcctttgagtctatctctctcatccgatttctgtgtttttcctgtggtccaatcaaacaatcattcatgtgttttgcaatcatctgttttacacttgcatttctgtcagaatcctatgttttttctattcctctgtttttccattcctacgattcaaaggggttaagcattttagtcgcataaaggtggataaaatgtcaacttaaatttggtcatttttgttcacttatataccaagatttgacatgcatcgtgtgtgcatgcacactatcaagtcaagacgttctggaatttgacctaatcagtcacaattgaaaccaaccgaagctacaactatggtacacgtatctgtctgaccggtgcgaaactttgcgcgtactgaactttcttctataagatttaagtgagttatgtagctttgacaaaatttgttcatcttttcaacccctaattaacatgcatgttttcatggttatttttttttcacataatgaaaaactaaaattatctagaaatgggggcaaacgtgttgcctggagttgaataatcttagcactttggccggtacagttggacttgaataaaattgtcttgccccaagtgaaatcagggagttgaccgatcgaatgatcgatgcaaatgcaaaaatgcttaaggaaaatacatctttgtagcacaggggattttgccatgcaaaatttgaatcttagatttttctttcatgcaaaagttttatgaataataatagaaagagctcctattttatgccattcaatgttatctttgactagcgaaagggcctgtaacctatagtggttacaagagtctcagtagcatctgaggtcctgagttcgactccccatgagagcgaattttccaggatttaacggcgttgtgctttcagtggtagacgacgtacccatcgacagcgatgcgcctgtggtgactttgtcaatctccaggattggggtaggatagcatcataggggtaggatttgcgtgtgtgcgttcatagaggtgagtgcacgtacgttgtaagtgtctgcgttttactgtgtaattaaaaaaaagttatctttgactagttggaacagaagtagatcgaagaaaacattactaggtttcaacaacaaaaaaaagaaaaaaaaatactaccaagaaatcagcatttcggcccatgcccgtagcctgatttgtccttgtttgatgggcctccattctggccagccacgtaatcaggccaagatattaacgtaccgcattaggcctagaatttggacggaataagttcatctgagttcccttaacttcaacatgggcctccattctggccagccacgtaatcaggccaagatattaacgtaccgcattaggcctagaatttggacggaataagttcatctgagttcccttaacttcaaccgaaaaaccagatacaacgggtccctcaactgaaaaaaccagtgtagatgaggcccctctgcggttttgacggcagttttggctgacgtggtgcctacgtggcaaatttgacttggtctttatctgatgtggcatcgacgtggtgctaacgtggcaattcgatccagaaaataataaactttgtgggacccacatgccagcctcacacataaattaatataaaaatggtggggcccacatgtcagctacaaataaaataaagatggcggggcccatgtgggccccacaagtccctcttggctctccatcatcctcgcggcacagcgacggtgaagaagaggagcgggcgccggcaacagcaagccgcgggcggaacggaggggcgggtggagcaacagcagatgcatcctggcagcagacgccaggcggaggtggtcagaggaggaggttgctaacagagcggtggcaagccgcggacgcgcggaggtgaccagaggaggaagaggcagaggaggagatcgccgatgagcgcag

SEQ ID NO: 24322 - DNA, 39806 bp, Oryza sativa
ttgcccagccgccgcgcgcggccttcctcctagcccagctgtcgcgcgccgcctccctcctcgcccggccgccgtgagctacccctcctcgcccgggcgccgcgtgccgcctcggggacaggagagggaagagaggaggaagaagaggggaagagagttgaagaaagcgagatgatgagaatgacatgtggggcccacgtgggccccacaattttttattaatttatgtgtgaaactgacatgtgggtcctacggagtttattgcttttccagatcaaattgccatgtaagcaccacgttaatgccacatcagataaagaccaagtcaaatttaccacatagacgccacgtcaggtaaaaccgtcgttaaaactgccgagggacctcatctacactggttttgacagttgagtgacccgttgtatctgttgaacgaagaaaatcggattcattgacaagttaagggacctcatatgaacttattccaatttggactaatattttggcccacacacacgaatgggccacgattcacgcccacataaatgaggcccatatataataatgggccggaatttggaaccatgcagacgagttcttacagggccaacgtctcatcaacgccaagaaaccaaatcatcattactctaattaacatactcctaattatctttctaatcaattaattaaacgcaaaatcagtagttttctaataattttattattaaaactgtacttttagaatatttcaccttataattcgatagttttacaataaatttactgttataaatatacatttaacagttgagtgataatttaaccaaataattaacatattatttttaaataataaaaataggttatatcttccgactttgtccatggtcacacaaccaacaaatttcacaagaatttaaaatggatgcgatgggtcaaaccctcaactctcaccaataaaatgataaagtgaaataacgttttcaaaatcagagagattctggcacgaaataattatctttctaatcaactattagttaattaattacggagtagtgataatccccggagctcatctccatctcctcttccgcttcctactcctactccgtcgcaatccgccgcctccaaaaagcatccacctgtacccacaaacggaagcaaagattccaactttcgatcgagagcctcgccgtcgattcccccacctcggctgagcccggattccgaggcagcccccccatggcgggagccgagcgaccctactacccgccgcggcccacggacggcggctccggccagcccgccggctgcgactcgccgatgaggtgggacgacgacgacgaagaccacggtggcggcggcggcgatggcatgaccgccgttgcggtgagcaatcccccctctctctctctctctctctctctctctctctctctctctctctctctctccccttacgcggtttcgtcactgtgaagattggttgcgtgtacgcttagttcgtttggttgagttcgttgtgattttaaagcttgtggtttgggcgattggttgggtgattagggcttgctgtgtgattgtgagaatcatggaggaatatggaaaatagaatgctttaatgggtgattgggttaagcgcttaagcgagaagcaagaaaaagaaggtttgggtttttaggattgtatggctgctgctgctcatcgccgtcgccgctttggctgctgggaattatggggcttttctacgattatttcttttaaacatgaacgaatttccatattggtttctgttgtaattttattttccaaatttagggattcaacctgttcgaggaagaatcagatgaccctcctgccaaaaatggcgtggtcgacgatcctgatactaccactacaagtgattgcaacactgatatgagtgaggatcttgtaaagagggaagaagggatgaacttccattgtgatcccccgcttcacgaacatactggcatctgggtgcctgtttctgtcccgccaatgaccaaacgcgatcacgaggagtggcataagggctttggtcataatggtgactactttccagaagacgaatttaactgggagatagatgaagagaacaaggagatgacgatgtgggatgtattttctgagatggttgttgcggcaaaggataaggtaatatcagttgcatcgtatgatcttgggagacgtggtatgtctatgttgtccaagtttttcttccaagaagcttggaaggatatggcccaaacacttgcagatgccaatgctggcattgcgaatgagctcctagagactgaacgaacaatatggttacctgacagcgctgccagcgcctgcatgctctgtaacgtgcgttttcatccgataatgtgctctcgacatcattgtcgtttctgtggtggtgtgttttgtggtggttgttcaaagggtagaagcttgatgccaccgaaatttaatacttcagaacctcaaagggtttgtgatgtttgcggggtacgtctagagagtattcaaccttacttgataaatcggatcagtcgtgcttcacaacctccaactcatgatgtcactgatctgagtacattgaggtcgtggctgaacttcccttacgcacacacaatggaatatgagatctacaaggctgcaaattctttgaatagttactgtaaggtatgcctttttaccctaaattgtttactgttgaatttgtttatcagtgctgttgtaatttttttagacattttcttttgttcttctcttttactgtttgagaaatcatgtgcttatgctttagtcatagcctatcaagacttgtcacctaattctaaggtgctttatcatgtcttaattctcaacagtttatatatgatttactatggacatcactcattaagtaattgatatgttcctttcttgctaatacaataataatatctataagacttgtaacagagtatggtcttccatatttcttgcaaagtaattttcagtttccttaagtatgagttgaatagatgaaaaacctaacccggtgattggataagaattgcatagatatttgctctcagcttttgcacaattacacctgtgtaatctatagtggcatcatatggttgtccacaacatttcagtacgtttatggtcttccctctgttgtataatttgttaatgatatctattattttttaaagacatacctgtgttacattcatccattccccaatctttattataataactctagaccattcaagttacagtaaatgctgccaactaattaaaatgatatctacattagttgttttagtgatatattcaaattagagaatcattttgtctgtcgaatgctggttcgaagtattatacaaactaaaattgggtttccacatcattctagcttctgaaagtgctgattgttcagttagttcagttgttaggagaccaaccagtagcagtgcaatcattttttttttcttccatgtgccattcaggtgggaagactgaaaccagaaaaggctatcccctatactatccttaaacaagcaaaaggccttgctataattactgtagcaaaagtcggtatgatggttgcatataaagttggtactgggctggttattgctcgaagagccgatggttcatggtcacccccttcagcaatcgccacttgtggtattggatatggagctcaggtgacatcttcttttctagtgtcctttatgtgcaaattcttttatcatcacactagcacatcataacaaaatcagataatttccgacttacccatcaggctggaggtgagctagctgatttcattattgtgctgaggaacacagaagctgttaaaactttcagtggaaaggcacatttgtcagtcggtgctggtgtaagtgcttctgttggccatgttggacgagtagctgaggctgattttcgtgccggtgatggtggttatgctgcatgttacacatacagttgtagcaaaggtttgtttcaaatttactccatggcatgcgtcactttggcgtcttctttcatatgttcattttcacctcgctcaacatggaacacatgctttattatatgatacgactgtatattcgtgaataacttcttttggtggtgatggtgatggttgggagaatatgtgtaacaggacagttcatggttacacaaagagtcaaataaacatgtaattctgtcttagaatctcttaaaacaaaacaacagaattggattggggtccttgacccatagtttctcaatatattaaggtaatttaaagggttttgtttgtatccattgcaagttgattatttctcttggatttcaaatggcagacgagtaattctacaaagtttgggaatgtcctcttaaacccaattttagttctgcatactttttataccaacacaccaggacctgttttaaaaggcccatagcttagtaatttgacccttctattattagctttatctttgaatgactaaaatatgtcctagtatatcttatcactggataagtgcacaaattctcggccttcattggcttacatcacgaacttattttgttactgatgagtaggcattatagtaagcttagccattcctactgttttttctcacaaagaaataatgtttaccttgttttttctcacaaggtaaacatttatacgttgaggcaccctgagaacacttgggactctagtctgaacaattaacttgttgacagtcttttaatgtaatattaatatatatatgcacttgtggaattcatattcataggagtgcaaaccatgtcatatgcatattaatttattttcgaggaattgctttttgaatttgaactttttgactaaaataataatgccaactgtgaaccactctagactgctggatgcagttatagtgacaaacctaagtagtattacagtgacactttagttcattcgtgcaatatctgatgtcgaatttttcaattaagtgtagcaggatagtaccatttttcaagaaataaatgttcattgctaactgttaagtacttgtggctagatctggtcattcagaccattcagggttgtcttatgtaacaactgagtctgtatatctgtcttatgttgcaggtgcttttgtgggctgtgctctcaatggtagcttagtatcaacccgagacacagaaaatgcccgattttatggtggtccaataaaggcacccgatatccttatgggatccatggctagaccacccgcagccgctgcgctctacaaggttctgtcagaattgtttgacaatcctgagaagcaatcgctttaggtctctagtatgcgttgcgtcttctggtaaatacattctggaactctctgtcaagtaattggattgcggttttgcgatcttttcacttattcgttggttgcagtttacgcaattgtacagtctgccattcattgacacgccaaaggtttcacatcatggttaccacaaaaccaaatgtaaatacatgtacattggatcccttcttgcttcatcaagatataaaagaaaaaaaatatatactattttccattccccttgatgatctgcatgcatgttcttcagctgcattgatcagcactcctgctgtgaatgacctaggactgtttttttttttttggttgcatgcaacttttttctcagtgtacatgtgaatgtcctcccatcttttctatgatctttgaatttgtgcacctcctccaggggaaaagaggagggtcccccaacctctcttcttgatagaattcacaggcagtatagtcatttttgatggtcctaaagaggacactgaaaaagctggttgtactggctctgtcatcctgttgtgatgttgtgtgttgttgcattccctgggtaattattttgtcctggcaatgcaatagcaaactaaaatgtactactacttcattacattgtttcagctagcctgtaattctgatgcaagaaattcatgcagaattgcactagacctgagaaacaatacttctctagcaaaagataaaacagaaaatgacttcatcaaggtagtggtggtattttttttttgttcatatgatgccattgcacttgacatgatgagttgtgagaaaatactccctccgtcccaatatattaaaacctaggataggatgggatattttctagtactacgaatctggacagaattttctagtactacgaatctggacagattttaatatattgggacggaggtctgtccagattcgtagtactagaaaatgtctcatcatgtcctaggttttaatatattgggacggagggagtgcatgacactgcagctaatgactatgattactgaagcgtgccgcatgttgagcttgtctggcatgcccagagcacacactgcagatgaatggaatctctgtccctgtcactgcaaaatgtatattcctggtcttaacaaacaccaatgtccatccagccctgaagatacagtaatgcggcagtgtccaatcggtgtctgactgaatgtgccgtcctcgatactagtgcccttgaatcattgagatgcataattcacttcagttccagttcagttctaccatgatggaattaagctgaatatacttactagagatgagatgagcaagagaatgatacagtatcctggaaagtgagtagcaatggataaatggataatcaatcagcaacacacagaatacagagcataaaccagcattgatcatgagcaggaagcaaaatgtataaaattattctctgaattctactcccaactgtctgacaacccattaaccatgaacatcctaattcccttcccttgccatgttttccttttcattgtcttctaacaaccgaaaattataggatataagaaagcaaaaaaaaaaatcaaaaagaagctaaacttaaacgacggcctgcatgaatttaaacccagttcagagactcctcataagatgaacttcttctgaacccctctctgatgatgatttctccaattcttgatttcttcgtcttcttcttcttcttgatgagatgaggaagtaagcttagcgatcgccgcgagtcatggagctcccgagggtgagctcgagatcgtcggagccgcactcctcatggatgcgctccccttcccacgccttcaccagcccggtcatcttgccgccctcgccgccgaacgcgaactcgcggcgcgccgcgtcggccatctggacgtcgccgccggcgaccggcgagcacgctccgctcatcaccctcgaggaggaccccgcggcggcggcggcggcgccgaacgggttgggaggaggagccacgaggctgtacgtcggggacgacggcccggcggaggatatctggaacccggcaagccacgccgccgcgtcgttgccgccgccggcggcggcggcggctgcggcgaccttgcggcgcgggctcggcggggtggagtttggcagggacgacgaggccgcgtaggcgtagctcgcgccgacggtggcccacgggggcagcacgctgccggcgtggtggtggtggtactcctcccaggcggccgtcttgaggcgcggcgtgcgcggcggcgagcccgagggcggcgtcaccggcgcgctgatggagccgccgccgaagtaggagtagtgcgccgggaacttggacgacgagccgccgccgatgccgacgccggcggaggagagggtcttgagccacgggatgaggctgctgccctcgccgccgccgccgccgccgagcgtgatctgggaggaggagccggagctggggaaggaggacgtcccgcgcgggctcggctggtacgacgagcacgggctcgccgacggcgagcggccgagctgatcagcgagctctgacgccggcggcttgcatccctgaaacacacagacgaacggttcgacaaattaaaccaaattttttgaagcgaaaatttaaaccaaattggtgaatttgacaatagcaagttaatgacattttgcatagaagaataacaatcagaaaaatttatcatgtacagtttaacaagaattaaaaaaaaaattgtaacattttgcatagaagaataaaaaaaatcagaagatttgatcatgtacagtaaaatatgaatataaaatctgtgtcgttttttaagtaaaaaaaatgtgacattttgtatagaagaacaaaaatcagatgtacagaacaggaataagaaaatcacctcagaacacaatgtgaaaataaagttacaagaaacgtgaatgcaaattcttactgaaattcgctgcctcagaattaaaacttcacaaattatggccagaaatattaacattgctggcacaggagttttcatcaattcaaactataaccatgataataccaaatagtggcaatgcaaacttaactgaaaggtaattaaaatcctcagtgaaacgcacacaaaaaaaaaaacaactactgctctaaaaagccgattgcaataaaagaaagaagatacttgggtagaatttgtcattttgtaatgcaaagttgattttctgaaatcaaaggcttctgtgacagccttagctttctttgatgtaatattcggtcatgcccatatctatctgcctatgaccatgccactaacttttgtctccataattgcctctttcaccagtccttttttcacatgagcagcttcaattctgtccaggctccagtactacatatagatgcatccatagagataatgctaatcttaaaaagagaatttactcaaggtatctagaggcagagcttgcagccaacttagacttactttgacaaaacagggcagatggattctgtaaaggtactagctttgaccaaaaactaacaatctttgattcttgtattaatctacaccttaattcaaaagcgatttgtttggcagtctaaccatgcagttactaacgcgtgcaagccacatcctattttgcatttcttttcaattgaaaacaagtagcacttcagtttttttcggttttcacttgtcagccaacttgtcatccagaagacttcagaaaagaagagatgatctaatccttaatttttttttaaaagaagagcaggcatctaaaaagcaccatagataacaaaaagaaatgcttgaaaacagatagatttgatacattgtattctgcaaacaagatcctgatagcaatgttcagacttcagagctagtactacaaccaaaaagatgctagtactgctcttctgccaagacaaaaataaaataagaacaaaaaaaagaaagaaaacaaagtgatgagctttaagtacagcaccactactactacgacctcttttccctgcctaaaaagacactaaatcttgctaaaaagacccagcgccacagcatcatctctccaccccacagatgaagaagatgaaatcaacaacaatctaaaaccatttttgttcagataacggaagatctttttaataccaaaaacaacaaagaaacaaaaccaaaaaaaaaaaagagaaagaaaacgaacgctttttatccaggaaacggccacggaatgtcgcggcggcacgcgtaatcctgagctcctagtgcgtggcttgtcccacgcacgcaaagaaaagaggagatgagaggagagaatttcccccgccattatcggagtaaaaggaggaagacgaagcagaggagagaaaggagaggagaggagagagcacgcgcgccgcgttgcaggaacgaggaataaaaaaaaaaagccaaaaaggcaatcatggataacgagaaaaattcggtaccctcctctacagccgacgcaaattaagcaagaaatccattccatataagagcaaaagattaaatgaaattcgacgagaaatcgcttaattaatttgcaagaagaagaagaggaagaggaagagggaccttgcggtaggtggtgccgtcgggctcgacggtccagccggcctcgttgcagagcgccttgagcacctcgttgttgtcgcagtgcttcgggagcgtgtagtttccgtacgcccgcagccccgcgtagatcttcgccgcgatcgcccgccgccgccgctcccgccgccggttgttctcccgctccctccacgtcggcaccctccctccccctcctccgttcatcatccctctcacctcacctcaccgccgcgacctacgaggaagccaacggcggtgcgcgctcgccgtcgccgccgctgcaagctcgccgcgcgctctgcagtgtcagcctcgcaggcgcggcgtataaatacgccggagaagcagtaacggccggaggacgcgcaatgaccattctacccctgggtggtcttgcgcgggggagggtaaatgcggcatttcgcgcgggggtggccggtaatgattccgccgcagttaaggcgggggtggccgagaatggaatgcattcgcagtggcttaactagcctatcgccttagtgaacagtggccatttttagcagcagctagctaagctaagctaatccatgcaaaccaagcgtgagcggcgtgggtggtcaggtgacgcgtggtggggccagggtgtcagtgactgtggggggttggtgtgctactggaccagtggtggtcaaacgaccggccggcttgggttttggatatgttcttgggggtgcccttgatgacttgggttttggtatgatgtgtatgatttggtttgatgaggttgggggagaagatggatatagctagtgtggttgctgtcactgttcaatgtgtcaatgataactctacagtaatgattagttaaaagctagcacgagtctagttatggtttgtaacggttttggttttgtgtagcgcatggttatatagccgttaaattattataaatatgtgtatgtggaagtcaataacgagaattgttgtcattgattaactgcctatcgtagttactgtctgcacgattggatagtttaaacgtatctcgtgatatctcctttgacgatttacacgtgacattgattagacgaaggggacgatattaaatttgccacaataaccaccgtaacggttaatctggttgtgtaacggccatggaatgcaattttatcctcataatgactacatgtagtattggatagtttaaattaaacatgtgattccttctttgtcgatttacgcgtgacattgattagacaattagattatgttaatctttaccgtgacaacagtaatggtttgtctagtaacatagaacgtaaaattggacgtgctacgcattaatagagcattgttatctataataattgatctgcacagtcaaaacaaaagatttcaaacggttcaattgggtctagcacatggttacgtaaccatggaactacaactgtacatgcattcaaggtgtaaataaaacattaatatctctagtaatctatctacaacgtaacgcactagatagagctatggattgtaaagcgtccagttagttccatagcacgattgtataactctaggattaccatttacagtgcatataggagttgataaaaattgctataaaaataatcgttaatcaacataactgcagacacaattatatgtacaggtaacacatattatttgttactaattaatttatgtgtgatattgattagacaaacatggttgtgataagatgtaccgcattaatcaaatcggtttgactcggtcattaactatgaaagtgcaaccgtatgaaatcaatataacactataaatctaataactaccatttcctgagaggaactactgctaggcttacctagcctaaaagggctaggtgcagtcagttattaggggctgtttggttttcagggacttattctaagtccctgtcacatcggatgtttggatattaatttagagtattaaacatacactaattacaaaacccattccataagcttggactaattcgcgagacgaatcttttgagtctaattacgccatgattttgacaatgtgatgctacagtaaacttttgataattatggattaattaggcttaaaaaatccgtctcgcggattagctctcatttatgaaattagtttttttattattccatatttaatactctaaattagcgtccaaacatccgatgtgacatgggctaaaaagttttagccccatctaaacacccccttagtctctctggccatgttaaatttgacagggaatacgtatactaattagagtttaatttattatttttattataacttgtagaaattaaatttgaaattgtattttttttcaatgatataggagtattatatattaatatatcttatcaatatttttgaattttattcataattatttagtaacttggatcatggaagttcaccagagaatacaatccatctctatgcaagcaaggtaccgtaccaacagttgctggcagctggcacgtacgtgaagtggactagagatcagcagcaggagataggccgtgccgtgcagtggctcatgactcatgagatcagcatcatgcatgagctagctagcacacggcgtgagcgcggttaaccgcggttggatgtgtgggtttcagttagtacgaacccgggataccggccaactcatgaaccgctgcttactttgtggagaatttttttttcttagtgaataatttgtgtttgtccactgagatgcatgtctcacacaatcttcctcttgatgcttaatttagatggttaataatatggggctcacacaaattaagcactttttaggttatccatcgataagatcgatgccattttgagtcaagatgataaaagcacagttaatagatacctgcataagtatataggtttatctcatggttaaaagtaaaagatttactactcaatagatctccaaatctcagtcgagtattatcatttatttatatacacagctatattaatagcttaaaaaaatactctcacatttaactacgtcatcaaattgggtcagccattagattgaaatgtctaatacacattgaacattagaccgatcaatgtttcttcctaaaagaattcttatacccacgtatcaacacacgaaatatcaactagttcagtggcggatgcaagatttctaagataaagatacaacatcacttaagcatagttaaatactccaaaaaaaataaaaaaagacttgctataagtgaaagtcaagtgataattttgatcccaatgcaaattaatagagaccaattatacaggaaaatttacaaaacaacgtaactaagctagaaaatacgtttaatacccttagaaagaatgattttgggattaagtgtgcttgttttgacacaagtaatggtatatagacatattatacctataaaatcacttattttttacaaaaatttgggatagaaatgtacccatgtcccatgtcccattgtaggtccgctcgtaactagttgttatgacgtggacaatcacgtgcttgtaatggcctgataattgtctttaactaagctccagctagcacccatcaaacagcgatggataagcgatgaggatggcacaacattaaagtaatccaggccatattcaaaagtaaatgaaatttaaataaaaaagcaagatgatcgataaataatactactacatttgttttttaatatatgacgccgttaactttttacatcatgtttaatcattcgtcttattcaaaaattaaataaatatattttgttttgatgtggcttgatttatcactaataaactttaagcactacttatatttttaagatttgcataaaatttttaataagacaaatggccaaatattataacaaaagccaacaacgtcatatatattgaaaaaaaaatgaatcaatcgatatctcaaatatatcaccccgtctaaacggatatcaactagccgataccttaaaaaagtatcatcctgtccaaaagtataccatgttgtagcattttccttattaatttatccatcaattggcgtgtgaaagaattaccgcggaatatgatttcttctccaaacaaaccaaattaaaccaaagttcatgaccgacagaacgaaaatgccagagcaagcaaagcaagcatgcatgccgcattttcaagcagtggcagattgcatatcgtggaagaagggccaagcatgcagcatgacacgtcgttttcttgcctcatccaacggcaacgtacaggccggctgctggtccatatgcgcctctccctcctctcttctgctcatgcatgcacgtacatgcatgcatatgctccatcatcgtttcatactatatccgtgtttcaatgtacgaaactgttgattttttttataatcaatctttaactattaattttatttgaaaattttatacaaatataaaagtatttatgtcatgcttgaaaaatatttaatgataaatcaaaacacaataaaataaataataattacatatttttttaataaaataaatgatcaaaaaccaacgacatctagtattaaaaataggaggatatatctcttcctgtcaagcagggcccacaggtcaggatagctagctagtcctgtcgatcgccacgtcgtcgtcaggcacgcatgctgccggcggccagaaacactgcatatcgatctgcaggagtagcactgcagggcagctagctattcccaccgcttctaaattgtaataacatattcgttttatattataaattatttatatttttctctaaataaaaatttaaaattttattaagtttatagaaaaatttagcaacatttacaacgctaaattaatggacctgttcgactggtattttttacagctacatggctgccagctgcacagcaacaagcagcacggctgcagccacacaacacaaattaccgctgcagcctgcagcagcagcagcgctgctgaacggcagccgaacaggcccaattttgttaaatgtaatattgaatatattttaatattatatttgtttcaggttgaaaatgttattatatttttttttataaatttgattaaacttataaattttaactaatagaaaaatcaaagcgattcattaatacgaaacggagggagtattattctaaatctattaggatatatccttcatccaatttcataaatagaaatcagatatcttatttagtttcgtaaccgaaaatacgcttatatttttgaaagtgaaccgatattcgaaacgatcaatacaaatacgaatatcgatgcctaggatgagaaagaattgagatggcaaaagatagcatcacgaggaggatgatgccaaatacgtaggaaggggtgaccgggtgacctgggggaaagagaccaaagagggagcaatggctaagccagctatatgtggcgcatgcaatgccatttttgtcactttgctccttggatcaggggaaaaagaaaccttcttgtgtcactctgtcagtgcttgcatgccaaattgactattgcattatacaaggatttttacatatgcatcccaggtcggtgagcgtgcatcttttatataatctaaaaagaaactctgtaaaatttacttatttatctctaatcaaatttcacacgattgactgattatttggaagattgttactcatgctctaccagaaccgtgcagcccagtctatccgacaggcaaacacactgactgttgagaatataggcatataatgatttaatatattccataaataaatcatgacattacatatgtatactagcattaacgcatcattaaatctacacatgtaaattaaacagtaaaacatgaacagatcaaatacgcgcaacatgtcgaacacgtaccgaggtagcggaaagaccggttgctcggcaggaactactcgcggttgcgagcgtcgacgaaggcgcgcagcacgcgagcggataggaaggcgagccgtcgcgaacgaacaggaagcagtcgcgcgaagcgcttcccaaaaaccttattgccgccttctcccggtgcaggacgtcgaaggcagaggttccggtgacctgctctcctgatcgccggtgcacactggcgagcgggatggagtagtctacgagcgacggcgcaacacagaggaggaggcaaaccctagattgatttcgcgtgtgttgcgtgaaggcggcgacacggtttatatagagataggtggcttgatcaggacgcccgcacgatctccactctgcgtaaccgagccggataagtcacgcgtaacttatccggactctacgccattttcacgcaccggatttttcggaatgtttccaacaacaaaacaaatccgaattttcctgcaacaaaacaaaactgcaaaaagaggctgcatctgcgcaatggtgaggagccaattttacggaccattcgatgcgtacgtcgtgcacgcgcgccgcctgcccaggcaaggcgaggcgagcgagcgcgcgcgtgttccccctcttctctccaccacacatgcttcaagtggctaggagggcatcctcccttttaaggaggtctccctcttctagaataagcaaggtggtactaaactccacatgcatgccatcccatgaggtgggcttttgtgatttcccaaagaattaatcttcgaatgggccttagcccatctattaattccaacaatcccccaccaaatctcaaaatcccactgagatttgccttttccaatgtactgtttatataccagcggttcgatggagaccgattaaggttgaacatccacctagaactccaagctacactaactcacaacttgaacaatggactacgccttgaattgcaagtcttgtgcaagcaagtttcactcagagtcttatctggtactagaccgtctgtagactacccctcgggtggagcgtataagtcatactcctaggtttttagtaagcttcctagaagattcacccaaaatcttaatagactgcggccaacagtcaagcttacaaaggtgagttctttcaagaatgctctgcaggacaacatcttcgctaattaaagccaacagaactcattaaggcatagccaacctgccttgcagctcacgagagtacatgtatcttcacttagagagggtatagattggtactctcctctagtttactaatggtttgttcttcccaggttctaattcacgagatctccgatcacatagactggattaccaccatagtataactcacatgggtctcaaacccatctccttcgatgcattatctatcacatttcgtgatagtcccttcgtgaagggatctgccaggtttcaagctgtttggatgtaatccaacgttataactccggagtttctcaatttcctaacagacttcaatcgtcttttcacatgtctagacgatttcatattatccttagaactattcactttgacaattaccgtttgattgtcacagttcataaggatagccagcaccggtttttcaacaataggcagatccattaatagatcatgcagccattctgcctcaacagtagcagtatccagtgccgtcagttctgcttccatggttgacctcgtcaaaatagtctgtttgcaagacctccacgaaacagcaccaccacccaatgtgaagacatatccactagtggctttgatctcatccacatcagagatccacttagaatcactatatccctctagtaccgcaggatacccagaatagtgaagtcccaattccatagtacctttcagatagcgcattactcgctcaagcgcacgccagtgatcatctcccggattagaggtaaaccagctcaacttgctcacagcaaaggagatatcaggcctagttgcactagccaggtacatcggcgagccaatgatttgggagtattccagttgattcctagcaattctcttgttcttgcgaagcaacaagctaggattataaggtgttggagaaggcttactatcaatgtagccaaagcaattcaagatcttctccacataatgggactgcaaaagtgtaatctcattctcacctctaattagcttaatgtttaagataacatcaactactcccaaatccttcatatcagaatgatttaacctcatttatcacctcaaggtttgtcccaaatatcagtatgtcatcaacatacaagcacagaataactccctcacccccaccatggcgatagtacacacatttatctgcctcattgactgcaaagcctgcagatgtcaatgttttgtcaaatttctcatgtcattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatatgaagctgctagggaaagtagcacacgaattgtggtcaatctagcaacaggtgagtaagtgtcaaaaaaatcttcgccttcttttttagtatagcccttagcaacaagccgagccttgtacttttcaatagtaccatcaggcctgagcttcttttttgaacacccacttgcaccccacatgtttacacccataggccgctctgtcacctcccaagtcccgttagcgataatggaatccatttcactacggacaacctccttccagtagtctgcatcaggagatgcgtatgcttctgaaattgacttaggagtgtcatccacgaggtacacagtgaaatcgtcaccaaaagacttaaccgtcctttgtcttttgctccttcgaggagcttcactgtcatcctcctcagtgacatgttcatgtgtatgttcagtttgttctggtggtgtgattgaactgagaattatttcagagggttggctagaactactatgtgtatccttcattgggaaaaagctctcaaagaaggtagcatcacgagactccataattgtaccaacatgcatgtcaggtacctcagatttaactattaaaaatctataggcaatgctgtagtgagcatatcccagaaagacacagtccacagtcttaggtccaagtttgcgcttattcgttattgatacgttgactttcgccaagcacccccatgtgcgcaagtaagaaagtgatggttttctcccaatccatatctcatatggtgttttgtccttatttctgttaggaactctgtttaacacatgattcgaggtcaacaatgtctccccccaccatgccttaggtagtcctgcggtgtccaacatggcattcaccaagtcggtcagtgtgcggttcttcctttcagcaatcttattagactcaggagaatagggaggcgtcctctcatgtataatgccatgttcctcacagaataagtcaaactcgtttgagaaaaactctccaccacgatcagacctaagtctttttatctttctgtcaagttgattttcaacttttgccttataaattttaaaatagtctagagcctcgtctttcgttttcaacaagtacacatagcaaaatctagtagcatcatcaatcaacgtcatgaaatatcgttttccacccttcgtcaacaccccattcattttacagagatctgagtgtaagagttctagaggtgccaagtttctctctttagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaaaggaaaagcagaacaggcctccgcactcataacctttaccaataaaatatctatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccctattaggacggtggaaccccatgcgacctgataagaagaaaacaatgagatgtcagcacaaacatgtacattggcccctgtatcaacccaccaattagtagactaattaactgaaaaaacagtaggtaaattaccatacccgcttccatctccagtgttgccaatggtcacattggcagacttagaggtctgccctgcaggtgccttcatccccttgcattgtggacacttcctggccagatggccaggttgaccacacacaaagcaagtcctcttatcctgattaggattgttgttgttgttcttcttcttgaagttggtggtctgctgagctttgtatttccccttgctcttgttctgggccttgtgcacaacattggcagtggactgcccaccatcgcccttagacgcgacatctttttcccgagctttctcctcaacatcaagagacgctatcaacccctcaacggagtattcctgtctcttgtgtttgagtgcagtaccgaaacctctccaagatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagcacgctaggaatgcatcccacaaagagagtagtggcctcatcgaattctttctgctgatcagcattaagaacgcccataggcttgccagtactcacctagaagcatttcatagctgtcaaccatagagtgaccctgatctgccatctcttaaagtgcacaccggtaaatttatccggcctcagtgcattggcaaaaccagccatagtaaactcacagtgcctatcataaggtttttggattgttgagaatataggcatataatgatttaatatattccataaataaatcatgacattacagatgtatactagcattaacgcatcattagatctacacatgtaaactaatcagtaaaacatgaacagatcaaatatgcgtaacatgtcgaacacgtaccgaggtggcggaaagaccggttgctcggcaggaattactcgcggttgcgagcatcaacgaaggcgcgcagcacgcgagcggagatgaaggcaagccgtcgcggacgaacaggaaggaagcagtcgtgcgaagcgcttcccaaaaaccttattgccgccttctcccgatgcaggacgtcgaaggcagaggttccgaagacctgctctcccaatcgccggtgcacgctggcgagtgggatggagtagtctacgagcgatggcgcaacacagaggaggaggcaaaccctagattgatttcgtgtgtgttgcgtgaaggtggcggcacagtttatatagagataggtcgcttgatcagggcgcccgcacgatctccactctgcataaccgagccggataagtcgcgcgtaacttatccggactccacgccgttttcacgcaccggatttttcggaatgtttccaacaataaaacaaatccgaattttcctgcagcaaaacaaaactgcaaaaaggaggctgcatctgcgcaagggtgaggagccaactttgcggaccattcgacgcgtacgtcgtgcgcgccgcctgccctgcccaggcgaggcgagcgagcgcgcgcgtgtgttccccctcttctctccaccacacatacttcaagtggctaggagggcatcctcccttttcaggaggcctccctcttctagaataagcaaggtggtactaaactccacatgcatgccatcccatgaggtgggcttttgtgatttcccaaagaattaatcttcgaatgggccttagcccatctattaattccaacactgacacatagcaccccctacacttttattctcacttcgagtaaaatgattaacttggaagtagtattgagcccatccaacaggtagacccacttatactttcattcgacagacatgttcacttacactttcatcatcatttcgtgtaaatggttaacccaaaagcgatatggttggatggacaacccatcctccagaaccgcaaaccaaccatccgtatagcacctcatttacactttcattctcgcttcgtataaaatggttaatccgaaaatggcatgatttccttaaaaaaaggaagtggtatggttggagggcttataagagattctactcttgctcatataaatcaagggcacacaacgctcatgggtaacataggccacatcctaattgaaccgagatatcactcatcacaaattaggctgtgtttggaaccctgggttcccaacccctcccaatcgtattccgcgcgcgtgcttttcaaactgctaaacggtactttttttgcaaaaaaaaatctataggaaagttgcttaaaaaatcaaattgcatgttgggaacaaattattccgaacacagccttaaaatagatcttatcatgaatttgtcatataatataagaaaatagggttaattacttctttcatataatcacatcttatttaattaattttcatccatccttatctccaaccaccttcactcgttacatattcctcatttaagtatttaacgagagatattatagtatattttttcttgtttacctaaacctcttcaaaaatcctaggacattttatattttgtgatacttattaatttgataagttatgtcaaataaggagattctcactcgtgacgaaaaggaattggaaaattttgctagagggtattgtgacttcgcgtttttagttgtagaacaccacacgaagtgatttttaggggaagacactttggaagcgtggaaattagctcatgggaaccgcaaccattagaatattaatttttgattgaataagagagaaatcatgtgaaaattatgaaattaccactgggcccacatgttaggtttgccatctctctatccctatctctctctcgcacatgaacccacatgctgcctgctgtggaaggagaggagctcttgcacgcctagttcattgcatcgccaagcacacaataacaagcctaccttcatcggcaactagttggaattggtgaaccattggatctgactatctgagtaggtgcagctccactttggtcccgttctgctcgtctaccaccacctgcgcctctggccggtcaccgccccaagctcctccttgcatggcgcctgtgggttgtggtaagagtcgtccttcgcacgcgatcttaggtctccaccacttgtggcgtccctgctttcaagacccattgtcgggagctggatcgtcaccctctgactatcttcatcacagtcgcacacccgggggaatggagcccatcctctccatgactctgcttactcccatgtcggtgcatggtttgggccccccctccctcgctgcttacatgctgcagcgtgaaccgtgtggatgcgccacacccatagagcgcgccgatgccgagtggactatgacagatgatgtcgagtaggagctcatctccttccacgatccaccattcccaaccagcatctagctcgcctcgccgtcgccggtcaccgagaccctctctcacctttgcctcctgcgagagtgagaggaatagaggaagtagatggggaaaaagatagtagaggcttatatgcggattccatgtacgagagagagaaggatagagagatggcaagcctagcatgtgggcccatgggtaattcagaactttcacacggttttttctcctactcaaccaaaaattaatattctaatggtgtagtgtccacgagctaatttttatgtctatatggtgtcttccctcaaaattaactttgtctgatatcctacaggtaaaaccgtgaattcatgatgttgtctagcaaaatttgctaaatgaattactacctttttgctaaaccaatactactagaagataattcccctgtcaggataaccatcggtcatttatcatgtcattctaatcttgtggctattttgctattggttcctcgacatcggcagaaaattatctcacgttagtttaataattttgcttgcagaagatataactttttttgccccagtactatttttcggcttacggattatgaattatatcacaggcatattattttacttaaaaatcataggcatattttactttttaagctcctaaacaataatttctctaaaaaatttctccatcagccctccgaaagaacatttttatataaaattttcagctttccaatattttatttatttatttatttatttgcgcccttaaataattgttatagactagtttcatcccacacccatcgtgggtcgtgcatcaacactttaggatggcggagaatggaaggcatttgcagtggtcatcagctagtcaagatggtcatttaattcaaacaggtacatcaatgccataaaatttctttgttttggcatatctagaacacatggatttcacaaggcaaaattaaaaagattaagataaagggaatcttttgaattcaggcaaaacaagattgaaatatagttaatcttctcaactcaggccaaaaattctcaattcactggtttacctgctcatagcaatcgtggggaaagtaagaaggcattgagtatgtgagttctgatggatacccgtttgatgtgcttcaggattcgtgcagtcgtcacatgggagtgatgtatagaagctctgtttaacaccaaacttcatctgagaaaattattacttcctccttttcacaatgtaagtcattctagcattacccacattcatatagatgttaatgaatccaggcacacatatatatctagattcattaacatcaatatgaatatgaaaaatgctaaaatgacattgtgaaatggaggtagtacaaccaataagtgaaaatgttactttcaaaacaattattttagacaggagagactagccagacagaaatacagaacaatttgggtaataatcaatgagagaagcagcttattaaatggtttgcctggtgtggaaatagccaacaatagtcatcttacaacagacaccattatttatctatagacacatatggacatcagactagtgtaatactacaagaatttcatagaagactacatcaacatatgtacattttatagccgagaagtaatgtttacgcttcgcagcaaatttatctgcatacaacaacacggtagcagtttggagccttgggagttcattccacgtgtcattgtgagctcaatgaatcaataacattagtaagttgatacaagaagttgatagtgggaagggaactcagcttcccagtttgaaggcatccacaaaaaggcccagacatacgccggctttccagtagttcaccattgcaatcaatgactggaatcgtccaggaggtctactcatcggttttctgtacataagcatgccaattccctctatggcagccactacaacaccagccacaagaacatcccagtcaccagtctgccctaggattgttgccaatgcgttggcggtatagaagccaaacagcacaaggaatatcttcgtgggggagttgcttctggcagagttcagcttttcaagtagttccctcccagcagcttggatgagccttcccagccttgttctaccaagaaagccaccatcatcttcgaagtcttggctatcagcattagatggtccacctgtttccaaggcaaatactggcttccatctagaatttttcatctggtaactatagagtgcagatatcaagtcaactaccaaatcttctgcatagtagagatctgaagaaattgattgcatcaatcttttatcttttctcaatctctacaaaccttcagtcatgaagctaactagtaaataattccacaaaggatggacacatcagcaattcatctactcccatccccaaaagaatataaaattggtaacctgactagtcaaatcttcctaagtttgaccgccactacatagaaaacctatttatatttatcatgtgaaaaaagtataactaaactggctcaagaaatattttggcaccgcaatacatttacagttattttgccaacacatatgacattactatacaaattgatggtccaatttatgcacttgataccatatcatgtccgaagtgtcgtatatttttttaacagatggattacttttattgtttctatttttttattgaaaatagtttatgcatataataggtagataccatataaattgaaaaatgggtactatcagtaacaagattgactgtccacaagttcttattatataatgattacctgccaaattcttgtattttgtatgccttgcggcataataacatttctgtttgaagatgctaaacgagatctaggtaggctacattttgcatccatgtcaccttggagagcacaacttgaacccatgcatttcctaacaacgtgcggtgaaacctaattacacttcattgtctattccattcttttgtttgggtgagcccttattgaattccttttaaacagtcaataatccaacctatgtcaactgaaatgtatttcttcaagtgtccagcttatatcaacaaatatatgattcttcaatataatctgactgatagtcagcaaagatgcattgtataaatgattgaactcatcataaacataaaaagatgtactgaaagctagatctacttatcaatggtgccaccgagtagaaatgtgtatgcaaattaattgtagtagggggaaatgctgttcatagatttaaaactttcgtaaaccagctcctccaaaattcctgttgacagaaaactgacccaaagttctggacgagtccaatggaacccaattcccaattgatttttgggattttttttttacagaaatactaggtagagaaattcaatacgctggagaagagaagagaagacagcgagcagcggcgtcgggggctaacctgagcgccgctccgcccgtcgtcgccggccacgagaggctgcaggtccggcggaggagcgcgcggccgcagagaccgccgggtgccggccgaagaggggcgcggggagggagggctccgcgccgcagcggcatgaccggcgggcagcggcgccacggggcctctgtcagtctcaaggcggagctaccgcgacggcgacggcggcggcggcggcggcggggtgaggcgatgcgatgcgaagtagcctgtggttgacagtttcgatggtctagaatcgcgccttctgttccgtacgtggatagttgggccgagaacttgttgggctggagcccaactctccagttgcaaaacgtacctgtgggtcagtggcgagtggcttctctccgtcgctaccccggggacgtcgcggcggtcaagcgccgcgaggcgggcctcgcgggcggcgtcggaggcggtgaggatgcggctcgggtgggcgagcggcgggaccgccagcccggcggcgtccctcagcgcgacgcagtggtgcgccgagctgtgcgtgtagtcggacggccggatcggcgccgacgacgacggacgagcactcgccaccgccgccgctttcttcttcccgtcgccgccgccatcatcctcgtacgcgtcaagccgcaccggccaactccaaatcgacgctcaagctcaagctccgccggccagggcggagagggagagggccccgctggcggcgcgaccggcgggggaggaggaggaggaggggaggggaggcgcgcgggcgggtggcggcggctgaggaggaggcgccagctcggagcgggaggcggcggcggcggcggtggcttggagcgggaggcggcggcgttgtcgagaacgggagcgagagacgcgttcggtcgcgagcgagaccgcgtcaaagggcagagaagatgacgattttgagggagaataagttcaccggagattttttaaagtatcttaaccaaaaaaaccaaatatttactcctaaactctcacaaaccgttcactggaggtccctcggtactatttttgtccggtttttctgacgtggcattctagttagcaaaaaaataagaataaatatgtggggaccacatgtaagtgacataaaaatgttaggtcaacaatcctagtcagcactgatattctaaatcgcttttttctttggcgcacagggggagcaacagcgacacgcatccgaaggcaggcggagcagggacgcggcggttcggcgggcgaggtggcggttcgcgagtgcgactgtgatgagcacggcagcgaagcggcggtggagcggtggtagcgggcgagcagcggcttcgggctcgggaggaacaggcggaggggcggcagcggtggcgcggcagcagctggtgccggccggagagggcggagatgaggccggcgggagagggggtggagcgccgcatcggcggtggtggttgagaggacgggcgcctcctcaccgctgcctccctcgcgggaaccgtccagcgcttgccctcggcgcgccagagcacgtggattccacggcagcgggcgccgcggcagggatcgccaccgctatggcggcgcatgtggtgtgaacacccgtcgacgtcatcagccagagcctcatggtgcaggggaacccgtgcccggcctcccactaccgcggcggcctcgacgtcttccgcaagatcgtggccgccgacggcctgtaccgcggcttcggcatgtccatcttaacatacgccccctccaatgtcgtgtggtaggcgacatactcattgtcgtagaagacgatttgaggaggcgcctatcccctcagcccctcctcctccatcggtgctcccccctcttccgccggcgtgacacgtggaaaggatgggagagggaaaggtggtcgacgggagatgactagatgggggaggggaaaggtggccggctgctgccgtgctcgtcctccgccgctctgcccaccactcgtagaccgttgccgcgctcgctcgccgccagcctcccacattcacgctcgccatcgtcactccgccctcgccggagagaagagagtaaagagaagagaaggtgaagaaaagagaagaaaaaaagatgtgcagctgacatgtgggtcccacttttttaattttattttctaactaagatgccacgtcagcaaaatcggacaaaaatactgccgagggacctccggtgaatggttttgagagtttagggggtccatatttctggttttgtgattaagggacctcaaaaaatctcgttgttaagtggagggacctccggtgaacttattccattttgagggcatgcacgtaatttcacgttggctggagagctcggctccgtgggcttcggtgacgcccactgtgggctgtctgagtagccaaatgtgtaatctggtttgaggccacattggattgtgtagcttgtggcttttgaagttctttaatctatttggagtaaattgaacccacagtacaacaacttggtaggtggatgcgatatagaacaagaacttaagatttgaacgttcgagtacagtaacttgacaattgggtgcgatctagtatataagaacctgatagttcgatattttggtgcatcaacttggctaagcatatgctagatgagttgtttcacgatgtcaatatgctattagacagtaatcctacagatattaccttaaatattgaatttaatctttaagaattatattacatatatagtttacatccaattatctttaagatttttttttgttttcttcatcttctcaaatattaactgaaatataataatttttacatccagtttaattgactttcagttatgggttattaggataaaaatataaatatgcttatacaaatccatgctagtatattgtcaaaataattacttaaaaatgaatctatataaaaaatttctccaaataattaagttgtcgcataatttcttagtttactgtatcaaaatcgtacctatcttaaaagtttttacatttatataatcatttataaagttcttatactaaattgcacctacctattaagttgttatactagaactctcatttctcaagtagttcttataccaaattacacccacctaccaagttgatgcaccgtggatgcaatttactcatctatttggcaccctagtctgaacagatatagtggcgcattggtgtggtaggtggagagtggtgtgtttctatttctttaatgcccttgcaaattccctaatggtcccaacaagtcaccgaaattcaacgcgcgcgaaatgccaaaaaatattggtgctctgtctcatttcttcgcacaccattacaattttattttacagaacctttcctatgaccccaaatttttacactaacgggtacgttcacgtcaggaaaactcatattactgacggtatctcatccacgtcaaggaaaattccaattgttccgacggttttaaaggatcgtcacacaaattattttttctctgacagggttttggactatttgccactctcccgaatggcgtgttctcaaatgccactctcccggatgacttcgctattttgccaccggagatagaagatttcttgcctgtgtgccatttttgagcctgcaaggcaccacgtcactcgatatgaggacaaaataattgtcttaccctttttcttcatttctcctcctgtcattgggctccggtgagctccccgcctcgcactcctccctccttcgctctgctccttaccttcccggcccctactccattccactgcggccaacaccggcccctgtcttttcttttgtggcctcatcggggcctcaccccatcaccgtagagttcgcattcctcctcacagctcttttacactctcccccgatgtcgacgggtgcgccaggtccaccctcagggcttcccctaccttgtcattctccacccagcgccaggaggtcggttcggcggtggtggtggcggtgtcaccggctcacatacaggtaggaaggttggagaagagagacccgagctagaggaagaagaagggcaagacagttattttgcctttggatcgggtgacgtggcgctttgtaggctcaaaaatggcacacgagcaagaaatcttctctctccgatggcaaaatagcgaggacatccgggagagtagcatttaagaacacgccatctgggagaatggcaaatagtctaaaaccccttctctgactggtggttgcatgcatgtcactgagtcagtaaaattagcgaccgtcaggggtattctaatttctgatagtgtaatagaattaaacattctgtgagtgtatgatttaaaaaataataatttaggagagaagagatgttaattaattgtcatgcatgtatttatgttttatattatgaaacacctttaaaaagcatgtgtcctatattttggaatggaggagtactactacatgcaagcgaagatcctacaattcaagcaaagcagtccactaaatcgccgctcgctgtaattgcgtaactaatgatgccgtcaaacaatacatgtacgcacttgattctacaagaactcagaagaaggctgcactacttgcagtttgcagccatctcccggctagagcgggcctggaagacgacggtgggctcgccgaggtcgtcgtcctgaagctccccatccacgtgtcatcgtcgtcgatcgtcgccgtctgtggcgtacgtcgagcaggttcaggggtttcctccgtggcggcgtcgatcaagtataacatgggacactttctcgtcagcccgagcttctgaatgggtcttggattattatttaaaaccaccatgtgtgacacctcatttgtgcttttttttaaaaaaaaaagaaaaaagaaaacagcatcgatgatataattaagtacagactttacaaataagtgcacaaataaagcgaaagggcatatagtatagtggttgcagttatctgagtagcaccccaacgttctaagttcaaatcattatatgagtgaattgtctcaatttaaaatgggaaaaagtacgaattaccccctgaactattgtggttgattgaattaccccctaaattcgaataccaaatatttctcaccctaaacttttaaaactggacgaattacctccctactccaaaccataacggttttggtcctacgtggcatccatgtggcgctaacgtggcaatctaattagaaaaaaattaaaaataacataggccccacatgtcatatggagtagtgcactagtgctaaattgctaatctctctctctctttcttccctctagggtcgcgggtgcgacgtgatggggcgaaaccagacgctgtggtggggacgacggggatggcaggagccgaggaggagctgtgctcgccggcggagaccaaggaggagctgcgtgccggcggatgcggatgaggaacaacgcgtgccggcggaatcgaggaggactcgtcgcggtagaccactcccacttcttccaatgccttcctcggcgccgctcgttgcccgccgcgcaatcctggtgatgccacagcccaccactatcctcgctgcctgtgatatcagagagatgagagagagagagagagatgttgtagccctccccgcgacgcaccacccgccgcctccagcgtcctcctcggcaccacccaccgcccaccgcctccactatcctcctcgacgcggcctaccggccactgctccttccccgttacgcgacaagcttcagcggcggcgtagtaggattttgcgcgaaggcggcaacgagcccgcctcggtctcgagctccctttgcgacagcgggacgtggagcgaggcggcggcggcggcgggatcctccttccctcggtcgcccgagcgacctccgcctccgccgctagcaactgcccccgccctcgcctgctgccattcttggtgtcgtcgtgtgctggtgagctggtgaggagaggagggagaagatagagtggggggaaagattgggatagagatagggtagagagacatagagaggagacgagaactgacaggtggggtccaccgattttttattaaacgaattgctgactggacttccacgtaggaccaaaaccatcgcagattgagctagggggttatttgtccagtttgcatagttgggggtgaaggatgtctgattttgcagttcggggagtaattcactcgaccgtgatagttcggggggtaattcgtactttttcctttaaaatggctgcatacattcagttacatgtgccggttttatttagcaagcacaaaatggatgacccgagtgcacggtgtaggggaaaacatcttctgagtgatcttaactaggggtgggcgttcggtctaaccaaaaatttcggtatcggtcttcggtttttcggtcatttcggtttttgaaaagtcaggaccgaatttcatccaaaaaaatcaggaccgataaatttggtctcggttttttcggtctcggtctcagtctgaccgaatttggaggagccgtgtaacatcctcaaattttaacctaaaatttgactgcatcatgctggcttttgattaaattagtgtgttttaaaaatctatttgattcttaattggttcaagtattacttctttagaaccctactaatttactctaattattccctttactccaaaccttagtgaatttgagcaaattctctcaaatttcaaactatagattattttcttagcttaccctaatattagtgaggatttgctacacttcaaaccctagtgaaaccctttcaaacttatagtttaaattcattctttcctagggaaatattcaaaaattcctaaatttcactgttcatcgcacacaaggtgctcgatgaaatgcccagcttagctagagcagcccaaccaccacccaatcttgtgcaaagtctagaattgatcctaggggaccacaccccactcaaaaaccgtggatttctttgcttcttcctccccttcacacgcgccgcgcgggcatccgacttagccgcgcgccgtgtcgccacgcgtcggcctcgggaccgcttgcgcgtgcccgaccgccttggcgcgccgtcgcccgtccgacgccctcagaccgccgccgccgcaccaatcttgacgacgacaaagccgggatgactaccgccgcaagaaatcgtcgctcgacgccgtgcgctccaatccaagccgctgtcgagtgcgatttcgcttctacccgggatgaatcgcgccaattctttccacacggttggattgaagatagacggtggtatcccctctcacaattcaaaccattcacccccgagtcggccgttttcaccctcgccgccaccgcgcgtcgtgcccggattggcgccaacacgtcgccagccgatttcacacgcggtcaagccaatccttcgctggtaagtattcaaacgtggcctcctgccactcaaagtgatcttggccgccctctcgcagcctctgctgccccagccatatccaatctttgagctcatccatggcgatgacggtgttcgagctcatccgctcctcctagccctataaataggaccccaatcccttccttgtccatcatcgatcatcaacaaccataaccccacaaccccgaagctctgcttcaccaatccatctcatcaaccaccatcgcccgtcggtcgaacaccttgtgcgcgatcgactccacacccctccatccatcctccgccctaaatacctcttagaacaccttatatcaactatgttctagtatattagaccctaaccgaagccctgcatcgagttttacctcgccgcaccaagccgagcaccgccgcccccgcgctgctctattcttcgccgccgagaagtttttccgaccgtaatccttcatctcggcatatctcggtgagttcttccgtttcaaccatctatgtactccctagattccattttagcaatccctttgcactaccatgccaccctctgggctgccgacgtgagcacggccaaggcctatggaggcgctcgtcggcaagtattctccgcgccttgccaaagattgacaagctatcagaatctatctaggtacctcgtagatgctctagaacccctcccctagccatgtctaactcatatcacctcgatcactattacggcctaactgtaccaccgccgccctagtcgctagcctatccatacatcaaattaacccctccgccgccgctcgccatcgccggagaaccccagctccctcccctccttggctgcaacccctttccccctccatcgccgccgtaatcgctaaccctagcgccgccggcccgatttggggaacggccggaggtagaagaagagaagagagagagactaacaggtgggacccgcacatagtaacatttcacttttagttgattttcaaactttagaagcccatatcttttaaaatatatatccaattccagtgaaacttggaccaatattcttctaaaatcattctctatcttttgagcccctttttgctatttttacattttattttattttctctatttttcttatttttggatttaatttgaatttcttttgaatttgaattttatatgtctaaccctaggtcttgaggattcttctgactcaatagataatatcaatcaatctcaggacaacgagcaagggaagttaccatataccttttgatcatttaagcctatattttacaaattatttatttatagccttatatccaatattctattttctatgcataaatcaatcatagaaacccagataatttagtattgcttactttgcttacaatctggttaaaataccttatacttagattgggagagtaagtaagatttggttgatttccgggtggctagtactgtctcgatcgatataagttttaccaggtacttatgtcgaacgaacgggtacgaccgcagtttctagaatagggacatacctagttattatgttaattagcaatatggcacctctgtatagtggttcttatttttaagtcctcacacaggaggcaactatagccgcgaagggcaactttaaccattaccatgtacaggtaaatggtttgtgatagtcgactataaactatatggtatatttctaaaccctgatcgagatgacgtggtgtcatatgatcagttccccttaaatacctcgggaatgccagaactcctcttgctgctgttaacaacacatttagagcatatgaggatatgagttcatggaacaggtgccacaattgttaatgacttaatattgggccatgactaaagccgatgattatcagcaagtcgtggactgcgggtaaagcgtacatctgctgcagtagaatatctttgaaactattcgaatagccgtactcatggagttgagtaccgggactcatatggtaccctggttagaaatctaaagtctatatgttttataaattctaactataactttcctagattgtttattactgctttttgcaaagaaccctactatatactaatgcataacatatttccatgataacttactgagtgttgcgaatactcatccttgctcttataacccctttttcagatctgggtcaagagaaggacccttatgactattactatgatgaccctgataacttagagaatccctaaaggtcatatctccctagtcagaatgtatagaaacttctgctgtgtattaattagttaggtgagtacctattattataaaacccttagtattgtaaaactttaacgtatgcaatgaagaaccagttatactgtatatatcaatatttactgatctagggattgatacattaattctagtcagatccaagtttttagtttcgggctccgacaagccaaggcagggccagctgtaggtggcacacgctgtcgacgccgatacggtggtggtcggtgggagtacggtcgtggtggaggcggaggatggatccggcggccggcgaggcagcgtggaggcggagggcggagacggcgccggcgatgtggaggcggaggtggcggcgcggcgcgatggatccggcagccgctggcccggtgcgaccggagaggcggcgcggaggcggagggtggagacggcaccggcgatgtggaggcggagggcggaggcggaggcggcggcggcggcgtgggatggatggggatgcggagggctgagggcggtggcagcggaagcgtggcgcgatggaggcggtggcggaggcggaggcggtgcggccgcgcgggatggaaacgagggcagcgcgatggggatgcggagccggagggtagcgcgatgggatggatggggatgcggcctgcgggtggcctctagggtttagtgatgtattgggcttattgggcctcctagacctattgggacacaattcggtttctcggttaattcggttaactgatcccaataaccgaattacccgaacaaatttcggtctttgacaggctgagaccgaattactaactgaatttctcggtctcggtcttattctgcccacccctaatcttaaccacctactctctccatccctaaatataagattttgattggatatgacatatcataatacaacgaatttggatatactccctccgtttcacaatgtaagtcattctagcatttcccatattcatattgatgttaatgaatttagacatatatatctatttagattggaaaatgctagaataacttaccttgtgaaacggagaaagtactaccgtccgtaaatataagggattttggttggatgtgacacattctagtacatgtgtcatatctaacatgtattaatctaacatgtattaaatctaaccaaaattctttatatttagggagagagagagtaatctttttatctctcaaacattctgtttgctctttccccagctctctcaaggcccagccggcggaaattcacgttgctcctggtgcattggacaactagttttagaactgtaccgcactaaaattttctccctcgaaaaaaaatatattcacgttgtttttctgtaccttctacacgactcacgaaacagatcggccggagaacaagccgatgcaagtaggggtgggcacaaaaataccgaaccgaaagaccgaactgaaaatatcgagaccaaaaccgaaaaaaccgataccgagaaattcggtcatcaattcggtcttaggtagtgaaagaccgaattttgttcggtcaattcggttagtctcctcgggtaaccgaatagaccgaattatcaaaaatgtctaaatgcaacctataatccagtatgtttaataggattaaactctaattttcacatccctacttcttcttggcatgcaacctaataggagtctttactcatgagtgcttacgaattttttttgtgatttttgtgttgaaaaattccattatttctttgcatatatgaaaacgttgttgaatttcggtcaggaccgagaccgagaccgaatttgttgatcctgacatttttcgctgaaattcggtcttcacttttcaaagaccgaaaagaccaaagaccgagatcgaaattttcgattggaccgaattcccacccctggatgcaacgaagcagtgctactcaaagtaaacagtccgatcgatcatcaatcatgccagaaatttaagaattcaacccagcgtttcaggccgaatataatccaaaattttcaaatcaaccatctactactccgtcataaaaaaatacaaactctagctacgaatctgaaaatacgtgtctaggttattaattaggattagactttttttttgagacggatagagtacatatgcaagcaaatactctctttgaccttaaatatttaacgccgttgatttttttaaatatgtttaaccgttcgtcttatttaaaaatttaagtaattattaattcttttcatatcatttaatgcattgttaaatatacttttatttatacatagagttttatatattttacaaaagtttttaataagacgaacggtcaaatctataactaatataaatattcggatttttccggtcgtcacctcatccatacggtgatttttcgtccctcccccccaaaaaaaaaaacctagccggaatttcatcatcacacaagtagaatcccacattgagcacaccttctctccaatctcaaatcatcacaatccaaatccaaatcaaaagctaaatcccagtccaaatataaatcgaaatcattagaaaacatcatattaacacgagatgactaggagagggaggggcgagccggaccggaggctgcagcgcgttgctgctcgccacctcgccgtcggccacggacccacccgccaacgccgccgacaccgccatcgccgccggatcaggggcaggagggaggcgaaaggggagaagggagccgccgccggccagcgaccgccaccacctccggatccaccggcggctaccacagccgctgccgccaccactcgggatctgccgagagagtggtgcggcggccaccgctcaacgaggagagaaggagccggcggtggggagagggagcggcgcca

SEQ ID NO: 24323 - DNA, 3749 bp, Oryza sativa
aaggtttatttgggttaggggttttgatagatttggagtcgatctgagccgtccatcaaaacgaacggcttagatcgctcccgcgtcggaccggcctccatcatcgggctgcatcagtgatgggctgcacgcacttcatgggccgcacttaggtcggccgacccaacaaaaacttaaattagatttccaattaaataattgttaaataatgtttgtattattaaaattagcaattaagctctgaaaattccaataaaatttcaaagagcgaaactaatcatggagaatttaataaaattaaatttaaccatatcattttatttaattatatacatacctacttaaaaataccaaatattttagtgaatttatattttaattaattgcatattcttctgctgtacgcttcccgttgcaacgcacaggtgcttttgctaaaccaaacaacacttttggtcaatatacacactccgtaatcacccggtgcaacgcacgggcacttttgctagtatatttaaaaagattaacagtatcaactatttaggaacggagggagtatatattttacattcatcgagcaaagctactcgatcaatcagccattcagccatcgtgaggtcaatcgaataatcccattaaacaatctacatgcatgtatgtactcaagattcttcataaatttcagaaggtttcgtccgtgccgtcagtcatgtccacctgttcttgccgttgcagttgctcctcgtctacgtcgtcgccggcgagcacggcggcggcctcgtacgagtcctcctccggtggcacgtgctctcctccggagccctgcgccgccgcttcttgctcttcctggcgcgtgctgccgtctgcctcgccgaacaagcggtacaacacgcgctgatgctccggtgaaagctggttgccgtcgtggaagtccgctgccgccatgtcatcttgttggtgctcctcctcgtcgtatgcgccgccgtactcgccgtccatgtaatagtagctgtcgtagtacgtgtcatccgcagcaatctgctctccggagatctcttgcgccgccggcgtgtcgtcgtcgtgcgtgtagctctgatcatctgcatctgcctcgccggagaagtgccggggaaagagctccaacaaaaccggtcgtcctcgtccggcgccaccttcttccgccgccgcagagtccgcgtcgtccttgcctgcgtactcctcggtcgccatgagtatcgactctgcgtgctcctcccgtcctccgcgacatcgtcgtcgtagcatcgccccggcgcgccgcgagcgtcgccgacgtcgacgtcgtcctcttcggaagcacggaggcgcttccggcatcgcacctcgccggggtccaagaacatgaacaacgagtgatcttgctccagatcaccgtcgagttcgcggccgtcggcctcggggttcgatccagggaaggatgcctctgcatcgccatccagaccaccgtcgaggtcggcggcggcgttcggttctgggaagtagggtggctgaggcagaggctcgccgtggagatggacgatgtggtcgtcgtcttcggcggggggatcggcgttgaggtcgcgcaaggacggcggagctggatccagtggccaagctagagagaaataagggggtgcactacatcatcacatataaatgacaatgtacagaattttcaagcaatattatactagttaatatatttttcaatagtctcattagcatagcataagtggcgatggtacaccgacaaaggaacactgacaaaaagaacgtaccataccgagatgaataaaaccactaatatttggaaatacaccacctgtcctcaatatcttgcaacaaaggataatataaacatattaagtttccattgtaaactatagaaaaaccatgtgaaaacaaacaaattaccttttcataaatcataaattatatttgggctctgtcatgttcataaaacgatgaaccacagcttcgttggtgactttcttcatttcttctttttctatatagcaaataaggctatgactcaagtagtcatcaccgatgcgattacgcaaagaacttttcacaatcttcatagctgaaaaacacctctcaaccgtcgcagtggcaacaggcaatactagaactagcttcaaaagtcaataaactaaaggatagcaaagatgtttccttgtctctaccaacttttgtgaaagctcaccaatagtttgtatgttggagaatctatcatcttctcgcacatcagcggtgtagagacaaagatgatgcctaagatctcttaattccccagaattaaaatcattaggataaagttttgctagtctcatcaagttctcaacattaaaatcatggaatgattctcttgggctaaaggcagctgagcaaagaagcaattcagatgatgtctcattgaaacgactatcaagctcttgaagtagccaatcaataacatcattaaaacaatccacttcataatggtgttggtttgtaattcctgtcttttgcctctgtttctttggattgacatatgcttctcccatctcaagcttgatgatatcatatttgtcacaaaaagcatacacatcaccaagtaaattttcccacccatctcttctcaaatcatccaaatggcacctagttgatttgacacacttaacagcattcacaatatcttgatctttcctttgcaacgctaatgacagggtgttagtgataattaatatagttgacataagatgcaaatagaagacaaactcaaaagattggaaatacactagaagaccatttgcttgatctctatttgttctatctttgtcatctttttccacaaattctagcactttgactattgttgggaacatgtcaagcaaacttttgagagttttgtagtgagaactccaacgagtatctcctggtctttgaaggcattgctcttgatttaacccagttccagtttgaagcatcccacaacctaatgccttgcatatttgttcataatttatttctctaatcatgtctcttctcttagatgatccacccaccacattcaacaaagtagatatcatagtaaagaaattactaatgcctttatgtttttctcacaatggctacaacaactaattgaagttggtgagcaaaacagtgaacataataagctgaactactttccctcatgatcaatgattttaatccattgaactcacctcgcatattgctagcaccgtcatatccttggcctctaacttgcttcaaactgagcttaaagcctgcaaatagagaatcaatcgcagccttgagataggaagaagttgtttccttcacatgaacaacctcaataaatctctctttcacaaatccacacttatcaacatatctcaacaccactgccatttgttccttgtaggacacatctctagactcatcaactagcaaacaaaacacatcatgcccaagttcttccatgatagaatgtaatatttccttcgcaaaacactcaacaatgtccttctgaatatcagaagatgtcataagactattccctgctccatatttacccactgccttccctaaagcatgatcatgctctaatagcatatcatgaaactccaagaagttccctttgttgtaggaatccttggactcatcatagcctcggaaaggtaatccttgcttcaataaccttctagcaacactaattgaaccatttaaacgagtaaaataag

SEQ ID NO: 24324 - DNA, 8491 bp, Oryza sativa
ttcggttctgggaagtaggtgctgagcagagctcccggtgaagatggacgatgtggtcgtcgtcttcggcggggggatcggcgttgaggtcacgcaaggacggcggagctggatgcctggatccatggcgcggcgcgagttgttgatcgagcacctgcgcgcaggtggatgcaggggcgagaggttggaggaggtgggacgacagaaattcaaatatataggtgcgccatatgggcttcttcctcgtgtcggagtcggagtcggagtccgtattccatggggtcattgaactatttggcatttaactatttgccacccctatctcaatgacatgtgggtctacatgtatctatgacatgtgggtccaatggcaaatcgttaattaccacatctaaaagtgacaaatagttaaatatctcgtattaatatcatggcgagttgttgatcgattgagcatgagagggtgggtggggctaacgcgcgggtgatcgcatcgcatctccgtgtcccccgggccccggctatgtgggtagattgattttgaaaataaagttgggaatatatttttttaaaaaaaactacaaataagggaaaattaattctttctaaaaatatacattattcgtataaattttacccatataaaaaatatatatgcagaatcttctgatatagctccattctgaatatataacatttgaatccgaatcagaattcaaatttaaattgggcatataaatttttagagcataaacttttggtatataaatttaggagtactcttgacaggctataccgtcgagtatggggatagttggtggtaaggtatggacgagattgtggtaaaagagacgacggaagatcgtgatttttatacacgttcaagccctctaattacaggttttctgtctataaatgtcttaccaaatccatatttttggattatatttttctaaaactagaatgcccctttcatatttatgtgccaacttattgagaaacacagttctcatgtgaaaaattcattcataaaaaactaaatagaatcatttggaaaaaaataaaaactaaaattttaaaaaaatttcaaatcatttttttgaattcatacaacattttcaccaaaattcgagaacaggtaaaaataattttagttttaaaattctcagtgaaacttttgtatgaattttatcaatttttaaaatttgttaaaatatttttttcttttcaaatttgtggtcaaataatattttcctttgattttattataactaaaaatttcacattcagatatactccaccgtttcatattatataatgttttgacttttttatagcaaacttcattgagtttaaccatatttatagaaaacataataatatatataatatcaaattaatttttatacattgaatattatttctctaaaaataatgatatgttttttataagtttgaccaaaattaaagaagtttgacttataaaaagataaacatcttacattaatataaaacggatggggtgtattcttaagtaggtagcgcataagaaattcagaataggagaagaacaatatagttattttaaaattttgtagcagtcaacaactgatggaaagaaattcaaaggcatatagccaccggacaaaactttatttttaactaggaagatagcccgcgcattcgcgcgggcatgtgcattagtttgttccgaaaatagttctaaaaaataaaaaattaaagtaatgtattttctactgttaattgattatttattatatctctttttcgtgaagaaatctcgacaaactttcattggtttgaaatatatttttttaccattctgctagccctctctttaattgcttcatatacatgcaatttttatgcatgtgaatcaataaagatagaaaatttcttttaaaaaatatttattgtattttgaatttagtgattgagggattcttaattcgactttgtattcaaatcaaattactttattctaaattgtctttttagggattttaaattgcacttaatctcgtatcgtgggggcttttaactatttgccattcttacgagtggtgcttaacgatttgccattaggcccacatgtcatagacacatgagggcccacatgtcattgacagggtatggcaaatcgttaattgccatgtcacaagagtggcaaatagttaaatttccccgtatcgtgctgtatttgatctcttcttttaatacttattttattattccaaattttagatatttataacttatacttttatagtgactcttgatattttatattctacatggaatcttgttatatttttttatagttttagtgtttttttaatttttgtttgtgtattttaatcaaattgtttgttttatatttttgttctgaatttaattacaaactccttgtggtgatccgcctgtcaccatcagcctcgcggatcattgttgacctcctcatcagtgagcctctcttgatacattagacaggacgtggcggggctcggtggcaaagatgaagctattttctagtccttgtcgaagacatggaacgtctccctctgcccctcccccccccctcctcttagtccttgcccttcatctaatcatttagtgcgttattaggtccaggaacttgtagaagtcgatgatgccgctaccgtcagtatccacctcgctaataatgtcttgtagctccgccttcatcgggttcatgcccagagtttgcattctggttccaagcttcttggtggtgattgaacttggatttagacccacacatttgaattcattcatcattttcgaagtgctattttgctcaaatatttgtagtcagaatagcagcattatctaacttctatatagtaaatatgggcaatatggatcttgaatttaattataaataatacaaaaagtcaaataaactgtgaaaagtacatgtaacttgagagtcatgatcatttagctattattatttttctatatattatgtgttaggtagaaaataggataagttatattaaaaataggatatgagaattggatcctagagatgagtaggacggtggaggtacgtacgtacatgcatgctcacatacggtaggggtggaggtgggggtaccggatttatttttgtgagatgtagcagttataattattggatctacctatttaaaggaaaatcaatggtttgatttttttatcataatttctaggaacttttaatttatttgagcactatatggtgtcttatgagtggttttagaaaaccatgtgacagtttaagaggatctgtagggagtttaatgattttttagtatataatagatagttaatatagcattttttggttctttatgtactgaactgctcactagaaaatatggataagaaagtgagcaggagagataataggagatcatttacgatggcatgatatatgttactatttagttgcgataaaggggtttatgtcaaatgatatgtttcttatatatgtacataccaaaatatggtaaacatagttcaaattaaaatcgaatatattataagatattctaattatttagttgttgtgttttttatatataaaattttgctaccataaatggaatgaagaagagaggggcggggagacatacgtactttggatgtaggtacatgttaggagatgagggacctagggagaggtgtggacgtacgtgacatttgtttttttacatatatagatctaatggtgtgtaaagagaaaataaatggtacgatgttttctttttttttctggaatttcttagatttctctaatttatcagagcgtcacgtggcggctcagaagcgtttgtaggagccacatggtggcttaagagtgtttttaaaaagtttaatggacttactcgtacgatgtctatttgtagggatttttttcataaggatagaaaaagaagaaagaaacaaagataaaaaaaaaagaagggaagatagggagcgtacaatacgcatcctgcacggaggtagggacggcaggagtttttttttccgttaaagataatctaatgatccaaaataatgagcccatctatttaagtgaaaatcgatggtcagatttctctattttattagaatgccacgcggcgactcgggagtatttttaggatgccacgtggcggtttgagagtgtttgtaggaagtttaatggtcttttagtatataatagatagataccaacgagacaaaactcaaagatatgaataaaatagatagagtgaaactcatgaacatatgaccaatatatgacaaacattcctagtctcctagccaataacttgtcaacatcttttggtactgttcaacaggcatgtttcgttttcgtgtatggagaaatctagccgcgtcgtggcaccaaagctatctatcatgcatggttattgtgccatggttgccagcatgcaattgcatagtacataacttgcctttgctcctcaacctccggctcaatgcttgctttccctttcttcttacctatcctaagttcgtcagcaaatctaatcttctttcactctaagcaactgaacagcgcttttactttttctgataaatatatttaattttgataacatttaatttctcttaatctagagacggtacagtacagaaacacacaacacatatatacgtgtatataaagtacatccacgcaaaagaagaaaagcaagaaaaaaaaaccacaaaatatatacatgtgagcacgtactccattgatctcttttttagatcttttacataaacacttgaatagtatacgtacttgacatcatgcaaccaaacgtatatttatacgagtacacgtacacaggacacacggatatatactgattaagacatgtaattaatcgattaattaattcttaattcataccaagcgtccattgcccattattgcaagcttaccctgctcacggaagatgaacagatgatgatgatctaggccagctacggcgcgccgccgcccaccgtcgccgtcttcttctccttctccggcgcgtccgcgtctacggcgacgtgcccccggctgctcggcccggacggcgggatgcgccatgaccgccagtcgaggtcgtcgtcgccgtcatccccgccgccgccgccgccgccgtgctccttcctccccggccgatggcgaagcacgcggcgccacggcacctccgccgccgccgacgccatggcatgccggcgctgatcatctgctgctccttcctctgcgctcgcctgcaggaaggctaggccggcggcggccatggccgccatggccagaatgagagctaagagcttcttcgagctcatcatcgcttgcatattggagtagtatatattaatataggcaataaatatattcacactactaaactatagctagttaactatatgaaatatgatcgatcttaagtttatatttgaccctagaggttttcaaatgtggcgatagattgcattgatcgagaaatgggggcatatatatatacacacacacactgacacacaaaagaagagagcaataaaaatgcaattaggagagagagagagatgtttaattggtacgtgaaggcagagctaatatgtgtgtgtgctggtagttagaaggtaataattaaattgctggtgaatcaagggaagaagaaattaaagagagaggagtggttacacgtggttccttgctttcggtcaataaagcgatgagtttcttgcaagttggcatgtacatacatataaaacatacgcatgcatgcatatatatgacatagatcgatccggccggtcgatcgatcatttcgtctctttcgcatcgtatcttggaattatgttagcttgtttaattccttctctatgtggaggaagccacttttgatttgatactgttctctagctagcgagaaaataattggaaaaaaattggaaatagagccgatttgtgcaccgcgcaattaagaaaaaagaaatagcgaatgactctttgttgatcttcatacaattggtatcaaaagaacaagttttttttaattacacgacagacttacacgcacacacgccactacacgtgcaacaccattttcacaccctcgcgaatgcgtcccctagcacatgctctaagcgatggaaaccagcggcacatactgatctcactaaagttctgttgaaaaccaacttgcatatgcgtaatttttgtgagcaccaggatttgaaccatagtgggtagagttacgcacccacgactctaccaccacaccactggtgcttccccagaagaacaagtaatttattcgtgagagtggtagcatttatttggcaatgaacaaattaaatgtgcaaaatatccaaaagaataaatttatctttccttgccatgcacgaatcttagcgtggatagcatggccagagtgaaccttagacaacatccgacgactaaaaaattgcacgattttagcaattgaatttctgtcaaggtaacaattctgtggatttagttgttgtcccagtggtacaaaggcatatgtttgttttccccgtgtgtgtgcatggggagaaattcgaacgagaccctttttccccctaaatggaaatagtgataattcgaacaaattaaccttgcttctctgctactgtaacatgtacaatattcaacgcacgtgaagagaagtaaattagtcggtgctctttaaactcgttgtgaagattatggataccccatacccacatgacatgtatatctgactgggtataggggtactatatgtagatagaatatctttaaaggacttggattaatttcctaacttgtgtatcaaggaaatatccgagaatcttagtcggttacgattgtaatttatctttatccgtctattccgttaggaatatgggatgtatcttgtaatacggactcctccccctatataaggaggggttcggatgctcttggggcataactttttctcccagatcatacgatcaataatacactcggcggatcaatccccggacaggagtagggtattacttctcattgagaggccctgaacctgtataaatctcttgtcttcaaacccatccatttttcctgcttgatagccatccttttttattgccgaaatcttgtttcgacactcgtcatctacatacacagcctaatgctttgctgtaaagattgcaaaggtacaacatttgaagaaattaaagtccaattaagctagacattgccttttgcctccctgtaagaacgaaaacagcttgcttacgttaaaaccggccactaattcgggctagttgtcgtttgtgcgcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaacccaaaagaaaagtcggagattttattattgagtgaatacgcagacagcatccgtaagtaagggggtgtttagatcacatcccaaaattttacgccctgtcatatcgaacgtttaaacacctacatgaagtattaaatataggctaaaaaataaccaattgcacagattgcgactaatttgcgagacaattcttttaagcctaattgctccatgatttggcaatgtggtgctacagtaaacatttgctaataacggattaattaggcttaataaattcatctcgcagtttactggcggattttgtaatttgttgttattagactacgtttaatatttcaaatgtgtgtccatatatctgatgtgacacggcaaaaattttcacccctagatttaaacacagcctaatatagaatcaaattagatacgtttcacgtttcagtactatgaatttgaacatatcacatgctcatatcaaaatttataatattaaaatatgtctaatctgatgttaagtaattatattttacgacggaggaagaactagtagctaaataaaaagagagataacggtgtgtttagtttagaaatttagttcgaaagtttaaatttcttatttaaaaaaaaacacttgtaccaatgaatactgatgagtattttttttttctttttacaaaatgttactatagattagaatgtgtgacccgtgataatcccatgttcgattagctgaaaaagtagaacccaatctagcactctctctattttaggttagaagacgttttaattttagctaaagtcaaactggaattttcagtttgaccaagcttttgaacaaaataataacatttttaatccaagttaaatttactatgaatatattcaattattgatttgatgaaactaattaa

SEQ ID NO: 24325 - DNA, 3498 bp, Oryza sativa
  unsure (1)..(3498): unsure at all n locations
tgcagttcggacaacttacctggggattactgattggcaagtgtgttagtatcagtatgttgggtggcgtctcttgtgaggaagtgagtttaaccagagtattcttaagatgaccaagctcaccaaacatacccagtgttttgtattatattgtctatgcttgcatttttgtttacttgagttcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcagatgggggtgtggctctgcagtttgagagcggctactttgtggagacgctcgtggaaggggacaagcttggcgtcacgccacacaccattagggtgtcccctgttgagggtggagagctccttgcagtggactcggcacatagcaacattgtgcgaataactccgccactgtccgagtgtatgttttcttcttgccatcctcagctcagcgcttccttggttattttaaatatgaatgtaatatatgacatggaacattttttggtgtgtcatccagcggactgtttttaggagtgatcagagtttgttccttctttccccaaaggcatgaaactttaaaattagctttgttaaacatatcagtggctaataagcatatatgcaaatatttttttttcattttcttcttatgtagctctaatgaatttatataccaatttttaaataattgatatttccatgaaaataatgtcatctatttcgaagatttaggaataccttctttttactgaatttaggaatccatgcataaaatcggttttcaggtagtgagagatggagagagaacttcacatttgtttgtgctcaggggaatatcatctagtactagtagtgtagatactagatactgggactgatattacaacctctgcagatagcagaggaagactggttgctggttctttccaggggcattctggccatatagatggcaaaccaagtgatgcacgattcaaacgccccacaggcgttgccgtggatgatacaggaaatgtctatgttgctgatacagcaaacttagcaattcggaagattggggaatcaggtgtgctacaatttaatgttacatctgttctcaaagcagctgtgacttttgacctaatacaaactcttacctctgtttgcaatatatatgtaaatacctacatgtacagtattattattgtactttgtatgcaaatatgaaagttcattttcattttacctaattaattatttaaatttattattggtcgatgtttgaactgtgaaagccaaatgtgacagctatttagaaacagaaggatgacatatgtattttatgcattatttctgtgttagtactaggcgaatgaagtgaatgaactttctgtgcaggagtgaccaccattgctggtggaaaatcaaacatcccaggttatagggatggtccaagtgaagatgcaaagttctctactgattttgatgtggtatatgtgaagaaaatgtgctctttgctggttattgaccgtggaaatgctgcacttaggaaaattgcccttccgcaagaagattgtacctaccaggatgcaactcttctatcgtcaggtccattctcctatttttactttttatgtttgtaatctttacatctagatgtttttgcttgttgtcctatccgtcatgttctttagaacattaagaaaatgttgtttatgttagagagagagagaggagttagctggctgaatatttgaggcagttttgaacaagaaaagggtttccgggccttattttaagttttgtgctaattctgtttggtggtgctatccttgaatttttatggatgattaattgatcaccacacagttttcttctttacatcaagtgtggctcactcgaccgctttggtcccaatacatgcgttctgatttttttattattattttaaagttgtgatgtgaaatgatatctgaattggaagttggtaaaattgctagatgttttttacttcatgtatccctgtatttataattctatggtagcatactgatttgtcaagttgaaccagaagtaatattattagtgccatatcagtaatgtagatctagcacgcgccataagaaaacatagtctgtagcagatcttttgaacatacggatcgctataaatgaatttgttgattgaatacaagtgtagtatagaccatgactttctcaaccatttataacgagatatgccatcctggaactggcataatagtatcaaataaattgtggatgggcatgctatggccagtgatttgcagctttcttagtgagccatctgtaattttatatcatattttgggcctcttcctctatttagacttttggagtttgcatgataaatcttgtttagaaagctgagttacttgagtaaatgactagttttttttcataatccctaagagactctttttttctagaggtaataatgcagttggtgttgtgtttgtgtttctggctgaatcatttatatttctacactaacttatcttaaattatgactgtatgacaccagagctgtagggatttacaattattttcatgttcatttacctgttgaacatgttagtttttatcattagttcacttcttgctgcagtttatgtaccatttttcaaaagaaaaagaacatgtctagacttgatcactgattttgtttattttcacagatatcatattggtcattggtgctgttgttgccggatatattttctctgttgtgcaacatggatttgggtcatcaactgctgaaaaggtagtgttttctgtttgttacattttgggattcggttgtctttttatatgctggattttggctttcagttggtccttttcacttgcattttgcagtatcagtattcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24326 - DNA, 1064 bp, Oryza sativa
acaatgtatcctgggaacagaacaaggcatatcccctagcatttcaatggaactcctttgttccaaacaggaaatttcaaccagaatcaatcaatgggccatatgctaagttacagcgtactcttggtttctgttcccaaaaccattaaattgtcctcctgaatctcatgttcaagttcacttagcattactactccattaactatcaccagtgtacaaaagtacgcttgtacacacaagattgcatagctgattagcttttcatcccagcagctcctgaatttatatattcttatacagtttaacagactaaggatgagagtttccaattttatttgcaattttcagttcttgaacctaccaaccacctttcaccccaaaaaaaagtgcaaacaaatcagtcttccttcggccgcagtatttctctaacatcataaccagattccatataaagcaaaaaaattccaacaattctacacagacaagcaaagaatctcgcaacgttcctcctcgaaggacacgagaaagcacaaatgccagcctattttttttcctccaacccatctccgatcatacgactctcatcacaattcttgtcagatcttctcgatcgtgcgaaacaggaatcaaatcagggcacgcacgaactgaacacggtatgtctagatctcgacgtctacaaatccctgctcaacatccaccacgagcgctacgagcaaccgaaacggaagcgaagaaagaggaggaggaggaactcgtcccgtacctcccgatccagaaggagagcgaggcgccgagcaccttggcggagaagacgcaggcgacacccgggaggaagccgaagaggagcgccgcggcgccctcgaacaggatggcgtagggcgggcacagcgccagcgtgagcgcgtgcgccgcgacgtacgcgggcgccgcccaggggcccagcgcgtcctccgcccccggaacgccgccaccgccgcctccccgtcccacccgtaccgcctccccaccgccaccgccgccgccaccgccgcgaacgccaccgccccgcgcgcccacccctt

SEQ ID NO: 24327 - DNA, 593 bp, Oryza sativa
attatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtat

SEQ ID NO: 24328 - DNA, 1148 bp, Oryza sativa
aaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttc

SEQ ID NO: 24329 - DNA, 640 bp, Oryza sativa
ccagccagatttacgcaaaaggaagttggtgtcaagtgatgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatctttctgcaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagcaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaa

SEQ ID NO: 24330 - DNA, 871 bp, Oryza sativa
acatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcaccagcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttg

SEQ ID NO: 24331 - DNA, 489 bp, Oryza sativa
tacatcacttgtcaaatccgtatcgcaggacgaaaggaactcttcaagcttagaggaaggtttatcgggcaatgaagatatcacatcacgtagccacttagcagttgtcatggcagaagtaactggtgtcatctgcacaatcttgattgagcccccattggcaggtgatgaaggggaactaggggcagccaacatattctttattgtctttgtaggagaggctagtgtttcaaacacacgctgcaaaaagagaaaagggaatctgtaatgtaaaaaaagaaaacaatgtgtagttaactaaaaagattatgaatcatcacagatacctttgagcagccaaaattagcggaactaccagaagagttttcagcattgagtacatagtcattgctggtcaaaaacatttccaaatcaagctccccttggcagccggtggtactacttagcttctccagtttttccaaatttgactgaaaaatctcatcatcg

SEQ ID NO: 24332 - DNA, 597 bp, Oryza sativa
ttgaaagtgttctcacacccttgggcacttagtttatctagtgaggtgttagagagtgagttaagccaatccaagtgcattgcttcattgttatagctagtgtggtacttgatcatcctcggcaagcatcctagacttgttactcttggaggttgccacctcctagatggcttgtggaggtgtttcccggtgatctctccgaggagattgtggaggaggcccgacgccgtttgtgagtgatttggagttcaccaccttcgaagtgaaggaataactaccctagtgatcgaggcttgggtagtcctctccgtgggctggctcccaccttgcccaccccttgatgaagggggcgtgcggtggcttcatggttgagcggtggagttggactcgcctcaacggggattaggaaaccggcgagtttctgaacctcggtgaaaaattccttgtctcttgtctcatttatttgttgcatttacatttgagcaaatttacattcatagagacatatttgagcccatatcacttaggtttgcaaaacttaacttagttgcttagttaaccttgtacctcaccttgcctagcaacttaggttagttt

SEQ ID NO: 24333 - DNA, 683 bp, Oryza sativa
ccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctccc

SEQ ID NO: 24334 - DNA, 1341 bp, Oryza sativa
taaacatgaatctatctaggactcagattgagaaattccatcaattctattggtcatacttttccttaaaaacttacctcttttttctgaaacgtttaaaactttttcttcggccatactttatgtggttctctctgtcctagtgtgggctcttgttgtgtgcaaacttttgtgggccggtttgagcctccaaatttcttttttttaaaaaaaaaatcaatttacgggatgcgattagatgatgtgtatctcactatagtattcattcataggattactgaattcttccaccaacagtaaaaaccagaattcatattttcagagagcatgctaaaagagttgcacagaaatcacagcatgtgtttgcttaagctgatcccacatagtatgtgaaatcagggcaatatcctaggaatcgtattacatatttttgtaggccatctaagataaacaaaacatgatgtatgatgtatgtagcacaattgtccatgatcatgatcttgatctctttttttttcccattcatgtcttaattctgaatattttgttcatgtgctccagagcattgtgcataaatccccacttccggtgttcaggggaactgtgattagcatgaagattttggttgatttcagtgttggattgggttttatctacgggccagtagatatctgttcataatatgctattacaatggttaaatgtgtttcaaccgctccaatttcctaaaaaaaaaaagaggaaagaacttgtgttttcggcagatgttgttttactggatgcctctcacattcacaactcacgcaaaggatcaaatatgtgcagggactgtggaaaagaagaaaaatgggacatcgaaaagcaaaaactagcatatgatgattacggactagcaggatagaacctcttgtgttgtcacaaccagttcaagatcctcactttcatgctttggtacgttcccaaacgcctcctgttcctaaccttgcaatgctcgtcggctcgtcgatcgctccatcactataccgtatgatgatttcaaagttttgggaggcatatagccatagaggcgcaacactataatgtttaaatattaggggttcatgtcattctccttaaaatcagctgctacggaataacttatttacgcagatactataataaaactattggtatatattttcgtcttccgtctacctaccctccaatgagttcagtccttggagatctctcaaagaatacctcctctgtttcatattacaagtcgtttgacttttttctaatcaagtttgactaattttatggaaaaatttagcaccatctaaaatatcaaactagtttcat

SEQ ID NO: 24335 - DNA, 532 bp, Oryza sativa
ttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgccttta

SEQ ID NO: 24336 - DNA, 1251 bp, Oryza sativa
acatttaatatattcatgttgaagtatgtgaatagtcagctcttccatcaaagccaagtacaagttaaataatagagccttcaatttttcttctcctctctccttttctcacttatgtatttagtgtatttatccaggagcacgtgttaagtgaactctcatttatttttttaactctctcctccacataagtatagttgacttatactcactattatccttactctaacccttttcaatttttgacttatgcttgctattatccttactctaaccctttttcaatttttaaattccttcttctccacataattttacagttggcttatagctacgctactatatactcctttcatcttattttaagtacagtcgtgggttttcatgtctaacgtttgaccgtccatcttatttaaatatttatgatttgttttttttaaagtcacacataaaatactatttatgttttatcatatgtcataataaaaatattaatcataaatatatttaataaggtggacgatcaacattacatagaaacccacaactatacttaaaatgggacggagggagtgttaaactcggagcaagtttaatagtatagccaactactaactctaaattatctatagtcaatttaatagtcaattcatataatagttacctataaataaaaactacactattaatatctggtcacatctgtcatacacacattgtgtcttaaagtccgtactacagttggctataatctgtagccacatgcttctctctctttttttatcatctcgatatacttttaaagctgatttataggctgctagtttacctgctcttggctctgttcgcaagagggtgttcccaactctcccctctcgttttttacgcgcacgctttttaaattgttaaacgatgtgttttttttaaaaaaaacaatctatacgaaagttgattaaaaaatcatattgatctattttttaaaaaaacactaaaacttaattaattacgtgataatgaaccgcttgttttcggtatggagggaatgagttccaaagcaccggaaacgaacgcaccctactctgtgtgagagagagagatggcatcatggtcttctcatctgggtattactcggcagccttgtgctacgcgcacgtacgttaaaaaacacacacacagacacagataccgtagctctcgtgggtctccgggtctcgatgcactgctcccagctgctgcaaaaggagcgccatg

SEQ ID NO: 24337 - DNA, 1177 bp, Oryza sativa
tcatgtagtaatgggtatacccacgggcacagataatctcatgggcatgggtatgggtaggcactacctgtacccatcgcgcccaattgccttcacaagttgtgaagaacaaatgagatggcagacagatagagataaggcataagatctatgttttagccacctgtagggggataatatataaaaaattttggtcttaatccttgtgtggtgagatgctgatctttcatactcaggaccacaacagctagagaaatgaatcaactgcatcacatagtacaaacactgttatacaccaaactgactgaaatcgtcagatagaaactagaaaacatcatccatctagcaatttcatccatgttgtatctactactatattgaataacccaatatgaacagtaaaaccatggtgaatcaacactactactgtcatccattcccatatctctgaaactcaacatcctggccatcagcccttcagctacctctgaatctggcgcaaacatcgcatgggtgatcccaacaacaccagggttctgactgttgagtaccgaaaaagttgtcgcaaggccaaaaccatagttcatgatgaaatggaccagacctctggggaagatgaagacatccccctcagcaagggtcttctgaaacagcttccccttggtgtcaaagaagcctgccaccacacttccactgtgaacaaacatcatctctgaagctcttgggtgggaatggggaagcaccgccccgctgaccgcgatgtcggtccgcgccattgaaatgccaagggtgttcaggccagggaactcggtggcggtgatgatgttcgccgatgaccggaccatgttgtccaggtccccggcatggttgagcagcaatgtcttgaaatcagaggccattatggtgcttgggctcttgcagaagaaaccattcatgaagagtttcctctcaccctggggtgccatagggcatacatcctgaagaggagggctatctgatatgatttctggagcaaagagaccaaggagaagaaggtaacaacacaggacagtggagagcttcatgtcatggaattgttggacaaaaatacagtgaagcagaacatgggttaaatactgtgttgagacaggagtgcaaccaaagtcagaagactgagtatcctgtgcaacattcttgg

SEQ ID NO: 24338 - DNA, 2382 bp, Oryza sativa
cacaccatgaatatatacgtcatccctgtttttccgtgcaccaagcaagttaataaaatgtgttgagctagctctgatgtattgtattgtgtctaattagttatgtagtaactagttgctggtccatatctatttgtttttttcccattgcttactagccccaacatttggtgcttgatggacattcaagatagctcttgaattaggattcctggctccttggtttatatttttctccaaatcctctgaataatgtgctgaaatctatcacttgatcctcccagaaagtggcctgctaggtacttgatacttctcaccatccttggattcctacttgaagagtactattgatttgctgcctttaactacttagatagtgccttgaacgaatcatttatcattgtgacattgtagccctggcataactctgtggcactctgctcagtttacatgcattacatgttcattgattgcatacaatgccattctgtagtaacagtgtgtttaattctcctagattatgagagctaactgaatttaatttgatctgcagattgtgtgcgccaatggcgcctcaccacattaatggccttgctgacgttcgtgcagttgcggaaatgtcacctacacttcctaccatgattattagagtaccttgtgagcagtcagccaatattcacaggctactggaatttgttgaggatcgtctggatcacggtgctcacgacttgattaaggcagaggacattccccgacttcgagctatcgcccagggaaaccttacaagtgctgatgctccccagttttgtttgtcattgctcaacgagtcccagatctacctgcgggttcaactgttctcgtcgaagtcggatgattgggtgcggccacccatcgactcacgggtagtatcggcagtggctagtgcgtttcatcttccccaggatggggtgctgccttttgatctcaactcaacgacagtggccccagatggtccaggtgcaggtcgtattcatgctgaacttctgatgccaccaggcagcttgcctttaccgcctcctgttgttgtcacagtgtcagggtgtgaaccactgaatgatgcgcgggaactttatcagtacctggaggagtacgtgaatcaagagggctggatagttgatgacacacagcttgcggggcttgcagagctggctgaagctagggacgagttggtaggagctcgcgataagctcactacacttgcatcagatattggagatgatcttttattgggaggagcggtcactgatgatgtaccgttgttatctggggacttcaaagcagctttggccagggtattgaagcttcctgaaggtatggagcttcccaaggactttgaatcacctcttcttgtccctgccattgctgggagggagagaattcatggtgaactcatcaatctccgagctgacctggctgctttgaagcagcatgttgaggagcagtggctcccatgggctaatgatcgtctatcatccgctggagtcatcggagaccagattctactagacatggagtgacacgggctaataatgttcgtctcacatctctgatacattctacaagacatggactgagtcagattctacaagacatggagtgacacgggctaataatgctcgtctcacctctctgatacattctacaagacttggactgagtcgttccgtataggccacacaagaagtgagaaagacgatgtacatttcctgctgatttctaaggatcaaaccatagctgttataggagatctcccagaactgaaacctcaattgctattacatagttctatacttgcagaatgattacgatggatgcccttccaaaatttatgtggcaatagaagatgctttttagtggttagaccgaaaattaataatgttcagtgcgcagaacattctcaccagtcctcatacagacaatgcatggtcatacgcaggtggcactatttctcattacttgtacaacaattgacaatgaggttgatatcaatcatcacgttacatgtataagtgaccctaagggcttcttttgttgcttaccatccatctgagaacaacactgtgcaaacacttgcctaattgccaaagctgaatgaagggatattagcagaatttatttacacactgaaaaagaagtagcattttacatagccttcgctcctaatgaatcggctggggaatgaaatgatacaccccattagttaattctagacaatcagccgccttttacactgctacagcctattacaacactagcacaacatttacagtcgagaagcactttgcttcacccacttattcagaagaaccaaagaacaatctgtgggattatgagctctataca

SEQ ID NO: 24339 - DNA, 648 bp, Oryza sativa
gcctggagaggatggtattttgctttcaaaatacttaaccctgtttggctttgctttgggggtggtgtctgcgaattgcgctctaccaatgagttcctagattcggtgcataatctctttggtgattgaggataacagttgccatctacaaaaaaccatttgagaaatgaataaccgaacaatgcaacaagcaattaaagaagttttaatttatgaacttcctgtttaaataatgtgtgatcatatttcatatggttatcaaatttgttagtccataaataaacacttaaatgctccatactgcctcaagcattccttgtgcatgacaataaggcgtcaattctactttcaatgcaaaccgacaacagttgatatgaaacaaaataggatacatgctgctgcaaaactgagctcgtggtatccccagttcaagagtaatagatgcatgactatgttcaaggaccaaagtccatactaagctagactgtacagttcagctcataagtctagaggagccagaggtttccttggtaaatggcactttttgttacattatagggacttttaaaatttttagtggccataccttttcatcacagtcctttctgccacctatatataggctacaatgcagaattgcacatacta

SEQ ID NO: 24340 - DNA, 295 bp, Oryza sativa
cgatccatcatctcgtgaagttgctatcgaggatccctttatgttgacatcagacaactcactgttggatatcttgacagtgctgagatggaggtaattgagagcttttttacgtgcatcagcctggttatctgttacccattcctgatctgatccttcgatttgatcattgctacaggttgttcatgttctttccgctaagggtgttaagctagtgcctttcaagctgaactacaccgttcaatcggtccaatccatactgaacatcaccatggatgttgacatgcttgcgcat

SEQ ID NO: 24341 - DNA, 369 bp, Oryza sativa
ctctctaaatcttctgtggttatacatacaagggccaaatcaagagtcttcaagcttcttaggccactaaaagttggtaaaggcctcaaattcataaagcaaagcttaagatgctctatagaggttggttctggagcagcaacattagaggatggaaagctgtatttgacatcacgaggatgagcataccatcgtggacttaggtcaatagtcagttcatttgcaccagatcggactgcaaagtaaatccaacggtcaatatagtgtgcgtacttgtgattgttgaggttgcgcttcaaggtgaatgagttaatccctgttccagcgtggtgccttatgatggtgttaacacacctgacaaatttagcc

SEQ ID NO: 24342 - DNA, 457 bp, Oryza sativa
aatctaatctagcaacgcgatttagccgataccggcagaaaccctaaaacaagaagcagccgatagagctaaattgatatgctaagactagattaacatagacatatgataaataggtaggcaaatatatcatctaaaccagagcaatccaagaggtcgaatgtactgatgcagccttgaacgacgccgacataaacgatacaattgcctgggctgacagaacattggacttaccccttagccggagatcgaacaccgatgcagccccacgtcaggtgccaagtcctgccggacgataaaataaagtagaaaaggtaaaaggtggcgatgcgccgaattgtattgatcgtgaagatagtttacaatgatcccgggtgtacatatttatcccatggtagatactagtccttgtaggataagaaagaaactttcctaaagataaaaggaaaacataaag

SEQ ID NO: 24343 - DNA, 1283 bp, Oryza sativa
atatatttcttgatatttctatatatattataatagaaaatagttgtcaaagctacgttttgaagaccgtgcccttatccaaaacgataagtattatcaaccgggagggagtaattaaagatgattcttctagtatgtactgtatataacctgataaagctaagctagctagtgccacttgttagatagagaattctctctagggactatgccatatctctacccctatccatctctgtaccatctcaatagtttaattaaccccaaatcaaagcaacactatccaattaacttttcccttctctctgatgagttcaaacttgcattgtgggcacacatcacatgcccttgcacccctcaagagaagcatgcaaacagaacaaaaaaaatggattcataagcattggtaaaaacaaacaagcaaggactcaaacaaaacaaaataaaacaaaacaaacaaccgtgtgcacacacacatgccaacacacccggaatgtatttcagattttcagtactttcagtttattactccgtatcaccttctctctctctctctgagttttgttttttgtgcattgtgatgtgtttgtcctagagggtagtagagagttgctgccatggggaggagcaagctcctagatcgagtagttggaatccttatttgaaaagaggatttcaaaaagggagtagtaaattttaatcagattccgtgtgtacgcagggacgcatgcaggggttgtgaagctcaaggtctaggcacggttttatatatatttgaatgacattgtaaaagggtatttgcgcacacgcattcgtgtacgtacgtatgtgtgacgctgttgttggactgtgagcaagggagtacattcaacgcagcattgctattggtgatggctggctatcaaatcaaaaaaaaattaaccattatatatcaatatatgcttgccgcttattggcgcatatatcttcatgttgttcttttgtgctggatggctgaatctcagaatgatttgtaataatgatggccaaataaatgagtgaactattatcactggtggagaaatgttttttagtcccggttcgtaaccccctgtagtcccggttttccaactgggactacgaatccgggactaaagatcgctatctttagtcccggttcaaataaccgggactaaaaattaatctttagtcccggttggtaacattttttctttttttttctgcttttaatattgaatattgatttcacaccatcccctcccatatccaaatcatcacatatt

SEQ ID NO: 24344 - DNA, 1047 bp, Oryza sativa
tgtatgtcaaggaaaacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtatacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcgatgggttccgtttctggcatcgacgacttcgccttccctcccggacaggcgttccggttcggcagcctcaacttcatcaccaacgacttcggcaagatctctctcctaactcggattcgaactagtcggggagagatcaggtccccgcgccgttcggtattccgaactcggccgaggcctactccaagatcatctctcccgagtcggcttcaaaccactcggacgagatctaatctactcctccgcgaccagatcaagatgacgggtcctatccctcaatcctgataaaacttcctgatgatttggccgctgtcttcacagccaagacatctcctgctcgaagatctaggcgagctccggcttcggccccgatccgatctagatccagggaggttggcgttatactccaaccccttgggacagtctcgacggaagagttggatggctaccttagctcccccggtgtcagttctcgaccaaccgagatcctcgactacgacgacttcggctaccactacgaccacgacgacttcgacaacttcgacgacagctatgaggataactacacgcctctcttcttcggcgtattcgtggctgacaacgaaacggaggaacaacgccgagcccgagaagtggaccaagagcgcgcatggcaagaaactgaacgtcgc

SEQ ID NO: 24345 - DNA, 644 bp, Oryza sativa
agctaggggcgctcgaaggcaaacgaggtcctgcgagaatggaacatcaagttacgacggggtgatgtttttgtacaaaaacagaaacaaaacttaagaaacctctgggctgagcagtaccgtgcgaaacaggtaccgtaggtcgaggtcctgctccgacggtaggacgcgcgaggccgtggttgtaccggaccagctggaggtacgacgtccacggcgctgcgacaggagaagatgcgcatgaccgcacgcatcttctcctgcatccggtcgaaggtcatcctctgctcaacgtcagtcaagtgcaaacctctgttcaacctcacttggactgcggtgatatcggcactgatatcccgtgcagcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcgcctcctctgta

SEQ ID NO: 24346 - DNA, 644 bp, Oryza sativa
gtctcggagtgattactgtggcggcgtccagcgtggcaacggcgtccggcggtgtcctggacctggagtcggagatcgggcggcacgcggcaggagacgagtcaactgtcgacgagaggaggcgaacagccgatgcgatgaggcgatcagccggtgggcaggtatggcggccgccatacctcgccatactggtggcttcgctactgagcgcaagatccccaaacaaccgggccgatcgatgccaaagctaggagtggccttggttttttttcccttcttgtataaataagcaatccaaatcaataccgaatcggaaccagagaggacggaggggtgaaaaaaaggcgataactttgagacggactcttaccacgaaactgatttcaccgcatgggcatgacgagaaggagttggcgccagatgttctacgtggggggtggagcggagtgatgatacagagggaggcgaaatgatatgcgacgccggccgcggccggaaggcgagtacacggcggcgccggaacggacgagagagaggaagggggggaggggtttgtagatttgggttaacgagagagagagggggtccgtcttttttttttgccgaatccttttttctgttttttttttgcttccggttttatt

SEQ ID NO: 24347 - DNA, 477 bp, Oryza sativa
accagcgacgacggcgacgtcgtctacggcggccgcggcgacgacaacgtctacggcgatggcacgggctgctgcggctgcgtctacggcggcgacgtcttcggctcggcagcggcgacggcgtctatggagtcagctttagtgcaagagtcagctcttgctgcaaatacacaatatcagcttgtaccttgagctgccagacatatcctgaacagagcacctagagtgggaaattaaatccacataattaacgcaccgaattgaatccacataattcatagacaatgattaacattacacaaaatggcactgatttacctacttgcaccaaatgtggctacaaaatttacagaacatatatagaaatacataattatgaccaacaagaataacatcacataaagttgtctactatgactacacttctcttctttcaacatcttctttagctgctcacactcattcttagaatcattc

SEQ ID NO: 24348 - DNA, 649 bp, Oryza sativa
ctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagt

SEQ ID NO: 24349 - DNA, 686 bp, Oryza sativa
ttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccggaagttgccttccttgatccacaagtggtcactatcacaaatctccagaataaccgtcaaggaatggtcaactacatctacgacaccttgtggtcccgccgagacaagaagtacattatgtgtgcctataatcaatagtaagtgtgttaactaaatatacacaacagcatgacacattccttgagtaccgaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggatgccatgtgtgccacaatatgcgacttctgtatag

SEQ ID NO: 24350 - DNA, 144 bp, Oryza sativa
aggcaatatatataatctatcaacaaaaatacacgacaattttccaacagcaaagcagcaaggcaaatcactgacaatacaaataaacacgaagtaccaagattacatgaattctgacagaagggcagttcaacgacatcaact

SEQ ID NO: 24351 - DNA, 1393 bp, Oryza sativa
attattccatttgatgagggaagtggaatatcatttgcagtgttaatctgctgtgctaaatggcactataatatattatagtataatactcttaatattttcggtaaaaacaaaactctttagtagctgatagaaaatgtcacttagaatagtataataggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatactcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcat

SEQ ID NO: 24352 - DNA, 2442 bp, Oryza sativa
aaatattgaaagatgagtttagagtccacatagaaatataattagaaataataaaaaaaataagaattaaaaataaataatattggaagaagatactagaatctatatatagaaatacaatttacagataacgaagattcggaattaaaaaaatattgaaagacgagtctagagtccatataggaatataatttacaaataactaaaatttgatattaaaaataattaataactaacacgcatataaaatacaatatgaatattacacattagtagtttcgtaaagttagtacaaaatttaaaattatgttgtcattttaatatatttgaataatacattaagaaaacatatatgctattatatgagagaaaatataatgatgctagccgcgtaatctgcgcgggccaccatgctagttaggtataatgcatcacctaactatcaatactgaatattttaccccctcgagttgttttactatagttttgctacacgtggatatctcataggatgccaactgttcaataaatccacatcatctaaacaatagagggctcacccacttcatcttcttcctcctttctccctctcctccgtctctcttaccccacacagtgcggctagtgaggcttcaagagcggctgacgatgagcgcttttttccccttctctctactccccctttgttgccgcacccctgagcgctggtgagcttgatctctccctcccaactacccttctgagagccggtgagctctagatcaccctcccccgtcgccgcccccttgtcactgccccattctgggccgagcgttggcgagcacaagctaaagatccaacatcctgcctcacttccttgagctggagcacaaacacgagctcgagctacttggggatgccgagttcagcgaaggcgactaggctttgagatgaggagttcgagctaaacaaggaagaagcggatgcggagcttgagctggaccttgtccttgaccaggcgatgatgccttgtcagataccgcgctgccgcttgacgtagcttttcccccctccgttgcatgtgccttgtcatggatgggctagcggggagtggagggagggagctcattggctgcctccaaccttctattcctcattttcctcatcacagcccctcttccttgcccctctccacacgtgaccggtgagatggtttgactggtgggactatgctgatgtggcgttcaaatgaatcaaaaccagtcttaaaattgctcgagggcgtaaaatgattggtattgatagttaggggtatattatacctgattttgtagttcggggtatattttaggcaaacataagagtttgggggtgtaaaatggacttatccctgtaaaaaatctatcatccatttggttttgtttttttaaatggtattgaaaaattatttgacattcatttctttacaatattacaaatctagggctagttgatcttgcccaaaaaaaaggaacactccaaacaacttcgttaaagttttggtaattattaaatcttgtcgtagacaaaaaaaaaacaaaattgaaagcctaggattgacatagaataaaggacttgtccaatttgtagccactctcaactctaccttactaaaatttggttgaactttgaaaagtgcaaatatctagaattatcaaagtttggtaacatagctgatgtgaaaaactactaagatttctaacatatgtttggtttgttaccctactagagttttataaagccaaaatttaataaggttaaaagttacaattaagtgaataagtttaaaatgtactgtatgcaccattgccctcaagggatggtgttggtaggacacattttgttttgtttttttttctgcagctagagtttcaccatgccttctagttctaggttaaagggtaaattggaacaatgtcattataattttgcaaagtttgagatatgccatcagtatctcaatgacatgtaggacccacataagtcaatgacatgtgggtcatgatggcatatctcaaattttgaattaagttggaaaaaaacagacaatatgccactccacaagattgcaaaggataaaatgccatccattagagtgcaaaggataaaatgctactcaatagcttatcatcagtatactttgccactttgagtagttttgagactaaaatacccctactatggagagagaggaagggagagacgaacgacgtcggtcgtgctcgtcgccggtgggcagcgagcgtgcgggggtgggcggcgagaaggggaggaggactgcgccgccagggggacgacagtgccggctccatcgggggagggcgccgaagtggggaaggatgacggggggaggaggatggcgcggcgacggggacgacggtctgaggctccatcgccgtcgtctcttcctccaccctgtactcc

SEQ ID NO: 24353 - DNA, 6547 bp, Oryza sativa
  unsure (1)..(6547): unsure at all n locations
ccgccagcccggccctccccagcgctcctccccntgcgtcgcctcctcatcctccccctacccccgccgctgccgcctcctggcgaacgcgcgggtaggctcgccgcgttcccgcgtcgtcgcctccaccgccgtcgcctcttcatccccccaccggccgccgccctatcctcctcccagccggccgctgccgccaccgcccggagaggcctccacgccgcccggccggccctcccctctccctctgttccctctctctctctaggggcattttgggcacaaaaatctctaaagtggcatttcatccggtaggcaacgtattgagtggcattttatccggtgcattgtattgagtggcattttatcccacccatcttatagagtggcatattgttcgttttctcaactaagttgtggcgttttgtgtaactacttttgtccattcaaaatccacttagatctaatatgcgtttgagctagggaattccacatcatcagggccgtgtggccgtgtttagttcacccctaactaccccgaacttccaactttccatcaaatccaaaactttcctacacacataaacttctaactttttttcaaactttcaattttttctcaaactttcaacttttttcaggaactaaacacaacccagattttgtatagggtttggaacaacttctatagggtttggacgtgtctgttttactccatgaattgaaatgtatttatcatgaacagtaacggatactaatagtgtatgccccttttgttttgacaatgaaagctgcacttgatgagttcttaaatgtcattgcgggattaggtgcacctaaatgcatctagtcaatccatcaagcagccaaaaccaagagcattcatgaactactctacctggcaaccaccgggtttgccccatggaaactttgtacttgcaacaaacatgggacaggactcccctccttgctttttcagcaaccgatctaaattaaaacctgtttcctattggctatttctgcaggtacatagggtccggcatcatctcactgtccaggctaaaatttctttgctctgaacccatgtgctttcttaatttttttttaagcggtaagtcatggactttgaattagttgaatatatgtgtccgactgtcccgttggactttttggtaggactccaattcaataatgcaacatgcgctcactggtggatccgtttcttaggctagatgaacggctgaccgggctctaaccatgtttcatcgtcggaaattaactgccgtgaaaacatgggttgtagtgctagttgtttgttgcctgggctttttaccaaatacctgacttttctattagtacgtagaatacacaatatatagagccgagtgtcctttaaaatggaggatttttatagaaatcttaactaatcatgcaagttaaggcaaataccaaagcaaataaagattgtacgagcaaacaccatgatctcgtgcatacccatctacgctatttcttgaacgtggttaggtgcgccgcatcatagttacatgacatcaagaggctaggctgatggtggaaaagagatgaaatgggagctagaagggcatcatagctaaaagggagaaaagatgaaaccaaggatgggacaatctagtctttcatttaactgttcgttgctctagtcatctgttgtgttgttcagtgtatataaacattgaaatgcgtagaaattgaacaaaatgttgtttatgttatttcagttgtttcttttaggtttcttttcgctgtggtagctgctgctctaaaccagttcatttcagaaataaaatggtgaacaatactctttttcttcttgtaatatgcagtagccacgaccagcactacctagaaaagccattgttttagagtttatatttttcctcaaaatacgaattaacattaagaggtttggtaccagatcacatacatttttaaatcaacgtttgaaaggaggccccgtactcttttacactcactgtgctaacatagttaaaacctctgttacgaggtataagtactgtcatggactaatctccagcagccccttgacagctctccctcgccgtgcttgtaccctgcagcttgtagtttactccaacccaagaactagtactaccactgcactgctacagccaagtggcccaaacgcccaggacacattgctcctccctcctcagaacaagtactatggacctcatacctcttgtttgatatagtacttcctccgttttatattagaagactttctaacattatccgttcatatatatatatatatatatacacacacacacactaatgaatcacatatatgaatctagacaacatatatataaatatgggcaatgctagaaagttttataatatgaaacgaagggagtaccatgtaagagcctcatgggttgccaatattacttaataaatcgtttagacttattagggaataaaattaatttataggtaaatttttatacacttgttcgtaacggcttaaaaaccaatactaaaaagaaattacattgaaaatgcttcaaaatcaagtttgaaagttcatattttgcccttttgctttggcttattaggcataccgatgaggctctaaaattacataatgagatagaaaagagaaaaaaagaaagaaagagaggagttgccaccccttatgtaaagggtagtctctatacaaactcctagatagataagggaaaaaaatcaatggattgaattaaaaaaaataaggtatgagtagtatattgggacaagtgcattagaggcaatatgttgtatgggtaattttatcatccttaataatgtacctagaggtaccatattttctagtgtaatatttggtgcctctaggcactgagtaccttaaagtaccaaaaaaatttagagtaaaatttagttacctcgaggttgttaataaaatagatacacaacggagacacgaattttatgtggaaaacctttgcaggaaaaaaccacgggcgccgaccggcaatgatcactacagaggagttggatacaaacgcatggggtacattggactgtcgcaccctccccgtgcggcttacaagagtatggggctgtttggatccatgccacagaatgccgcacctcatgttagtcagccacaaccgcttagcccttgtttgttttgcttccatagtttagcctgccaaagaaagttaggcagcttctagctgctttgccacacatttttgagccaaagctatggcaaggatttcgttcgccacacttttggcatgtgctaacttgaggtgtggtaagttgaaatacccaaccaaacaggccctatatataggagaaatctaggagtcctagtggggaaagacttagagtcatactaggaaactaatcctaatagtcaacttctattaggaaactaatccgaatatattgtaggcccaaaattcgaatcacatatttaaaagagatttctgaaggaccataaaattccttatttcgtataaactatctcctaattaataagaagatggtgtgtgtaaaattaggagaaacgcctatagggttttctggttagctctatttatttgatattaggtctttccctaatagtcatattttttttataaaattagaagcatgtttagcacagctctagctccagctccagctctacttctcctagagctataactagccaaacagtttcagctctctcacaaaataaactagagaggtggagctggatttaggtagctccacaactctactctagacccaactcctgtaactaaatttaggatttggagctctaccaaacaggccaggccatatgaccatcacctctaccgtgaaacttgctctcatagcctgggtggccatagcgaaatcatgcgctcctcactccaagtcgtcgtcgtcgtcgagatgacgaggagagacaaacacgcgcctttttctagtggccgcaagaatcaagatccatccaccggcagagaaccgaaccacgcaagctagctggtcgatcgatccatccatcgacaggcggaaaaggaggcaatcgattccctaatctcgctaccgccatccgccaagcgaagcgaagcgaagcattgactcctactcctactacgagcggcttaaagtgaccagtaaccaccaccaccacgccgcggccgccgtcgccatccgcgcgcgcccccacctgcctccgctcccactcgcgcacgcggccaccacccccaccgatacgcttctcctgcctgcctgcctgctgctgctgccgcgcgccggcagggagaggagaggaggaggagcatcgcttccttgcttcctcctcacgtgccttgcccccgccgctaagtagccggcttcctaccgaacaagaactgcagcgagcgactcgggaggaggaaggcgaggggatatgcagcagcagcaggcgtgggcggcggggcttggcggcctcgcggtcgccggggtcggggaggagggcggcgggggaggtcccgctcccaccaccgtcgacgaggcgtccatggagcggagcaagagcttcgtcaaggcgctccaggtaggcctgccggccggccggggacccggatccgggagagatcccgcggcgccgcgaggctcgttttttttttctttctctgaaatgaattgcagttcttgattcttttggttgaactgatgtcgcgcaggagctcaagaacctgcggccgcagctctactcggcgtcggagtactgcgagaagtcgtacctccacagcgagcagaagcagatgtgagtttttttttttgttttcgttttcgtttctactgcgattcgaatcccagctctagcaggcaaaatttgtggcaagaatttgtgcgtgtgggcaaattattggttgcttgatgctactatgggaccatgaacttgtttatgattgctctatccacatagtttctcgtttggtgctagaaaggttgcggttggtgtgtagtaggtttaaatggtgaatcagttcagagttagctgagcatatacaaatagcagaaatggatgaggaaattacttgtgaactagaaacttgggccacatttgcgagttggaacacagggaccttaaataattcttgcgaaatctgaatttttttttttgcatgcgaaattcctgcattcataacgatcccttaccgagacactggtagataattaatcttggtgcagcatagggtctggaaatgttgagtttacttgcaataatccatccgttgtttatttcagtctactttgtactaagttctgatatcctcactgcatatcacttgctgtcaaatggttgtgttcattttctgcatctggctgctaggatttgagtacacgaaaatgtgacaatcattgggagtctgatctgatttcatatgcttatttatgtcagggttctagacaacttgaaggattatgctgtgagggctttggtgaatgcggttgaccaccttggcacagttgcctacaaactgacagacctgtatgaacaacaggcttcagaagtttccactcttgagctgaaagtagcatgcttgaaccaggtactgctgtttaactcaggaatttgtgttgatgcagaccaggagttaaactgacattcttattgctcaatatctagcaagtcctcacctgccaaacttacacggataaagaaggcattaggcagcagcagatgaccggaaccgccacaagacatcacaaacattacattgtaccgagtaaggacgtgtaaaaaaagatgtaattctctactgaagaaactattagcacctaatttaacttgctattttttctctatgagctcagctttggcgaacaaaagaatgcaggctttctctgagatgcaaactgatgctgatattgactcaaggcctagaccttatccctcaggtgcaatttcttggcactcagcacacaattaaatcttgatataaagtacctgcactaaaatggttttttctcttcagcaaaaacccttttctggcatttggcttcagagaaaaactccaaaaccaatggagcacgccaatctgaatttgtgtaagcatgccagctctattttgcctattgtgaagttggtcgcttactctatgattcttcctgtgtaattctgttgtctctatttttttcagcctagaagaaacaaaggctacaaaacctgcatcgagaggttttccaccattctatttaattgcttttattgcttagtacaccccagtagtgtgatttactttcatgattggcactgagtgtatcttaggcagacttctggatagtttataatatttgtacaggtggctaacacctcatttggaattgcttttgtttcaggtaaggaaccatcaacatctccattgcccaagcatctgcagacaaacttggccagctctgattttgctatgcataatgttggcatgaaggtaaacaacttgatgagtggtttaagacctgactatttttatgctgtaaaacttgcaaatgagcatta

SEQ ID NO: 24354 - DNA, 298 bp, Oryza sativa
ctgcatatcacttgctgtcaaatggttgtgttcattttctgcatctggctgctaggatttgagtacacgaaaatgtgacaatcattgggagtctgatctgatttcatatgcttatttatgtcagggttctagacaacttgaaggattatgctgtgagggctttggtgaatgcggttgaccaccttggcacagttgcctacaaactgacagacctgtatgaacaacaggcttcagaagtttccactcttgagctgaaagtagcatgcttgaaccaggtactgctgtttaactcaggaat

SEQ ID NO: 24355 - DNA, 10811 bp, Oryza sativa
  unsure (1)..(10811): unsure at all n locations
aagaatagcaaaattttaaacatgtaattaaactaggaaaattacttaattataacttattgtagttgaaacaatgtattaccatctctgtctcatcctttgcttccactgtatctttcccaaggtcgttgctctcttggaatatgcgtaatccatgggataagctgtgaaagtgccatgttagcaaaagcgagataaagcaacaatggaccacctcaaactcaaagtaaatttagctaacctctccgaagatatgacaagattcccgtttctgtatttagggttcttgttattcatcagatggtaagagacagatggggttataatttcttctaagtaagccacaatgattttacaatcatcatctgcattgatcgagctcaaatcttcacactcaagattgttttctgcgagcacttccgcgatgtagttttgaacgacttgattattgttattattcgaatcttcctccatctgggtcttccatttctcaagaaggaccttgtctttgggaggctttgtctccagaatacaagggaaaagagcacacacagattcttcaatatcttctctatcctcatcatcatcgaggaattgtgaaccaatcacgattacccgtccagatagttttttcaacattttctgaaacatacagtatgctttttctgaacttccaagcaagtcatcaacatcccttatgtaaagaatgactggactgatttcagaagcagaaactataatctgcaaaagccatccatatcagcttgtacaaatagggcacgtaaatttggactatactgctgaataactgagttaccttgtaaagggattgtatgagaaccttctcattcaaactccagcatggtttaactgatgctgcatcaaaagagagggtgatctacagatagctaaaaactaggcaggttaggataactgcagatttcagttggaggaaccctcatgggcaggcacatttgaatatacaggtaaatgaggatgttgggttgtctgaaactagttgaagctggcaacatatgcattatacatctaatgtgcacatgtgcaattggggcataaataaacaagagagcataaaaaaatggatttcactcaccaaggtatttagaagattcgggatcatggtccttctcgggaggtaccaaggataactgaacccgtactgaaggtgtgttatgaggacaacaagtgctgcaaaagcaatagcataaaatgctcagaaaatcaatatctaatacctctagttgcatatccaggcagagatattacctagtcctgagatcaaggatgcctgtttcacggctcaatggtcctacattagtgtttcatgaagacacagtcagaacatcagaaaagttggagcatgggcatcgcttcaaaatcatgattgagagaaagaaggataaagcattgcagaaagtaaacaggcaaagaaacggtgagtgcacaacaggaagaaacagggtacctgttccagttggttcttccttcttgcgaaacagattgaaagctccaaccaaactagacactctatcgaaggctgcctctgtcatggatctctcacgggtctgtgttatgaacagatcagaattgattaggtaaatcatcagacaaatccacgccacttcacaaaattgtaacaaatgctcctgttcgaaaaaaactgcacattcagcaactctactagctaaattgttcagtgtggacagagtagactaggttctatcctcctcaagtaccccgtttaagttgtgcagaggccggaatcgtaaaacgctattccataatctaaagaaaagtacccattgtttcaacagggacaccatgttttactttgactcattaaggaaaaaaaaaaggccaaactgataaacagaaatgaaaatcctgaatttcccatgtcgcttggtatatcaaccaaatgtgctatacaagatggaactaccagttaccacctagaaaaagaaggcagaaataggatacagacctgtgtattgcttggaccgccgtacttatgatggagctgcaatggcaatcgggaaaagaacagtttaggatcataagaggccagggcgacaacaaagctaaaatttctcaaattgcatctaactgaccttgcacgcgaagtcgatgacatcgagcagcagcaggcgagcactgaactggtttgcgagagccttcgcgagcgactgaaggtacgcctctgcaacagagaaacagcggctgtgagaaaaaaaaaagatcgcgcttttggcgaaaacgaacaacgcacattgcggttcaggaagcggagggcgaacctgatgggccgcagagcagtatggtgcggctggacgcggagaggacgcggatgtgattgggcaggatcgttgggctcagatgcacgaacgccgtgctggtgagggccagcttcgactgctcgctgcaagaaaaccatgggaaacacatgctcaattagccgcccttcaccaaacaccgcattgatttctactgacgacgcaacgcgtatccatgggatcagtaattaaatcatgtgatcctacccgaaatataccagcaaagtcataaactaatcgataaagctaccggtcaaaataagggaaaaaaaggtttggttttttttttccttctcccacattggattggggggtttttggctctgaggattcgcatcgacgacgggacgaacctgaggtagtacgggaagtcgtcgaaggagacgccgacgtcgcggccgtccaccaccagacaccgcagctccgcctccacctccgccgccgtggcgccgccgccagtcgccaacccggtcagccgcgacgagacgaggccgatgccgacccccaccccgacgcccacccccacggccgacgcgatgatgctcccgtgctccatgtgtcctcctcgttcctcctcccgccgccgccgccgccgccgacacgacgaccacacctacgcggaagccgacttcgacagcggcatgcaaaactttcaggggcgcggattcggtacgggtgcgatcgaacggcacagacacggaggggcggtatttatagagaggagggttggagagagttcgggtcggtcccgtcgcgtcgcggccaggatcgagccgagcgagcccacggcacggggcacggcggcgtcacggggcaggagggggtggtgccgattgggattgggacgcctcgcggatgccgatgccgacgcggatttggcccaaaaaaaagaggggtgaaatttccggtgcacaaacacctctcggcggcggaatctcgttgtcgcggatcgagtggccgattcctattgtttatttctattatttcgctatactagatagacttggtctatgtgtaaaactcaagtctatgtaaaattctcctttcatcactagggtaaaagtagcaccttttttttctccgccttgtaactccgtcatgccgtcattcgattccctctgggttttttttttctttttaatgctttctgatttggccgaatgttaacggtgacagaatagttgtacgctttagcaccacggcagattggcgaaaggcgtgtgacacttgggccttgggctgtcaacaccaccaatagcagagacgcgtgggggcggcggtattgatggatgtcatgagatcatggtttttgccgagttggggaccactagttcgcttctcgcttccttttcgagcgtaacgcagacaaacgtgcatcacggctggtgtttgaaggttgcgagatttccctttcttgctataacgtctttggatggttgtatcaagactattatgtgacactgattcttattcatcgaaagttcgaaactaccgttggttccacacttccactgtttaaccacggcgggagcaggagcgacccagcccagagacaagtcccgagccagcctatgctaatttctcagggtaattctaggcagaggtatcttccttgtaactatgagggtgtttgggagaggtactaatagtccctctctccaaaaaaataagtccctagatttagtccctctctcccaaacactctctatatatctcaacatgacatgatgagtagtcggacttctgatcctattcaaaaacatcggacggtgtttcatggtttcttcgaattgtgttagcatcgatggcaaggggtgctccctgtgcaccatctttttctgaggcagacattgtgtccctttcttaagaatcagtggacgacatggcatgatccacatggcggtggacccacgacgaggtccaatcataaccatgactagtcgagcgtgtctgaagaagaccaccgagcaatatggcgatgcgacccttttgtcacgtcattgggcttaccacccctagactctcgatggttgaatagctagctcgctcaatggtctccctcagccacacctagttagtcatggttatggttggatcttaccatgggcccattatttgcgtggaccacatcgtatgtcaatcactattaaagagatgcaaattctgtcactctcagataaataagagatgaacattacatatctatgcctgtgaagctgacatacacgctattttttaatcatctatcgtcatggatagccgcaaacctatacaataacccctgtgtatgcatggatgaacttcatttcacttccgtatttgttgatctaataatgacactacagttgcccatgacatcatcattatttttttttaccatgcatgacatcactatttcactaagatgatgtttaatagagctcctgggtgggtcgggggctttaccacaggatgaggacatgagaactgtggcaaattacgccgacaggatgggatggccactatgaagggaaaaggtgaggagggcatggctagtgtgcttctcgatgtgattaacggctaagctaatataacgtgaatggcatttaagaagaaattttaaaacagtggcgaccagataagaatactactcccgataatataacaacctaaaatcaggtgaaacatttcagagtacaatgaatttagtcacgagcttgtcaatattcattgtattataaggtagtgtttggttttgggactatgtgggatgggatagaaccatccctgatttttgagttgggatgattccacttacatgtttggtttgtaggatgggatgatcctaaatttttgtttggttgaagggacgaggggatcaacgatcacctgatttgcccccacagtcctccccatcgccggaggaagagcaagaggaagagctggcagcgagcaagagcaagagcaggaagagaaccatggcttgctcacctccccatcaccggatccgccgctgcccctcgacctcctcctcgcactccgccgccgctcctccctatcgccgaatccgccgccgccctatcgtcggatctgccgccgcccctcaacctcctcctcgcatgccgccgccgctcctccccatcgccgaatccgccgccgcagtcctccccatcgctggatccgtcgccgccgccctccccaccactggatccatcgtcgccgagtcccccgccatcgctgtcgctgtcgcccgagctgtttgccgttgctctcgagggcgagcgcgcgagtaaggcgccgtcacgccgttcgctcgtcccaggtgggacgagttcgtccaccacattttcccggatcggttggacccggatctgagaggaatattcctctctagggaccaacccatcttactcacccctcaaccaaacacccttaaaagtgggttcgtcctatcccatctcattattgcaactaaacactacctaaaatgttccatccgatcctaaattgctatattatgggacatagagtagcaacttttaggtcaaaaataagaaagcttgccaagtttgagaagaaaaagaaaagatatttctctattaaatagtaaagataagagttaaattgtctcattaaattgactatatttcaactgattaagtttttctttggtggaacataccatctgaatttaagtaataaacttgatagttgacatgagtactcgcattctgactttaccaatcttaagacacggggtctagcacccttcctagaaagacccgagcttatttggaatgatttggggggagggggggaggggggcaagtaagggtagggtgtagtattcttctctactctgccactgtttctagccaatagaacacatgtgcatacgcatgcgcacatcacacacgcgtgcgcgtgcgcgtgcacggcaatgatgagatatgctagtgagcgccggtattaaagggttgtctcatttattacaggatctattaaggtaaggtaagatatgctagagtgtctgaatttatactgatatttttagaagtaaaaaagttgtctcatttgttgcgcgatctatcaattgtttaaaggttttctttatagtacttccctaatatatgtcgtttgaggtatcacctatagaatttatgggacccatccttttgcttaagccaaatgacatatttgcaaacgaaaataatgtgtgaataaaacttttatatttatatatatatatatatatatatatatatatatatatatatatatatatatatatatatatatatatatatgtttttagcaatttaaaagcaaaagctgaaaaataaacttcgatgagaaaaaccccaaaattatatcgttgataattcaaattttgactgataagcataagcgaaaagatgaggttatgtactaccatataattattttctataatatatatctcgtgattaccagtttgtcactagaaacatacttttatctcttaacacgtactctcttcgtcgcataaggaataggaaaacttgaaaatgcgtagtacactgtgattattactagtaccttagtccttatccggtcagaaacaccaacaaaaagacatataaaagagagataagtgcgatattctgcacaagcctccgacgtggcagagcatgcatgtggaaacctttccgcaaaaggctccgacgatgatgtacagacggactccaacattcacctccaccatccaatgaagtaacaaatgcaacgaaatttcgcctgcaatcatccatgttcttccatcccaagtttacttgagggatcggaagacttcgtttgtcgtgtaggtttcacatgcgtacacatacaccgaatccctatcacctatcatcaccatcaccccgatgctatcctacagccgcccggtcgtttacctcctcacctctcttgtgcacgctaacatacaagtagcttgttttaatattacccgcgacgaccagaacacggcgagtcagtcagtcaacgtgatacggatgcgattttctcctgtagttgagtagaaaagctaggaacagagactaagttgggtgtcgtgtgtggtggagtccaccatggatccatgatgctagcgctgcttgctaatcctgcaacgtttgttcggtgcgtgtccacggttgttgccccgttggagcttagctagttggcgaccactcgatcgacatccgatcaggatgatatgtgtcatacgtggtcctgcctgcccctgtaaaaccccatagcggcaagggccatcgaccgaccggccgcgtccgccgtacgtactacgttcgtgcggccggcctgccgtctccggcaggaattctccgccgcgcgtggcgggtgcgcacgtacgtacgggcgcggcgctggcgttggcatattggcatggtccatcgcgcggacgaaaccgagtcttcgctaccgtcgctgttgcggtggggctcgtatacagttttgtgctcgtttctccctccgatcgagtgcacgtttcccgaagcaacgatcgtctttcatttggtggttgttgtcatgttgggctcgcaagtgggggcggctctgggagattgtgttctcttgggctacaatacgctgggccaccatgaaagggaggtcggttttccggtatggatccggacctggcctggctggcccagcatgtcatatggtccatggcgcggtgtgtagtccagcgaaaaccatcacccacccatccacccaccgcacttagggttagggacgcgcgtttagttaagagccatgtcactaaggaacgcgttaattaatttgttggtgaacgattgaaaagccataataacgattgcgttcggagttgcggtttgtctgtatatccaaattaagagttttgtataggttgcgtcaactagagtttggtgcccgctcgcctaaatagatatataggtgtctgtttaaatgaagtcaagcgtcaacaacaagaaactggagtgtactctctccccgtatcaaaataaaccaatatatcattggagggaagtaaaacttgatgataataaagagatgctcccctgcgaaatcacgcatgattgcaggacgggatgcttcagcacgacatggaagctccaactgattgtcgagttctcgatttaattaaacggagcacgggagcaggatatctcctaacaggacggtggtatatgagaccggaaatggaccctctgacttattatcctctgacttagagtgacttttgaatccacatattagtgacacaagttaaaaataagtaagtttgaggattttaatccctattagacgtgggacgttagctagatgctaacgaacagttgatctcaactcctcaagtcgaagtcacggtgttgtgactttgttattccctctgcttgcatcagaggatctgcgttcacggcacgcgcgcatgttcggccatgcatgtgtgcacggtgcaggccctcaggccacacgtacgcggtacgcgttaacagctcgatcgatcgccgtcgcgtgtgcgggccggacatctgattgcgaggttggcgatagatgggccgtgtcccgtgggcgtatgtgacgagatcgctaatagtttttttcccaccactttcctttttttcttttggcacatatagttttttttcaggttaatttaaagtttacgcgccaaaattttataagttaaaagtttatatattcgattcaaatttaaatttaaatattttttatatagaatatatatatatatatatatattttatacgtacgaaatttacggtatatatttataagttntatgcaagtgtataagggtattattatttatattttattttttaangtgttatttaataatnaatggngnangaggaggaggagngtgggggntaggnaagggaggggggagggggagggggagggatcgctgtgggtgatcatccgcctattagccctctcccgtacgtgaggcgtggactagtctcagcccgcgcgctcgtctccacgagtgtttcggcagctctaatgtaacagtctatactatagtaatggtggtgtctattctcacatcattcctaccattaacatttggctcccataatatatattattacaccctttgaacaagtcctctctcatttcattataggctcctcaaattttaaaattatctacttgtataataagaaaaatcatagtactactaagactaaataagtaagctagaaacttaatttgttttctgttgcaactcacggactctaggcttatagctaattaacgtacccttacgtcacgtaggatcaagttatagtgctttcacagcctactatatagtccttagtttttttaaaaaatgtgtattaaaacttagtccatcctatctaacccttgaattttcactaaaatttgagacctatttccacaccctaagtacagtatgcacgcttgtccattctccctactcatgagggagggacacagtagataacggtatccatgtcgacccggtttaagacttaattgtttgacttatgcttgtgcttttaagctaaattttgaattttacaacttaattttaaatttattcattttcttatcatagtttattttacaatatttatttttgagtcattaagaacacgtacacaaaagtattactcgcaaatacttttttatttgctaataagctgtttagagcatcaccaaccgtatctctatattctatccccaaataatttttatgggaatcctaaataaaatttaagatataaaaatagtgttccctcaaacagacttgctaaaactgacctcctaagaactaaaaagtggacccatgaaaaattaccaactgaaattggcttctctctccctcccatgagatcataccagccacgcgtccactgatcgtgctagatcaccgatcggtgtcggccctctctatatgatatagcatgatcgatcccatccagtggcgtagctacctaggtggcactgtggtccatggaccacctaaaaattttatcgagattaaaactatagtatatgtgctagttaatataataaaaattatatagtgtactacctattaaattgacctattacatatagatggaccacctttactctaaattctagctacgccactattcccaactccagttcccctgtagcttcccttgttctctgcatgtcttgtgtcttctgctccttgcccttgctgggtaatcttcattccccttcaaaggaacaaggaaagatagccaaatgctatggtcaaaaccttaacacctataggaaatacatcaccatttacttcctttaaatatttgtgttataatattcttgttcaggctgcaacttgcaaccatcaacaggtctgctgttcctccctggtctttgtcgccaaagttaattgtttgattaataagatgcagctagcacaattgtact

SEQ ID NO: 24356 - DNA, 3352 bp, Oryza sativa
cgcgtaagcttttcaaactgttaaacgatgtgtttttttaaaaaagtttctatacaaaagttgcttaaaaaatcatattgatttatttttgaaaaaaagctaatacttaattaatcatgtgctaatggactgctccgttttcggtgcagatattttagttccaaactccccacagcgaacacagccttagatactcctactctatatccattcagttttttttctttttgaaaactataaccattcgatcaatcagcgattcaacggttacacgcacaagtaataaagaaaacaacgtacgagatctagtactgcgtacatacacggagttcccaaatgtttggcgatcttatctgggccgtgctttgtggacgagagcaactattcagatgtactctcttttttcttttcctttggaatgccagtacaaactttatatagcgtgaaggaatcaattgggctgtgtggacatgagtagatcatgggccgtattcgccgcactctgttggtactgtggtgcatggctcataagcttgccagataggacaggtgagaacgatacgagacatcacaactcgatcgcaagttggcgaaacgaacggtggaatgggcattcgaattagaggtggagcatgcgcactacactaaagtgcaataagctccaaactaagtaacaggctcatcgtttgtcctatactcctatatgaagtccaggcgttgctaaaaaacaaaattcaaaacttagctttgaagttgattttaggatgtttttcacgtagttttttatattaccttttaagtcaatcaatggtacatatataagtaagtcattggtttctaatcaactcatggctaatcgatggggcttttgccgcgctgtgctcgcctagtcgccttgccgttcatgcgttcacggttggagctttggtccgattgggtttcacatctttacgcaagttaggtcatgtttgtttcagcttataattattataatctgaattattagaagtaagctgaaacaaacaaatagcttattatctataaactagattactataatatgataatctactctaaaaatgtttttttaattattggatggttaacagctaacaaacatctaataagccagagaaacaaacagctaacaatttattctatatcggcttattataattcagcttatagtaatttggatcaataatctagattacaataattttaaattgaaacaaacagtgccttaaatgtagggccgggttaagacggttttaattatttgaatcgaatttgtggactctaaaatcctcacgtgtaggacggttctcaaatatgaattcagtaagatcccaggacatagtagtactagtaatttgttattaggtacttgagttattttgtaattttttgaataagacggacaattaaacgttatacatagaaacccacaactgcacttaaaatgagacggcgggagtaacaaactctttgaaatattggaatttcaaatgtcgatgaaaattgcccaaaaacctgtaagagcaaataaaaattcaattaatgttcccagaggaatctattctgcacgctaagaacatattctgcacggtcagctccagcacagtggcacagcatttcgcgtaggcatgaagtcctaaaatactttagtatttttcatcttttaagacatgactaaatctttttcatacccgttcagcatggataaaaatcaaagtctctagaatcttcaaggctcccaaaaggcacgacggaaaataagcaaaaaggtggtaaaaaaaaagaagaggatgcaaggaaaaaaaatcctcttgaacctcggaacgtgccatgtgatgtggaccgcaacatattgtgttccgtaccggcgatgtgattaagatggttttaggtcaaaattaaggggcccattccgtccactacgtgacgtccagatcagaggagatcacgcacctgttctcgtgttggcgtcaccacacatggaaaaggagaatacgagtatcacagaataaaaacgagaggactaataaatagtttactgttctaaacatggtttattagttcgtgagtaaatgtaaacaaatatgacccagagagcatcacttgttggaatttggaaagtggcttgactagttaagagctatgacgtgcagtactatcggattcgtccaagtctctctctctgttttttttttgggaaaaaaaatgggggtaaaatgagtgttcgatctgtagtacccaccgtacgcatagtcgtcagtgtgtgctacgcgtgctacagcggagactggaaagttgcacgctcaaccgtgtgacgaccgtaagtcttcgggacccaggaaagtgaattggattactacatcgatgatgggagtccaggaaaaatctgttcgataaaaaagaattggccactctctgttcgccagattgtattaggcaggtgaatgtaggtacaaagcacatattccaatcgtacgtatctgcaacagcattacaggtgcaaaggtggttagttctgggtaattttgttcgattgttcttcttttatccttgtaatcaagttgcaccgactgaacagatatgtacgtagaccattatctaaagacaaaacagataatgtagacaatgcaattattctggcctctcgatatatgcctcaatgtactaccttgctgctagcgatggatctgattaaaatgattattttgtgctgtttgggaattctcggtgatgcctcacatctcatccataataaatttctcggtactaccttgctgcatgctgaagtctgagtactatactccgtacttcataattcataaacttcattggcagattaggtcatagacagcgaagcggtgcggactacagaaacatatacagaggacccatgtcctataatcatgcatgaaaggaaccaatcactggtggagaagtgctttttagttccggttcgtaacccccctgtagtcccggttttccaaccgggactacgaagctatctttagtcctggttcaaatcgatctttagtcccggttgcacaccaaccgggactaaagattttttttcttttttttctgtttttaatattgaatattgatttcacaccatcccctcccatatccaaatcatcacatatcacagaacatctccaaatcctcaaatcctcaaacaaatcatctccaaatacatcacaaactcttaaaaaaaattatatcacagggttctaaaaaattcatcacagattcacatctcacacaaaaatgcatcacagatgcacatctaaaaaaaaaatccggccggcggccactgcccgcctcccctccgcgccag

SEQ ID NO: 24357 - DNA, 28195 bp, Oryza sativa
ccgcgccagccggccggtgatgcaccgccgccaccagccgccgcgccggtagccgccgagcggccccccgggctgccgccgcgcaggccgcctccgcgcgggcccccgcgccggccgcccgccgccaccgccgcgcaggccacctccgcgccgtcccccgcgtcgccgcctccgcgccggccacccgccgctgccgcggcgctggcacgcttctgcaccatgggtgaaggaaaaaaaggaaggagaggaggggagttagagataaggaaagagataagaagttagagaggaaaaaaagagatagagggaggagtttgttgtgtggacgggaaaagaggatcggtactatggattatatagtgtgttttaatttttattcccggttagtatcaccaaccgggactaaaaataggtttttagtcccggttggtgttactaaccgggacttaagatcctagggccctgacacggcctgacatggaatcaaccgggcctaaaaatgaactttagtcccggttggagttaccaaccgagactaaagatgatttttagtcccggttggtaacaacaaccgggactaaagatcttcctcttattaaccgggactaaaaattatttttagtcccggtttttaatggaaccgggactattgtgaatttgggtcgaccgaccaaagatggtttctctaccagtgaatttttagtcccggtttttaatggaaccgggactattgtgaatttgggtcgaccgaccaaagatggtttctctaccagtgaatacgaacggagtagaccaacacgagatagcatgtgaaggaaaggctagagcgcgagtcgatcacgaacggcatactacatcacattgtttttttgtccccggaaagagaagtgaaaaaaaaagcggtaacaatggttaaaaaaagaaaagaaattaaaacagaatggacggaagttgctttagggctttatttgtctagtctatatctacatttatgtatactgatatatatcccacatagatatataagtagagcccggccagaactatatatatatttcatacacatgtcacgtaaagtcgaagcatataaggtcatcatatgcatatattggcaaaggttaacaaggtgatatcgcttttctattcaattctacaagttgatcttttctactctcaagaaaaagttgatctttattttatttagaatttatcaaggaaaagatatgcggagcgttgtgcttaaagaaaaaaaaaaggaggagctttaatttctagtaggaggtttagcgcgctgtccacttgttcagggttcatttaggatttagatgactcatgctttgtcacagtgacatgtaattaaggtgagttcccccaattaaccaagcaaatttgtgttagataatgaaattcatccatgctttacttaaaaaatatatataaccaattattataatataggttgcaggaagaacgtttatcaattacaaaactacgcggcttaattaaaaaacaagaaaactacaaagcaaatatatatatatatatatatatatatatatatatatatatatatatatatatatatatatagacacacacacacacacactaaaaatacgtgtatgcatggcatcaggaacaggaatcaggatgctgaaatattggcacaataaactatatctagtatttcagcatgtgacagtatgacaagtttacttttgagaaactgattcctgtatttaagcatacgtatggaaatacaagtatttttaaggcaaccatacgtgtgtatattaagcatttgagaaattattattgctcatatttccaaaagttagattagatctgattttaaatgttaaatatttataactagatggagtatcacatttttacgatgcaaatggacatttcattacacataaaaaaacaagaggacacaaaaatatcatggtccctagtgacagctaacactcttataagtaagatgaaaaggtatatagctctccataattgcgctttcaagaaagacttaacgtttgttgttgatatcattcgaaccaacctaaaattagtaatggattttcgtccataggcctttaataacaaaataacaaataaatgataatgccgtcaacccagataattaccagaccggtatttctaccccactcagtacctcgctaacatccacgaacaaagagagcatgttgatatcttccgcccaccataaagacaatcaaagaaaacctcacgcaatcttccataaccatcttagccactttgaaccgacctcgagtaacgctccaaataatgatggagggcaccacctgtgtagttacctctaaatgattgtcattggtttggttgtttttgtagaatcagaacccaaacactaactagcgaagtgcttcactcgccaattcacctccattcaggcctaggcggatcgtgctcgatgaaggcactttgaattttccttgactaatatttcaatcataaaccaaggcactacccatacagttgccttcgatggtaattggttcgtttcttggtagaggttgagcatgaccatatactagcgaagagcttgactcaccaatccacctccatttaggcgtaagccgatcataagtgctgatcaggcgctaccattcccttcgatcatcatgcacgctccgatggttggagcgagctccgcatctccatgtgcccttgtcgatcgaattgagaggatgccactcccatggatgaagaaatcagtaataccattggaaccctagagacaatgatgttaacggcaagagaatgaggcactgatggcactaggttggctattgtattgagtcaccctaccgataagtgatgcaggagttgtaactaacatacttgtcactacatgcatgtggtacacattgacttgaatacttggcgacatatctttcaatccgcaatcataccgaagtttctagtgttttttatttaaagggactataaaaaaattgccgcaattttttttgaatgacaaacttttaaatgtaacatagttgtaatataattcccccgcaagtatactatactgacaatataaattaatataaattgtatataagaattaaaaatatatatgcaattttatacgtaagttatacatatatgacaatatagttacattgtagttaatataaatatagtgcaattctagtgtaacttactacaatataattacactgtagttacatttgaaagtttttgaaaaagaattcaacagttactttttagcaatttggttatttaaatttgcatctctcacataccaagcttacgtacctgacgagcaggggcggacctaggggtttgccggttgcactggcatacccaattttttttttggaaaaacactaggatgtagtatgcaatcaaaggacataaaaataaaatcctaccagaaaatagaatataacaatgatcacgaatgatcatgaattgtctggagattttgtaatcgtcaaaaaaatcaaatcaagggaagagaaaaggactagatgaagagaaacagtggggaaaaagaaaaacagctagatagattaggacatggattgattgttctaaattttatagatttttcatgaatagaactttgaaaaattcgatcaaaatctgccaaaattcttctatcagaattgggtgttttcttttaaaaaaagctagcatgatggcccgcagattgcgtgcctaggatcgttatctttttttctcacatactaaaatatatatatttcacattttattattaaaatatattaaaaatgacaacataattttaaattatgtactaacttgaccaaactggccaatgtgtaatatttatattgtattgtatatgcgtgatagttattaattatttttaaatttttaattttagttatttctaaattgtattcttatatatactcttagactcttttggtattctttatttttgtgaaggtaattatagttttgtgaaacttaatcaacttgtttttactactccggaaaatgcattagtcgtgttgcttaaagccatcgagaccattagcctctccatgctgtcgggacaggcggcctagatgtgatcgctagtcaccccttcagtggtgcatcaatttagttcatctcaattcattgatccctctcgattttcacactgctgtgtatgaccattgttaggctggtctacatgaccgagagctaaacctgcttacaaaactgattaaatctcagccattaatctaaactgaccataatctatagtgcttcattagagttttttaatcccatataaatctatagtgcgattggtttgtgtttattttgtttcacacggtttccaaaaattatttgtccgtttccacacaatcctataattatatatctttggatttttgtttattcttgtccgtttcatattctaatcctagtatacttaggtttttctattttctaggctatgagagcgaacgtggggctctttttttcattactttaattagttaatagatatatggtagcgtgatcgctagaatgagcacacccagtataattttaattttctgggtccgccctgacgagtgatgacaaaggtcacccattcacgtgtaactgtgtaaggccttgtttagttctcaactttttcttcaaacttccaacttttctatcacatcaaaattttcctacacacataaactttcaactttttcgtcacatcatttcaatttcgacaaaacttccaattttgacgtgaactaaacacaccctaagttaactcccagctccccgcaagaaaagaaaaaaaaatcccagctagcttattaatagtgtccatttgccgagtcaaaaggttgcaaatataccaccacgatccctacgcaagcataccggccggaccaacgaagcgatcgtggttacttgccgactattccatcgaaactgctaatgcgcgcgatcacccggcgctctcctccccctataatccctcttctcccctttcctcctccccttcttctctttctacaccataaaattttttaaaaaataaaaagttagaaaaatttatgtatagaaatactatatataaacaatttaaattcaaattcaaatttgaatcaggtatgtaaacttttgacttataaacttcgggtctataaactttaggtgtataaactttagatgtattgaaatactatatatagataatatttgaattcaaattcaaatttgaatcagatataattcaaattcaaatttgaatccagtatgtaaacttttgacttataaactttggatctataaactttaggtgtataaactttagatgtatagaaatactatatatagaaaatatttaaattcaaattcaaatttgaatcatatataattcaaattcaaatttgaaacaagtatataaactttaggtctataaaatttaggtctataaactttaggtgtataaactttagatgtatagaaatactacatataaaaaaatatttgaattcaaattcaaatttgaatcggatatataaacttttgacttataaacttttggtctctaaactttagatgtgtaaacttgaggtgtataaactttaggtgctaaaatttactaaaataggaaagtaaccttttctcattcgcatgctttgatttgccgaatcaaacgctagcttaagacaccaacaagaaaggcgaaacgcaaaaacatctgcgccggaaatttccgatacggaactttctccggaccggagaaaagcgcagagtccgggccgggcgccgcgcgccgaaacgctagaggatgagaggttgctgtccgctcgacccactgaacattcgatccatctctctgtctctcccacccccattgctcccaagcatccgacgtcgaaagcgtgtgagacaaaagcgtaaaaagcgaagataaaagggcacgaaaagaaacggaaagtattttgccgatccatgcatccatccgcgcgctagtggtgtagtgttgtacgtacgacggccgtgtacaactactgcgcacgatccattctcgagtgcgcgtcccattccggcgaaattagcggatagcattcatggtaccagttcttcgatctcctgcggatgagcatgggattcatcgacgagacgcaaagcgccaggccaaatgccggtggctgtctgcctctagctcgcgcttcggcgcttgtcgttttaccggaacgcgccgcgcacaaggaatgagtgcttgatctgccaagcacgagtaaatatgggtgcttgatctgccatggctgtgtttagtttctttcgaagttggaagtttggattgaaattgttacaatgtgactaaaaagttgtgtgtgtatgacatgttgatgtgatggaaaaagttggaagtttggattgaaagtttgggttggttgtgtttagttggatccaaagtttagattttagttgaaattggagatgatgtgactaaaaagttatgtgtatgataggttgatatgatggaaaaaaactgaagtttggatacaaacttttagatctaaacacagcctatatctaccgttgttgctaagtacgggtgtacacaccactgaattgcaatcatatctgaaggagtggtcccactcctagcccagttcgacgcggctgtgtggttccagttcaacacggctgtgtcagaaactcgtcgttagaagacgcggcccgggcccaacgggcaggttcgatcgtacgcagaggggacctaccgtacatacggcgaccacaggtatcacgtgaatacacgccattctacgagatagattggatgaaacatgtgcttcaccatcgcctgtaggagtatgtgtacacacagtgtgtgcactccaagactcgcctgtcggtgctatccccgactcgcaatctctctcgatgatcaagataatatatctatatggcatatacacgcggccgtcgtcgtccctgaaaccctccggccgcgacgagggcagcggcggccacgcgcaaacccggccagccaccgctcgacgcgcgcctgctctttttcccccgtggaaaaccagtcaaaaccacgtacacttttgcacctgtaacgcatcacgatcgaggaccaacaagtgcgacgtgatcgatcgagcagcacgcgcgcgcgcaccgggccgcccggccggtttagtatatctcgtcgcacgaaacgctcagggttcacagcccaaaccagccatcaagttgtggcgtcgccagagattgtggcgagagaaataatcgccacagctgtggcgaaaataagcatacaaatgaactagcaaaaagtgtggctgccacaactcacgtattaaccaaacatcagtcaaactgttgtggcagccgcatgtttggcgaggcaatgtgtggcggggatccaaacaccagcttggctgtcgatcgatttctcgcgcgcgacgatatacacgccgcatgggctagtgtctttgtgccggccgggacgccacctgtccacaaccctcgcgaccgaccctcacctatacgcgcacgtatctgcttatcacctcgttatcctgcaatatctgcagaaactaacgttggcattgtagtactccactagtagtactctattactgtatagtattattattatgtttgtgcggtcacatgcatcttgctacccatgcatcgatatatatgacgttcgattaattaattaattgagttttgtggcacatgcatcttaacttgtttactgatcgatcagatctataatatatactcatcctccatggtgcacttacacgtaccggccgttacacgggatggaaagtaggctggaagtagatcatatccatcggatatgcatacggcgtcgtcatgttttgatcgctttattatactcccattaggttttaataaatgatatggttgatttttatttgattattcttttcatttaaaaatgttacgtaaatatgaaaaatataaatcattcttaaggtaccttcgatgaaaaacaagtaaaaaaaatgatatgcaatatttttaataagacaaatgatcaaatatatgtgtaaaaaggcaactatatcatctatttatttaagactaaatggagtatttgtacatatggttaacgccacctgtttttggatttcttaattcatgagttgcatgattaatcttattccattatttatgttgaatggtttaaattgtatcaagatccctatctcactttgtaaccctatctcaatccatttcctccacccgttgctcctgacctagaccccaccgctactcatcgtagatgtgcacgtcattcacgttgactcacttcgccttgcaagcatgtatcggtgccaacaagacttcatcgccaccccattctactatctttcatatacttcctcttcctcctattccgtggcgccaccttcaccctctaatagtattggcaggttgtcttgggctacctcaccacccacgcatctccaacagctcgcgcggtcgagggagtcaccattgatagtgagtattctcatccaccagctccacttttccatgtcttgtgcgggaggttgaagatgagtccctaaccgttagatatcaatccaacagctagggtgcaagtcactgagatctgatttggcgaaatattattatagacaaacgtattactaatgaatgatttttacagtttttagaaggtaccaaaagataccacattttatagcgtaaaatttagtatctcttattatctttggtattaaaaaataccaaaatttgcactacagatattaatacttcttggtagtacctctcaagcaaccgtaatgtatcctactaaactagataataatgtgggccaagggtttaggtggtaacagttattacaaagctcacaatgtgctatgcctattagagcaggtacaatagcaaattattagctggctacaaatatattttaatgagataaaagatgagagagaagagcagcgggctacagatctgtagccagctgcagcatggactccaagacacaatgtgtgtatgacaggtggaaccatatactaatagtgtagtaagcaattattggctattagattggctatagatgaattggagatagtagtgggttattatactattaaacttgctcttatgcaagttaaggtggggtccatcttaaaaagaatcattgttaaactatctcttctaaccatgctagcacaaaaagattcacatatctaaaaaaatattgttctttattttgttaccggcagtagcacaatagcccagtagcagttattgtctctacccacaatgcatcttaccttcttttgtttaacattgtggtagccctaacacacactgtacacctgtaggctatagccagcttgtccaataccacatggcactttgatcaccccttcattcttactttgcatcatgggtttgcaccacccaaattgaagtttacgtgtgattccattacgatttacccagtcctaatctaaaattgccctttattgatttgttaaagcaccggctggtcaccacaaatgtgaatatatattggtagtttaaagtgtgcaaaaagcaggggcaagcaaaccagggcctaataatcacctaactagttgaggtgtgcatccacatgcacggaactagtggtctacatgggatcccatgcagacatatacgatgatatttcagagaaagaataagatggttgattaattaaactaccagcttcatatatagtagggattaagtaagcgtctaggctgctttgatcctggtctgtttcggtatgtctggccagtggccaggttaattgggtcgcccacttcttgttggcgttgttgggtcagatcgattgctttacctgttctggccgggccccggtcgtatcgtagctagcagaatgggagcgagacactagcagagttcacaagatcatggtataaaccgcgcgctatataagccggtcaactaaaaaaaatcaaactaaagtaaagttcaatttttttaaagaagaatatctgaattttcaccggttttcatgaattctgatgaaaccactaagtagtggttttggatccaagtaatgactttgtgaaccctgaaccagtaaaaactaaggaatttgtctactacgtaatgaaagctctttcacattgccaacatagaaaataaggagaaaactcattgattttatggagactcctgcatggctgcatctaacacacacacgaaaaaaaaaacatgcatgctgtatgttcttcacatctaaagactgctagtaaacaatctcgcatataaacatataaagtcattgttttacttattctgatactggtgaaatcaattatagtctcttaattctataaataaaaaatataaattatttattcaacgagaaatagagaaaaagttactcactccgatttatattataagtcggtttgatttttttaatagttaattttttttatctttgactaagtttataaaaaaacatagtagtatatccaacacaaaatatacatataataaaaaaaatcaatgttacattcaagggtactaatttggtgtttcaaatgctactaaatatttttatgaatttagtcaaacttaaaaaagtttaattagaaaaaaattaaaacgacttgtaatatgaaacagataaaaggcaaccgaaaaagctttcaaccattgaaccatactaatgcaacacaaacttatcaaatatttcgatgtggtcaattttccacgccaaaaaatccatcaaccctactccccagctagctgtacgtacgtgccatctttgtgcaacgcgcaccaggcgcggccttccaacttttggccaggtctgcagcgcctgaccactgccgggttcgggggccatcaggcggacgcccggtcaggtgggcgatcgacacggcgtccctggcgccgttccgtgagcgagccgccttgtgacccgatcgacagatcgactgatgaatcgcacgaagtggttttcggtgactctctttcggtcgggtcttgagtcaggcgcgtcgggcgcggcatgcgatcaatggcaatgtggcttttacaatgtcgtgtgctttccggccgtctcggtccaactgcgacggccggccgcctcttccgccgtgctggccgcgccggtatgttggaaaggtgccggtgcactagctagctagtgtggttaattaccatcggaaagcagacacgatttctcatctcaagaaaaaaaaagaaaagcagatatacattttctcatgcattttcacacacaccatatgcatcggtcggccggggagaataaggaaaaggagaaaacatttcggtgaattttcacaggatcatatcaaatgcacagtcgtactgttttttaacgaccacatgtgtccaatctgttccttggaatttggttccattctgacgtgttatatgcgctgaagtacgtactccccgtggctgttacgtacgccgcactagcacatatggttcgatattcctgttctaaacttcaacaacatcctgatttttcctcggttttcgttagcacgtttttcaaactactaaacggtgtattttatgtgaaaattttctatatagaagttgctataaaaaacaaataaatccatttttatttttttttaataattaaaactttattaattatatgctaataacttgtctcgtttcacgtgcgcacttaatcttcatccctagctcccaagctagggctaaccatgccgggtcggatgggatccaacttgggctgaaaacgggtgtttcccaggcaaattttcagcattatattgaccaccatgcaacatacaaagccaaagctaggctgcagagtggcgccttttggaccggttctggcgcatgctaattgcaagctagcctcctctcctccgggaaaacccatgagccggacccatgcccatgatcgaaatcaatcgatcgtagctagcctccccacttgcaacagttgcggtgcacactctgcagtacagcacgcagtacgaacaccaccttttacacatcgctccacgacgcacttgagtactacttggcggtgatcatgtcaggatcaccgatgattcctcttcatcaaaaagaatcactgatgatgataacctttccttggccctatgtccgtgtccaaccgatcgaagagcgatcgccgatcggaattcacctgcccgagtagaagcctcgtcgcgagcacaggctacaggcgtggtagtataggggccggggctagatcctgaccgttcctacatggcactagctcagatcacaaagtcactgaccaatggccgctgacgaagatggtggccactatctttgccgactggctgacgcatatctcccgtagcagagggccccccatcctccttttgtgcgtgaggtaggagtagatcgaaggatcggcaagcatatggctgccatcgtgcacgacctaattaaaccatccctccatcccaaacacacatcagatacacaccaccatacacgtcgagaccagttgtggtaattcaatttctcctcgtcgttttaagttaattaactactttaattagttcaccttttttttccaagctaccctataaaaacggcggcctgtctcgagctcccagagtgcgagaagcactacgaccactgcctagctcggactagctagctgccttttgcttcgcttaaatctttccgcattcaccgcgaaataatcccatccataatccggcatctctctagcgatctcgcggcggcgccggcagcagctagcagcagcagcagcagccaagaactgcacacgcagccagctaccaacagcggggcaggtggtcgctgatttgtcgtcgaggtcgcgtcgttttcgcgcatctggcgcgcgggcagggcaccgcgccgtcgtcaacgttaaccgcagagcagcggcggctacgcttggaggctagcggccgggcggcgactagccaggtacgtacggatatacgccgaagtatattacttactgacttcattcattccccagtttttctaactcctctgccgctaagctagctatagctagctaatttatctgccgtttgcttacgcgataagacatggacgtgaacctctaatttatctgtggtatgtattgtaccatacatgcatggctagatgaggacggcccccgcttgtcgcttgccgagttctcgatttattagtccgttttcacaaaaggatttggtcggcttgttgtctgtttgctcgatcgtgctgggtttacttccaggctctggagcctagttaagtgtatcgtacggcaattgctcttaagttaatcccgtgtcatagctgtccacaactagctgcgtacgctagcttagctagtatagaagctacggctaccactgatgtttatatagtgtacgggtaggtgatttttttgttgctactagtcatgtttcagatgatgtagctaggtcgatccggagtatatatttgcttggttggatctattcagctgctgaccttgctcccattgtcagctaaggaaaaagaaaaaagctagccctccgttcttaaagataaatatagtatttctaggttatttagtaaaattcaaagttaaaagagaactataggctaaatttaaaattacatgatttttctcttttaagcacttgattggctgaaaatgttttggatatccggaatcagcgtaaataaaatactccatatacttatttgtaactaaaaagccaaagcactagcaaactactaagtaacttctaaattagaagcctaattggtcccatgctggcttttgccgcctaaaataacctcggcaacaatatttaatgagaacgcacattttcaattttcgactaataaaatacttaagtaattatattgtaagctccttggagacttcggagtctgactctgatactgtagtagtagcattcaccttgtctctacgtatagtactactagtcttaccgaaatacatagaataaattaattagagatagtagcttcacgttgtggtcaaatagtttgtttgcgtatggttggtcggagagctacgtatttttatatccgctgaattcaaagatggatcgactcaagggtccttctttcatatttaaattgatccagatctgtttatgttccagcattaaaaaatatatatgggcctgacaagtgccagcagattttaagttgcttaatcagttcatatgagtttagcaagtatacaagctataataattaataagtccccttcttgtgttggtcgacgtctatgacggtaacgtatgacatatactccatagtagatccatactacttcctccgtttcacaatgtaagtcattttagtattttccacatttcatattattgttaatgaatctatatagatatatatatctagattcattaacatcaatataaatgtgataaatgctagaatgacttacattatgaaacggagggagtagctagtatactagcttactacactaaaccatctctttttgatgttgtatataaattttgtactaagttttggacggtatatactcctcgctgatttttatgtatttgcagtagtaccataaaggagagacattggtatgtatatttttctaacttaattagtactccagggtatacatactcttcgctgatttttatgcatttgcagttagtaccgtaaagaaaataaatcggcatgtatatttttctaattaacttagtagtactccaggtcctatgcattggagttcatgtgtgccacttgtttttcaaagaatgcatgctggaattccttcagcatatttaaatattggtcacacaaaaactgcgacgtgaatgtttggagggtcatttaggaacaaggtacagattgaaaggattggttcatgatggatttggaattccttgttagactgttgatttccttctagagcttgcaacattttttttctctatttccacaagtatttagtggaggaagattacagacctgtccactgcatcatggaacacacaactatagactattaaggtcgggtctgagtgaaagctcattcaggacaaaccgaggaaaaaaaaactgctacagtatatgcagataatatcgagtttaccccaaatctgttcttgaaaataccaacacttttaaatacaccccctcccctccggaaaaaaaacagctagaaaatgtactccaaggttaagaccaagtaaaaaagctcctatcaggacttaattaacaagattttttaaaaaaattgtgtaggacagagtacaacaactatatgctatcagaatagatttgtcccacgttttccgaactgtccttgaatggacaattaatcacaattttgacataatggcagaatgagttcacaacagacgcactaatcgtactttcacttattttcaagcttgaaatgacataagggaccatgtagccaaagactaatgaaaccacgcagcctgtccggctaaaatgatgtacgtggaccgtcgtttgccgcaggcacgaagaaaacattattcttatttttctggagccaacgtgaacccttgttcccaggcacaaatttcctcgactgaaaagttttgctattttttttcaaattaagacgaaataactatcaaccatgtacaatattccagatcagtccaaaaagcaatcacccctaaagtaataacccaaaacactacggctccggctggttcagctgcgtatcgatcataatcgaaagtgatattttctttcaaagtttgattatttcttttaacaaaaagataacttgctccgaacacccctgaatccctgataatagaagagtcagaagcagcgagatgcgaggaaagctgtcgtgggaacctaggacgatgtaaacgatcgagagaaaatatacagtgcaaaccatatatacagtgaaaacttggaaactatcgttggatcgagaaattgatgtccaaaattcatccacgtcaccttggaagttcactgtatatgtggtttgcactacatatttttccaacgatccaactgaaaacatcatcgcttagagcttcagtttctactttccactgcccctgttactgtagcagtctcacccatttttcttcgggggcggcgatgggacaccagtgcattctcctcccaaaattctcgggagagggtacgatgagtacgttacgtttgcctcggccgtcgtggtcgcgcgcgcgcctcggccctcagtttttattttcctttctctctctctctctctctctctctctcccctcctcctcgacgcgacgccccagtgacatctcggaaacgaaccggctcgcggtcgcctctcgtacccccttggccggtgcccggtacacgggcaagcagaggctacgccgcgatctctctcattctctcgcgcgctcgcggatgcacgggagacggggacgctgctacggcggcggaggaatcgtaggaaagcgtagggagcacgtggtggtggtttcgtcgcgcggtgcgaacggtcgctcgcgattggtcaaggcgggggcacggggagggagactgtgcccgactgtgcgtgggcccccccccccgaggagtacgcgggttgttgttcgtccgtgcgtgcgctctcgctcgcgctttgactcgccaccttttgtatttccacgctgtctctgcgccctcttattcttttctctcttttcattctgtaggtcactcatttttttttctcccattcttttttttccgtcttttattaagaatggtgaggacaccctgggtgccctgcttgactacttctatatatactcggtgagctgcggttgcggctatcaccttcctcagcagcacatagcaagcagcttcctctgctgagtgctgggctagaggctctgcttcctttgcgagctctttcatctgtgttcatcctcttccagttccagcttcatacatcgtaagagatcctgccgtggagtgtcgcactgacgaacagattcttaggcccaaggtaaagtatgcagaggagtatgtagtatagtatgattttaggaactctgcagcggcgttttcccgtgtttcggtgtcatccctgtcggtagagaagatgaagtttatctttgcctgcgctagctttgagaggtctaatttggttttagaagctgctctaattctagcacgggtgtccatgtcctcatgtcctgtagagtcagttctctgttcgttgttgcatgggcatgtctagctcagatatggctgtgcaagaacgacgtgtacgcgatggatagcttgccaacctacccccagcatccaggcaagatgtttggtggtgtccgggggactctcggtcacatctgggggagggtcccggttcaacactttcggtcggtccaatgctgccccgtagcttagactgcgacgttaattcgcatgttgttttcttccatggctagtttattgcgtcacatagtaacagcagctagttttccggtaatctggcggctcagggagtcagggagatcgaccgcaaaaaagtcgtactggtgatctacatattctcagcgtgatcgatctctgagattgatgtgtccgtgtgtcacaatcgtgtaggacgtactggccggtccgcctatagccggtcgtacatgttcggtttccacacgagtccgtctaggaccacacattctcatcttggtctccgggctcatatctgtaacgaaaaaccttttggaattagcgatatgtcataatgtcaaaccaagcagagccagcgacggaggccgatcgtacgttcgtaccctgcttgtccaagccgattagttattgactgatttattccggttttgatgtactgtactgtaccaggggagactgtaagatttttttttttactcctacttttcagtcaaggaggaagaagtgtcgaattttgacaagaaaagacaactgttattatttttctttttcatttttcccattgccgacggcgatgtgcttattggcggtacactgaaccttcacgaacagtggagacgaaaacggccgtcaccgtcccgtcgccgtcatccggccggcggcgtgctctgccgctccactggcatgcacccacagtagcacaccccggcgcgcatgcgggaaaggagaatatcgtagccaacgtgcattccggcctcgtgcttccccttactcgcgcgcgtctctataaatcgagcaccggtcgcgccgtgccgagctgagccaaaatcgagcccgaaactccggaagcgtacgggagaaaaacttgttgtttgcgtttagcgagctgtgaactgttttgatggtgcatgctgaacgcgtgtagagaagtagagagaaatccaggtaagattaactgtaggtaggataggttgatatggccaggatcgccatacgggaatgcccacccgtgcttcggccgaattggcgtgtgatctggtactgcggtacttgatgattacgttcttgagaaattattaaaactttgcttttttttttgttgctttacttgggagattgatcgctaaacgagtcaatctgtcgttgtatggtgtgcaggtttcgtgaacggtatggagttcggcaacgacgtccggatcagaatggacggtggtgtgtacggggagagcgagcaatcgtccggggaagccgctctcccgcggctgctgatcgaggtcccctcgcaggtcatcgacggcttcgactgcgtcggcggcggtggcgacgccacggccacggccacgctcagcgagcagagcaaggaactcgaaatgctgggcgaggagaaggacgtcgtgattagcatcccggcgccggtgtacgctccacgatccgtgtcggtgtcggcggcgtacgaacacgagggcgcgcagataccgtactccgtgtcgctgagcatgccggcgtcgccatcggggttccacttctcgcagttcgggatggcggcggcgaaggcgaaggccgtccaccgcgacgaggcccgcgtggcgccggcggagaccaggttcgacgacgcgcacccgccggcggtggggcgagtgcaggcgcactccccgcggctgctgctgaatcagacgcggttccactcgcagcccatcctgcacctgtccaagaacgacgagacgacgcggcggtgcgacagcacgcgcgacaagcggttcgaccagttcaagaccttctccggccgcctcgagcggcagctctccaccctgcgcggccggccggcgcaggagcacatgaccaacggcgagggcgcccccgagccgaacatcgccgaggaggagacggagcaggtccccggcgccgaccgctacttcgacgccctggagggccccgagctggagacgctgagggcgacggagacgacggtgctgcccaaggacgagaagtggccgttcctgctgcggttcccgatcagcgcgttcgggatgtgcctcggggtgagcagccaggcgatgctgtggaagacgctggcgtcggcgccgccgacgtcgttcctgcacgtcagcccggtggtgaaccacgtgctgtggtggatctcgctggcgctgatggggttcgtctccttcatctacctgctcaaggtcgttttctacttcgaggcggtgcggcgggagttctaccacccgatccgcgccaacttcttcttcgcgccgtggatcgcctgcctcttcctcgtccagggcgtgccgcggccggtgacggaggtgcaccacggcgtctggtacgcgctcatggcgcccatcttctgcctggagctcaagatctacgggcagtggatgtccggcggccagcggcggctgtccaaggtggcgaacccgtccaaccacctctccatcgtcggaaacttcgtcggcgcgctgctcggcgccaagatggggctccgcgagggccccatcttctacttcgccgtcggcctcgcccactacatggtcctcttcgtcacgctctaccagcgcctccccaccaatgtcaccctccccaaggagctccaccccgtcttcttcctcttcgtcgccgcccccagcgtcgcctccatggcctgggccaagatcctcggcgagttcgactacggcgcccgcatcgcctacttcatcgccctcttcctctacatgtcactggtacgtaacacttacgtgcaacgagcacactagctactacagtacgtaattaattagtattactaagctctgcatgcgtacttaacaatgtcttaatcctgtgaccaggctgtgaggatcaacttcttcaggggattccgattctcgctggcgtggtgggcgtacacgttcccgatgaccggcgcggcgatcgcgacgatcacgtacgcgacggaggtgaccaacgtgctgacgagggcgctctccatcggcctctccggcatcgccaccgtcaccgtcgccggcctgctggtcaccaccatgttccacgccttcgtgctcaaggacctcttccccaacgacgtctccatcgccatcacccgcaagaagcccaagttcagcaagatcctcgcgcacttccgctcatccagctccgacatgaaggagtatgtgctctccatctccaagccgcccagctccgactccgactcgtcggtgtcgtccaaggccaccaccgtgaccgatccgtcggtgaccagagtcaaggcggagccctaaatcgaccccaagtatagctatctcgtcgttagctgtacataaattctttaaattatgatgtcttgggacaaagatcatcgccttaatatggttggacattacgagtagttagtaatataatataatacgatcacatatagtataatatccttggagcaagttcgtgatgatgaggatatagaggtcgaacgggcagtttgtaaatctacggatgtgtgagctatgtgaattatattattaataagagaattaattttgatcattttttcctacgaccttataatatcaatcttagacctagggagagacatccctccgaacattttttataaaacaattgtgagcaatttagatattgaacacgagaccttagggttgaaaccacacatcttttgccactacactatcaagtgcatctcaattttggacctcaagcttcttctttttaacggacaggccattaccgacgatttatattaagaataaggtgtcctattttaaggagtaaacgagaccaaaccttacagtgcccagttaatttgggaaaaatgagcaaaccataattacaacgcctcaccaacagctaatctaacctaagctaccacgacggaaccgacacaaggcatctgccaagtttgtcatagagacgacacaatagcccacatatgttatcgttgccaagcttgccacccaagcgacacaacagcttcgacttcactgcaatgctactccaacgccaaaaagagcaaacagaaacgatactcatgaaggacatcagtccaaactaccaaagaaccatttcctgcacgcaactagcatcaacaatcctataaagagattgcagtactgtgtcatcgttgccaagctttgtcgcacccttacaatgaagtagctctgactctacccagcagcaaccaaataagaatgctgaacacccacggtagagcaaggaacggaagcaaggcagcgaaggcctcgtcaaacagctagacttgtagggctttggagacattgcaggagtccatcgatggctaccattgtgcgcgaaaggttcttgatgctaggagatgtcaacgccaaaacgacgcctccaagaaggggaacgacacctaatggcgtcgtcgtcatgccggcccatggcctggcaaggctttcaccggtgattcctattcaaaggtccacacaaccatcgtgtacaacgaccatcgtcggaccaccacaccaaccctttagcacccaaacccagtcaatgaccgtcgtcagtcaccaccgctactgctagcacccaagcgacccatgccggcttcctcctcacgcagacccctgccaggcatggccacgtgtcgctacgagcctcatgcatcgccgtccacggcgtcacagtgactccaccggcgtcgccctcgcgccgccaccagcacgggcacgccgcaccgcacctcccgtccatgccctcctgtccacgccgcgccgttgcgacctcctgccgcgcgtcgccatcggcaccgctgcccacgccggctgctccccgcctaggattgagcaggggtgccgccgcagaaactggatctgggagctccagatccagcactaccgccgtcatcttcgctctcgcgaccaagctccaccgccgcctgcgtctccgtcttggcaaacaccggatccatctccgggagcaccggatccgtcgctcccttgccatctctagccgtcgtggcgacgctccgtcctcccgcgccgaggacgagtttcgtgggccgccttgtccacgtcgccgccttcctggcttgccgcccggttttctagcggcgagctccaggggtggcaaggtgtcgaggattggtgggaggtggcggcgtgggaggctagggtttcgcccccgagctgcccgcgcgagagcgacgcggggacaagaagttggcaactactcccttcgtttcaggttataagatgttttgactttggtcaaagttaaactattttaagtttgactacgtttatagacaaatatagtaatattttaatatcaaattagtttcattaaatcaataattgaatatattttcataataaatttgtcttgggttgaaaatgatattattttttctacaaacttagtcaaacttgaagtaatttgactttaatcaaagttaaaacgttttgtaacctgaaacagagggagtaaataacttggacctcaagtttgcgacctcttttagttgaatcgattcatacatacaaaaaaagacgatgtttcctggttcagaaatcagaaagtggactgagcacagccggatagcacgaagcatttagcacgcattgagtgcgttcccgagtagtgcactactacatgctgttgacatgcactgcagcaaccgatctctctgaacagtgaacgaccaaattcttgtggaaatctagcagatgctgatgatggtctgatctgtagtaactgacaaagtcgccggcttcagatggagaatgtgttgtgtgtcgcaacacgctaaacaagctttataaaaacactttctgcatgcatggttatcctccgtactgaatgactgaatgatgaattccctgaacgttttcccaattctagaacacgcagccttaatttgactgcatttctctgcagtgtacgtttggcatcggttggacccttggatgtgtgcatttctcctggcatattttcggcgagctgtctgactgggcaaggaggcctttaaataaggataaaagaattgatgtcatcacgtgcgactgtactgtcaaggctgattaatctgcactccaaagtttacctaatgctgattgttctgtactttcaggtagtgttgtccagcgggatagtaatcaaccaaaggatgagttttctttgtctagtctggcagtccctgtgggtgacagtcacaattctgtatgggcactgggcagcatggctaaggcatgaagcatgagatcgcgcaaatcggtccattagtgattagctcaggttcagagccccttcacaaagttaggtgcgtatccagtcagaggctacacatttgcggcacaccagattaccaggtggaatcgaaaaaaacggggacaaaacaaaattgcttcgagaaaatttgcaacgaaaatagtcctcttgaaagatactgaacacatagtgtcgtcttgaagtactgaatacagtgtaggggacaagatattaattgtatcattgtatgttcagaaatcaaggattcaggatggatatagctgtaaggtaacggagaactattgtttcttgatccatagctgagcccattgagccagctatatgatctggaggcctttgggcctcttattgggctacctggctttcttgcttctcatttctcttcgttgattttcgtttgttttcctcgttgctgaattctgaagacctggggtctgagaaagtgcagcaagcaaacctgaaagactgaaacgtcaggatgacctgtgaagaggaaggaactagtgaatttctacatttggataggacaacgaggaagaataacttatcagaggttttttttttctttttgcccatgtcttcgtcagtatggcttgaaagatcaaatatttgatcatttatttctcagtcttgctgtaatagtaatcttgaaataaccatctgcatttcagttcatcaatagggttatgacactgcaaacattagcctttgctataatgacactggacccacatttcatagacatagatgggcccatttatcatccactcggagtctcaaaacagcgaagcccccatgtttgtagtccgaatattgcaattttctcatgaaaatgcgagctgggagtaaaacgaaatgcagtcaggtagaccagtgagccagggatggtagtactctgcagtctgcaagaacagcattaacctttcctctgcatctcaactactgcctacttgtgatttttcatccacaacgctaacttcaggctccagattacgaacgtcttgatcttttcgcgaacgcacgaacgtcttgatcgaacaaacagcaactgtttacactgccactgaaccgctgaaccgcaggtcgcctgtagcgaaacaatacaattaccagatcaaaattgctagcagaggcatgctctcactgctccatgccaccaggatgtcgcgcaatattgttcagttccgatttcccgtgaaaccaattgaatgcaggcaaatcctcagttcatttactccatttctcccccatatcccgtgaccaccatttactcgtctctcgccgcattcacccgccacgaacactgcggcctccgcgagtcggcggcctcggcgcgcgcgcctctgacactataaaacctgcgccttctgccaccctcttccctccaaattcccaacggtcgtgacccttccgagcgcatcgcgtcgcacgagcgtgcaaggtgatatggtggcctctgcgctctccgcgacggcggcggcgacggtggtggtggccgtcgtggcggtgctggttgcggtgtgcaggggggagttcacggtggtggtgccggactcgtcgtcgtcggcggcgctggtgaacgcgccgcagacggggctgtcggaccgggcgcgcaccgatccggcggagcagcgcgcggtgcaggaggtgatggcggcgacggggaacgggtgggcgtcgggcatcgccgacgtgtgccgcgggcggtggcacggcatcgagtgcgtgcccgaccgcggggaggtgtaccacgtcgtgtcgctctccttcggcgcgctctccgacgacaccgccttcccggcgtgcgacgcggcgcgggccacgctgtcgccggccgtgctcgcgctgccgcacctcaggtcgctcttcttctaccgatgcttcacggccaacccgcagcccgtcccggcgttcctcggccgcctcggcccggcgttccgttcgctggtgctccgggagaacggccacgtcggggcgatcccgccggagctcgggaacctgacggcgctgcgggtgctcgacctccatggcaacaacctcacatccgccatcccagccaccgtccagtccctcgcgcacctccagcttctcgacctgagctacaaccagctcgccggcgaggtgccacccttcaagttccagcacctaagcatcctggacctcagccacaacgcgctgcagggcggcgtcccggcgagcctagggcaatgccgttcgctgctcaagttcgacctcagccagaaccgcttcgccggcacgatccccgacgcgctcggcgacctgtccgacctcatcctgctcgacctcagccacaacgcgctgtccggcccgatcccggcggcgctcggcaggctgtcgtcgctgcggtcgctcatcctcggcgacaaccggatgcagttcacgacggtccccggcgacatcttcgccgggctcagggcgctgacgacgctggtcctctccggcatggggctggaagggtcgttgccggagtcgatcggggagctgggccacctccgggtgctgcggctggacaacaacgagttcaccggggtgatcccggcgagcttccggcggctggagcgggcgagcgagctccgcgtggacggcaaccggctggtggggccgatcccgttcgggaagcagatgatgtggcggctaggcaagaagctccgcgtcggcggcaacgaggggctctgctacgacgccaagcagcagggccttgagggcgtcgtcgcgctggccggcgtcgccgactgcgacagcgtcaggagccgcacgacgcagcacctgggaggccgcctgaggaacaccggcggcttgccggcggcggcggctgctgctcccagcgtcggcgtcggcgcgggcgtttgtgtcgggagttggcacgttttcgtcggcgttctcgtgtcgctgcaccttgcgaggttgtaacgttctgccttgtgttggttgaagcgtgcctgccagcgtgggctgcacgcatggacctgaccaaggtccatggtgtaaattagggcgtagggaaattttgatcaggaggaattgtacagtgttcttgctgattgaggtgttgtttgttgtttcgtcaggaaataaagggaacgttcgatctgtcctgtcgttctggtttgcttctgtcgcctgtcttttgcagttaatgtctgacccgtttatattaggcccatggtggcccatccgcggtataacgatgtggattggagtaagttcatttttggtccttaacttgacagcgagttcgattttcgttcctgaaccaaattaccatatacatcaacagtcaaaaccagtgcaaataagattccaatgtggtttggatgacggtttcggctaacgtggcacttacatgactaatttgacttagttcttgtcttacgtgacggtgaaatggcaccggaagcaaattataaagattaaatagtatgtaagacaaaagataaaaaaaaaagttggacccacatgtcagtgggtcccaccctcatctctatctccatgatcgatagcacgtcagcgcctccttcttccctcttcctcccggccatcctcgagctccattgtcaccgactgactgactttttaatttttatattaggacgagaaccaagtcaaacctgctatgtagacgccacgtcagccacaaggcccgaaatcgtcttaggataaattagctattaattaaatgcttacgacgtgatgaaaaaataatggctaattgattactacctccgttctcaaatataacaacttctatctataaatctagacatatatatgtccagactcattgctagaaatgcttatattttagaacggagggagtaattgcttatgatggtaattaattatttaatcgtgcaagttcgttctgtagtgctgtgagttcgcatccgtccgatttccttcgtgcaaagccgagcactcatcgcgctaagtcctgatataaaactcgccccctcccctctcttcagcggtaataatatacttttgctaatttcttctagaaaaccggtgaaaattatttattgagtaaatttcacaaaactacatatactttgaccaaattatcacaaaactacaaatttagcaacaaatttatcacaaaactacatgtttaagactaattatcacaaaactacatatttaataataaaattatcacaaaactacatattttgggggttaaattcgttgcactaatattatgtttgagttgaaaatgttcaagttttatgattaattgatattaaacatatagttttgtgatatctttgttactaaaatttatagttttgagatattttatcttaaatctgtagttccgtgataaaattagtgttaaatctgtagttttgtaatacatcatgttaaatctgtagttttctgataatttgaccaaaatacctgtagtttcgtgaaatttactcttatttatttttttttgaaacgtttt

SEQ ID NO: 24358 - DNA, 924 bp, Oryza sativa
  unsure (1)..(924): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcttaaatctgtagttccgtgataaaattagtgttaaatctgtagttttgtaatacatcatgttaaatctgtagttttctgataatttgaccaaaatacctgtagtttcgtgaaatttactcttatttatttttttttgaaacgttttaattttcattaggcttggagccttggacccactgggtattttttttaaaaaaaaaactgacacactgggttaagtgggcacgcgtaggtgtacgagagcgcaagcatgtggagcatagcatatgccatgtgtaggccttgcttgggcacattcaatgacgatgtgctcacactgaccatacatgtgtatcttcatgctcaatattattcgtacatggcaagccatcatggttaaattatgactacggttattatgggcatgtttggttcattgcccaaatgaaccaggtaaaaaaggaataagttcattttacatccctaagctttttgtttatctaaatacacctcctagctacaaaatctattaacttattaaagaaatagaaaaatgagcctccacgttcgctctcacggcctaaaattcccatattaatcgaa

SEQ ID NO: 24359 - DNA, 11308 bp, Oryza sativa
  unsure (1)..(11308): unsure at all n locations
ttgcagatattttatggcatataagttggtggaacagcgtcccaaatcaaaggtggtgtgccaaagtctggaacagtttaacagctggccacatattccatttttctactttggtctcgattgtatcaatggttatgtggcccagtgttgactacaaacagagctagccatgaataaattattccattctccaaaagagtgagccgtcaagactctaacagacaggttgagttgggatcccatccctccggtacgaaaaacgaagcagtctattagcacgtgattaattaattatttgctaattttttttaaaaaaatggatcaatataatttttttaagcaactttcgtatataaactttttgcaaaaaacacaccgtttagcagtttgaaaagcgtgcgcgcggaaaatgagatgggggagttgggaactccaggtaacgaacagagccaaaatcgaaattccaatagcacaaaagcatgtggcaatagcctatgataaaaagaaaaatctagcgatagtgtatatagtcagcgacaggtcaccttttttttcccagagaaacatcagagaaaatagaaggcacaatacatcaaagaattgtctgtttgaactttgcataaagagcgctgataagaatcccttgaaactcgaagaactatacattttacagggaacaatcatacataatttctcaatcatgacttcgccttcgccttgtgcgtgatcctagttttaacgcctcctgtattgaaaaatcagcaacgtgagcattcatcaagcaaaagtgtttcgaatctaatgtcaagtatgaagcaataacatctaagaacgcattgcatccttcttttaaattttaatggaaacaggatagatcgccagcattagctaaacaaaaatcagcaatggcaccggaagaaaatgcacacgattgagtgtagaactcatagaatcactacaatagacctattccaatttctcaataaccaagcaaatgatatcatctagcgctcatgaaggatgagatacataccttcagcttcctcaaactcaacttctttaatcacttcagcagcagcatggtattcaaacctacagagagaagaacctgacaaattagactatcatagactggcaacaaaatgcagtaaatgtctaaaggcatctgaggtgctagatcagaagactgaacccaacgacactaaccaatgctgagaggttcagtaaaaagtagcaactaatcacgaataatgttatcacgacagttggcatttgctctcataaagtagatgctaataggaaaatagatatcaatagcagttctaacttccaagtgtttttgggatttaaaatctcatacgtttgcattcccagaaaaattagctacatgtgagatgttgttcagagtacatcctatggttaatagtatgggataccaaagcttcatcacaaagaccgtagccatatacctgttagaagaagccacttgaggctgatattcagaattgctcttaatagccttaattataatatccactatttccttctttctagtgctggccattaaacaatcatactcagttggacgatgattgcaaagaagttatcactgagcttgcttatacatagcttatcgacagccgcgagcgctatcctcctcttcaatatatcagcatcaggatcaacaaggtagagagcaaaatctgtgatcacaaggatgcgccttttcatctttcctgattgagtgaacttcaataccttatctgcaaacagaactttgttgtcccctgcaatgtatcaaaggtcatgacctgctttagaaatctggtgatgctaaatacaaaaagaacatggtacagtgagaatatcatatgctgtgcatagtacaacatatttagcagcaggaaccaacaattgccgtgccgcaaacaatttcctctgcttggagatgattcttcacgctacaataggctcttaaacatcaatgattagaaactagtacagcattcacgcaaacgaatgatttaaaacgcctttagcagctaggttgcatcaaatcaggttgtcaaccaactattgagcagtattagccaattctatatgtcactcaagagagtaaaaatcagagagaaactgcacagcagctctaatctctgcatggttcagcacatcaaatcgcacaatcaaaatcactttgctacgggggcttaacttgtatatggagctatcgatcgaatcaacacctaatagctgattgacaattcacgacaaatttattatccaaactagcactgccacatcggaggggtaaaagaaaatcacacctccgccacggatcagatccaagcaactgaaccaccgcaacatgcacgatccgaacctaccaacccaagatcgcaccccgcaggccacagcacacgaatttccgaccaaagaaacgggaggggcggggggcaccttgcttggagaggatcttggtgaggcacgggtcgttggggacgccgatgtagtcgcccttgcagtcgcggtacaccgccgagcggcgccgcacccttgacgccatgaggagccccgccgcgggggccgccgacacgtcctcccccgcgccgccgttcgccgcggccgccgccggcgggggcggggcggcggcggcgggctcggggtccacctggatccgcctgagcggtcggaaccggtccatctctacggatcggagtcgtcggagggggaggaatgaggtggaagtcgcaagaaaggaggaaaacggagagagcggtcgcctggttgggccgtcaggttaacgcggttaggcctttgggcccaatttgcggtcgtggctttgggcctttaatggagtagcatttatataagctggcctgtttgtttcgttaagagttctttttttttttccttttttttttagagacagagcggttttctctacgttttgccgcccgtgcattgcaactggctcatgtgatatgagtgagtatactgggattggatctaaccgattgctctaagatcaaccgttttttctgattttccttttaaccaatcgtttgatttgtttttcctgattttcttgaggatggggtagttgtatgtgcaatgtgatgaaggaaagatacgactgcccttttatagtagtagggataatggagtgtatttcggtctctacttcaaagaggttacaaccaattagtatatagtttgtagttcaaccgactatgtattaccgatcacggtttgtttgatggataacaaagaaaattaattggaatttggaacacacagaaacacaccttctatagttggtgaaaaacctacatgttgtgtgtgacatcacacactactacgaaaaccatttttcgttgcggacattttggatttttgctggcggaatttgcatccgccacaaagcaaaggccagtgaagatcaagatcttcgctagcggttattgaccgccannnnnnnnnnnnnnnnnnnnnnnnnnntcttaagccagccgccagcgaaaatgtagcaaaggccagtgaagatcaagatcttcgctagcggttattgaccgccaannnnnnnnnnnnnnnnnnnnnnnnnntcttaagccagccgccagcaaaaatacattttcgctggcgttggcttaagacagccgccagcgaaaatactcatgcagccgcccagtgattcattaatttcaaatttcaaatcaacatctagattcgctgctcatttccaaattcaaacatgaaatacaaaattatcatcagcacatatcaaacatcatttacacaatcaaacatgatttacacagatcaaaacatgtgcatcatctggaacaacatgcaaaaagaaaaaaaatcaaatctagccgacgacggagcaaggtcgacggtggcggatctggcctccccgcggcacggaggcggtggatccggcctccccgcggcccagcgacagcggatctggcctccctgcgagccgccgcccgctcccgagcgccgccgcgcccgagctcgcctcccgccgccgttgcccacccgcctaccgtcgccgccgcacgcccacctcgcgtcgtcgtcgtcacgcctaaaccgtcgccgccgactgtggggtgggaggagctggttggtgaggatggatggcgccggaggcggtggagaagagagggaggagagacgcgagggagagaagggagggaggggagctggagagaggggacgggtgggtggtgggccacgtggtctatattaatagatggtggtccatctatgcaagctgtccttctaccgccagcgaaaatctattttcgctggtgattgcttaagtgggccgccagaaaaaataattgcattttctctaccggtctgtataacacaaccgccagcgaaaattatccatctttgctggcggcgcacctaagtgaccgccagcgataatagacatatcttcgctggcggctggtataacgcgaccgccagcaaagatctattttcgctggcggtcggtgccccttaccccctcgttacaattttgctagcggttttggtatttttccgtcagcgaaaattatagaccaacgccatgaaaaatcgttttcctagtagtgacatagcaaccgcgtcaaagatgaagttatcatcagaggacaactgaactgcaaattgattgcccgcttgcccatatgcagctacggaaggtgtgaaatagcaaatgactactatcgacaagctaagagtcggtgtaggaaatccaacgacatccattgtacgaataaggttctccagaatgaattcgaaagtacctttttacatagagtttcattgattatattacaatgtagttaaccactcaatgtggttagagaagcttgaacaaggacaaatttagtatagctttagttccagcttcactcgataagatactagtaacagagaatgaactagataggtcaaactgaattcaaattattctataacttcactctaaattcaactcctagagttaaatttaaaagttaaaccttactaaacagactctaattaatggcctgccacttcatgtgtccatgagtatggtggaatcggcgtagttcatgtgtcctcaaaaaccactattgtgtggcagatcctcaaaaatccttttccatttggttgcctgtgatcgcaccagagcggttagagcaagtgtacagtccactactactagcttcaatttatctatagtcaatctaatagccaattcatataatagttgtttactatattattaatatatggttccaccagtcatacacactgtgtcttggagtccgtactacagctggctatagatctatagtccgctgcttttctcccttatcttttattacattaaaatatgtttatagccggctaatagtttgctattgtacctactctgctgaccgagctaagtcagaaaaaggaaatataaattgatccggggtgcgtcgtgcgcgacttttctgtgacctgagccgttgtgtttggtgctgcctgccaaccacacggaaagggcagttcttgcgcggttgggccggcaaccgaccggaccaggacgcgtcaactaccgcaacggataccaacgaacctagccggcctccccccctcccccacgtcgtccgggccgtgagccgccacgtggcgctccctcgctgcctctcattgtgctctcggcgcggtggcggcggcggcggcggcctaatcgtgccgtgagcaagaaaagtggcgccgtgacaagcaacgcaaaatgtcaccaaagagagaactaaatatatttgcttcactagataatctactccagttccatagtccgatagtttttttttctctcccattatttctgggaggagaagtggagaacgttgacatatttgatttttttttttgcgtggtggcatggattaaattaaataccttaaatcataccggtcaatggtacagagttcagagttggtcgtcagcgcgagaaacggtcagtgccgtgccacagagtcagtgtacagcatcgttttctacttgtatcagcggctgaaaggcggtaggagaggaggttacaccagcagaaagtacaaagccgttagttagagcacacacttaccccgttcgtgcgcggcattggagacgtgccaagcgaccgagcacctgacgatgacggctacgttatccaccatcacgtatacagtttgtgaaagcaaacagcgtagagcaacctgtcgcaagtctcaaaacagcctgaacctgactgaatacttaagtgttagtgtattgtgtatagtggttagagcccgttggatgcatgatcggacggctcacaccccatgcaatttctgcatgtgaaacctacctagaacgcctattcgggaaactcttctcatcacggtaaattcagcaagttcaggcaacaattgagcatttgggccagtgacagcacaccattcgcctgcgtgctagtattagccagtcaatgtacagcgatggccaaaaaaaagaaagaaacgggagagatttttttttctttttagcaactgctgtgtgctgcttaaaaatggggctgcgaaaaacctctcgcggttagcagcagcacgcacgattcaggaaggaaacggccgcgtttgctttgctgctccccataactccctgcagtttaagcccctccaaaacggcgctttcctgctcctttttcttcttgtttcttctccttctcctcgtcggcatcctggtcatcgtcctccttttgctttggagactcctccccctttccttgttgtctctcttgcgggatctctacgtcagagctctcgcacctctctcttaagcttttcttctctggccgatccttgaagcaagacgccggtccatggtcggataaggatttcagactgctgccctggtgccgcgatcctacaagcttgtgtgagttatctttcagtggcatctttcatgtgcatgttttttttttaatcttctttgtttcgatttcatcttttggtttcttgtttcctacagtatgtttttttgtgtttgatggattgaatagttttttagtttatttcgttgaattatttggtgtttgaatatgttccgttcagatgaaaagtactgaattgtgcagtgttgatgaagttttgttttgctgattcgatgcttctcggttcacaccaaaatgttcctaaaatggttggaggctggaagaaacagatggaaacaacaactgtaaaatgttcagaaatgtataaaatttactttctgcatttattaccttatatttttggtgtcatcatcaaaccacaatcaagttcgtgttcatacgccgatcaaagcactttggatgaaaatttcgcacgtttgacatcagtttcttccctttttttttatccttgtcaggaaaggaattcaatccgtgccatccaaagaagcagaggaagaaagaagcaatcaagaagagcgcgcgcacttgatccatcgtcctatcggcaggcaaggctgatcgccgatagggatggagcagctccggcaactcggcgaggcggtgggtagcatcaacgcgctcatggcgttcgaggacgacctccacatcaacccgcggcagtgccgcctcctcgccgacgcctgcgcgcgcgcgctcgccgccgtcacggggcaggttcgcgcccagctccgcttcgacgagcgcggcgccaagtggcgcgccatcgaggcgccgctccgcgagctccaccgcgccttccgcgacgccgaggcgtacgtcaggcagtgcctggacccccgcggcagctggtgggcgcgcgccgcggccatggcgcacggcaccgagtgcgtggagcagcacctccacaatgtcctgtggtgcgtcgccgtcgcgctcgaggccatcgacgccgccggcgagatcgccggctccgacccggacgagctcgccagggggcggctggtgctcgccaggaagtacgacagggacatgctcgatcccaagctgttcgagcacgcgttcggcaagctatatctggtctcccaagagctcgttgcaaggatggacatggcgtggaaggaggacagatgggtgatatcgcaaatgttcgacgaaatgaaaggccctgcggcgtcgaaacctctgagcaaaaacgagcaccgcctcgccgagctcctcgccgcggcgatggggaagctgcacccggcatctgtccttcttggcagcgactacagcgtccggaggcggctcggcggccggctcaaggaggtgcattggatgggggagagctttgcgatgaagcatttcatcggggacaccgatgccgccggcgccgaggtcgcgctcctgtgttcggtggcgcacccgaacgtcgcgcacgccgcgtactgcttccacgacgaggagaagaaagagtacttcgtggtcatggaccagctcatggccaaggacctcgggagctacgtcaaggaggtgagctgcccgcggcggcggatcccgttcccgctcgtcgtcgccgtcgacattatgctgcagatcgcgcgcgggatggagtatctgcacgcgaagaggataaaccacggcgagctgaacccttccaacgtgctcgtcaagccgcgccaacccgatggcggctacgtgcatgtcaaggtcgccggatatgggcagccagctggcatcacagccggcggcgcaaaagcttccgccaatggcaacgccaacggcaacgacaactcctgcatctggtacgcgccggaggtgctcaggtccgacggcgtcgcggacgccgcggcggcggggaggtgcaccgagaaggccgacgtgtacagcttcgccatgatctgcttcgagctgctgaccggcaaggtgccgttcgaggacaaccacctgcagggcgacaagacgagcaagaacatctgcgccggcgagcggccgctgttcccgttccaggcgcccaagtacctcaccgcgctgacgaagcggtgctggcacgccgacccggcgcagcggctggcgttcgcctccatctgccgcgtcctccggtacgtcaagcggttcctgatcctgaacccggagcagcagcagcagcagcagcagggccagaccgacgacgcgcccaagccggccgtcgactacctcgacatcgaggcgcagctgctgaagaagctcccggcgtggcagcgtggcggcgaggcgccgcgcgtcgccgacgtgccgttccagatgttcgcgtacagggtcatggagagggagaaggccgccggcgccgtgcacgtcgccaaggacagggcctcggattcgggcagcgacgggaactcgctgtacggcgacgagaacgggttcggtgcaatgtcgccggagcacaccttctccgccgtgtcgaacggcaccctgcggtcgcggccggccagcagcgacggcaggttgccgacggccaagaaggcggacggcaaggcgcccaggcaagcaggtatttatcctaccacattttttaaatctcattccatgaactgcaaatagaattcattggaacgtatgattttcagctgaaaatccataaaatttatacagttttcctgtagaacatcaaatggaatgcatgcattgtttggtaagatggcgtatgatatgatggatggccgtacccaaaaagtgattcggataatctgatttatggtacagccgttccgatgtttcttgcacaccagcatctacatatctgatttgccattttgccatcgttggagtagctatcaccgtaccagaaagcacttcactttgcaagaacctttagatcattcacaatttcacatcatttcgcatcgatatcatagctagcgcaatcaagcgagatgataaattgggctgatactttcgcttgcagggccacagccgaaggtgaaacccgtgaacacggcggcgaggactccgcactcggcaaggcgggcgctcggcgtgaagcccgacgatcacctccagaccaacggcgctcccaccgcccgccggaggacgcccgagatggcctcagaatagcagcgcaagctgctctcgtgttcgtgttcgtgatcgagtttaatgggtagaacgcgttcgatggagacggttctttcctctttccttccgtagcacagcgtctttttgccaggggaacccgaacctgcaggggcatatcaatggaggttttgcacgctactcatttgcgtggaacgaaatcccacgtgttaggaatccttgtggattgaaaatgaacgggtttttttcatgctagtaagatcagcttcgatgcgttgtaccgcagttttttttttctgtctttcttatgcatggattgcaatcagtgttttgttagcaaaggtataaattgtggtcttccaacatccattcctttgtcttttggggaaaactcaattcatcccttaagggatattccttcatttttgcatgttacttaaaaagttatcaaaaaattagaaaaaaaaagtacgatatatcaatatgtgatatgtcactttacaaacatacaaattcgaatttaacttatacaagtagaaacaaaaataacaaatttgactggtcaaattttttatttttgtttcgaattgtataagtcgaattttaactcgcatgtttgtgaaaaaatatatcatatattgatatatcttgatattttttaaaatatttttaataactttgaacgacatgctgttgacagaaaacacgtggcctgggagatctgcttaactccagtgcagatccaaagctcgccttcggatgtatgagcatgccggttgatttgatcctgtaatcaacaagaaatagaagcaaaggaaccgtgattaaatctataaatgatagccgatcggctaggtgccgatgacatatcatttatttttgagccgatgtcatatgtgaatcgatcggcggttatagatagataataaagaactaaacctactcgatcggctgtagatattaccaatatatagttcttatatcgatatatatttaaatcaagtgattggatagatcggtcgccatgccgagacagtataaatcacttagatcgaaatatatattaataacgggactatatatgtttatagcatagccgatcagatagacctagcatgtatcggctaatactccgatactactctatatcaggatattaaaacaagtataatatatcaagcaaaatcttaatatacttaaatatagcaatatcttgacgtaaagggaagatttaacatgttaatgaggcatataaaacaaatatagctaaatcagataagatcggctgaaactccgatgcta

SEQ ID NO: 24360 - DNA, 2123 bp, Oryza sativa
tgtatttctatatggactctagtctcctcttctaatattccttattttttaattccaaatttcagctatttctaaattgtatttctatatggactatagtctcctcttctaatattccttattttttaattccgaattttagctatttctaaattgtatttctatatggactctgctttttctttttctctgattaatgttatcagagcaaacgtggaggcttcttttttttttccaaattttagttagttttaaattcctatatggactctatactctacttctaatatttcttattttttaatttcgaatttctattttttttcttaattatatttctatatggactctataatctacttctaatattccttatttttaattcagaatttctattatttcctaattatatttctatatggactctatactctacttctaatattccttatttttaattccgaatttctattatttcttaattatatttctatatggactctatactcctcttctaatatttcttattttttaattccgaatttcaactatttctaaagtgtatttctatatggactctagtctcctcttttaatattccttatttttttaattctgaattttagctatttctaaattgtatttctatatggactctgttttttatttttctccgattaatgtgagaatttctagaccatgagagcgaacgtggaggctcctttttctatttctttaattatataatagatgttttcgcgttaacatgatggaaatgatatgttattttggaggaaagttgcttcttttcaatgaaatatgcatccttccaaaaacataatgaatatttattggtaacaaaatttatttcttgcaacaaaaagtttgcgacaattttaatcacatatgaatgtttcgcaaacttcgaatataaagtttgtttataacaaaaatgaagttttagagtatgtggattttaaatattagtactccctccatactcataaaggaagtcgtttaggacaatgtttaagtcaaaccttgggaatataaatcatgaataactctcaagttgttgagtttgaaaatataaaaattatatgaaatagattgtgttgaaaaataatttcataaaagtatacatatatcacttttcaataaatatttttatagaaaaaagaagtaaaagttgtgttttaagaacatgtcgctgtcctaaacgacttcctttaccagtaccgagggagtacatgcatatacctgtcttattagagaaaaggtaatggaaacaaagtagaatcatgcctttttagaaaaatccaatataggccgtgtttagacgatattttgcggttgcaacagttttataaggtacagcttttagcgacttttaacaattgtaacggtggctaccaaacaaggcgatgttggttatgaggaacacaacaatggaaaaaaaatatactaggataactcatttagcaagaatccacgtgaaaacagaaacggttgcatccacatgaaaaaatccatatcttatatgtatatattaaatctcatttgacaagaatgcgccactccaagcaatcaccgaaatccaaaccaaaccttacttgtcaaaaacatttgctagtggcacctgatctgcactgtacagtatactccagcacgcacgaatcgaagattcattgaacctggccctttcagcaccatccatccaaaaaaggccaccatttatccgcccaggttcccgtccgggtacactcaaacgggtgcgctgagcgtaggcgggcgcaagttgggggtgcgtgcggtaggaggcgaggcggcgcggcgcggcgcccggacggaaacgagtcgggtgaggagcgtactacacccccggcttcgatcgcttcttcgcccaaccaaccaaccaaaccacccggcgcgcgcgctgggctcagaaccgaagccgtcgagcagccgcgcgccgcgtcgtcccgtacgtactcgcgtggtgtgtggggtggcgtgccgacgcgcgccccgtttggtggtggtggaggaagggggggcccgcgtgtcatattccggcctcggggcgcgacgtcacgcggggcgtcagggtccaacgtgggcgg

SEQ ID NO: 24361 - DNA, 1520 bp, Oryza sativa
cacattgttaaatcatggcgcaattagcctaaacgattcgtctcacaatttacacgcaatctgtgtaattgattttttatctatatttaatatttcatgtatgtgttcaaatatttaatgtggcagggtgaaaaaatttgttttggaagtacttttttttttactttctttttttcagctgagttatcactgctatgtttttgggattaccagatgagatttctcggacagtcgtacactcttattgccagtactagtacacgtaataaaaatttgaaaggtgttttagtacctgtacgtcattaattaattactctatcctaaaatatgttaactttcatacataaatttggatattttcaaaataaaccaatttttttaaggaggtagacctagtagtaatgggactggggctgtttggttggttgccacactttgtacgccacactttagttatgccacaatttcttaggtatgtgtttggctcgctatggcaattgtgttatgccacactttcataaccttaaggacccacatgtcatactcttaaatttgaagttaagcttgccacattttggctaactatttctaagccacacttatgccactatactttaactagttatggcaatgttagacatcaaacaaacatcaccttaatctctttcttttgttttgtgacgtgtactagttttgatctgttttggtcgcagccaccatgattatttaacagacaagaattggaccatggactcgtccggacggcagggcgccgcgtccgttggctcggattggatgacatgcgcttacttttcgtttattttttctttattttttattcactcgtctgtcacgactgccgtgtcacgcgtagaggccactcatcgatccggtgtgatttattgccagcataacacgttagtaacatgttctttcttcttcccagttttctaatctcaaatcaaatatctcaatatgaaatccgagaatggagcatataacactgttcaattttgatataacgttttaccgtttatctttcttcgaaaataaatatgttaagtaatttatttggttgtgacttgttttctttaagcatattttcatgtgttttcatcaaatttttaaataagatagatggtctaactaatatcttaaagtcaatatcgtcgtatattgaaagagggatttgtcgtattaggatgtccggacaactttcactgtacacggtgaacaattcgcacgcgtatatataaagatcatagttatgccaaacgtacatacgcgagttaggccttgtttagttggggaaaattttttagtttgattatcacatcaaatatatggatacacatttgaagtattaaagtattaaacatagtctaataacaaaacaaattacagattccgccagaaaactgcaagacgaatttattaagcctgattaattcgtcattagcaaatgtttactatagcaccacgttgtcaaatcatagcgcaattaggattaaaagatttgt

SEQ ID NO: 24362 - DNA, 510 bp, Oryza sativa
accagaacagttgtgtatacatgctactgccaaatactcaaattcttccatataaccattcctttcaaatgagcatgttgttactgtctcagtctacattaagcttaatgtggcttcattctaagtaggatcagctgctaacattgatccggaagaagctcagcaggcacttgaaatagccgaagctaggtagctagagactagactgttccggtccctttgggcaaagcataactagtattctctctcgccgtgcacgcgcacgtgcacgcaataggcgctccgcagtcacacatgattgccagagtccaaagatacttttaaggccgaccactacataggagcgataggaaaccaagccatgagcgggcgctccgaagtaaaggccaaacacttcggcaggatgctgctttatgtttaatttatttcgctttctgtggaaaacttgtaataagtgattatagttttgtgcatctatgggtgcagtgactgggatattaatattccatt

SEQ ID NO: 24363 - DNA, 15767 bp, Oryza sativa
aactatatttgcaaacagtaaaaatgataactcggtttatatagaaacaagagcagaaattatctattaaaaagacccgaatactctttaaaaaaaaatgggacagtaaaagtgagcgtcttcgctctgagatactacagtaactactagctacaggtcaaggcttttgcatgaaaaagtacaataggaagaaaccagaagaattgtttgatctcaatttgctactgaactactagacaagtgtgcatttttctgttgataagaatgccattaaagagctatggtggacttactcaaaatttcagcagaagtaaggcgctcttttgggtcttgccgcaacatcttcttaaccaaatcttttgcaccattggatatcgaaggccaaggttcagacgagaaatcaatgtgaccacgtaatacggcatcaaatataccatcttcactctctgaaaaaatgaaggtagaacatctatgttagcaacagaagcaaaaaaagttgactgaaataagaagcggcaaacgtcacctcacctgcccaaaaaggtggaacaccagaaagaaggatgtaaagaataacgccagcactccatatgtcagcctctgctccatagtttcgtttcagcacctcaggtgcaacataatacgcacttccaacaaggtccttaaaatgctcccctgcaacatccacaataggcattttcatttaccatctcaaggaaaatccttttcgttccacttagtcctattgagtattttagtgataggttctataggaaccagacgatcctatttggtcaaatacctaattgaaaaaaaaaatcttattttccttccactaaggtatgaggcttcttattccacaagaaaagaacgaaaacacctttccattctttcatatactgggggtttttacttggaaagacattgttccatactaaagaattcgggtccataaccacgagttccagtgcaatagatcttgtagcacttagcaacgaggccctacgggacatatagcactcagtttgcacatgccaagtgtaagaaaaataaagccaagttcagaatgaagaatcccccaccatcattgtaaaagaaaaacactaaaacaacaaaatcctccaccgtcaccaacatttctgcataatgaagagtcaagcttcacccactaagttcagatggcatttctgatattgctgagtgcatttttgaagatcttgcatgctatgccgccagcatttagctaccagtggggaaaatatccagtgcctaaagtgcaaatcatgcaaatgtacaatgccatctcggtaaacgcaaacacagagattgcccaagctatagtggagtaaggtggatggatccaatgctaactagaacactgcatctggaacatctataagtataaacataatggcacttgcagcgttgcatctagcccctaattctagtaacggtgaaactttcagacctgtcaaacccaacaactcgatctaagtaaacccaaaatcctcatgaagtcaaacactggaacaatgaaatatctcgcgatccattcctctgtaatgagatagtgaagcctcgagcacgcaccaggcttgaagaaaacggaaagaccgaagtcagtggccttgagcggcgagtcctcgcttttactgaggaacaaaaagttctccggcttgagatcccggtggaagacccccatggagtggcagctgtgcacgacggcgacgatctcgcggcagagcgcggcggcggcgcgctcggagtagtgccccctggcgatgatgcggtcgaagagctccccgccctcgcagagctccatgatgaggttgaccgagtggcggtcctcgtaggcgccccggagctcgacgatgttgcggtggcccgtgaggtggtgcatgatctgcacctcccggcgcacgtcctcgatgtcgtcgcggtgggcgagcttccgcgtggcgatggacttgcaggcgaagcgcttccccgtggccttgtgggtgacgaggtaggtgaccccgaactggccccgcccgagctcgcgcccgaaggtgtaggtcgcgcggacgtcctccatcggccgccccagcaccctccccatcgccgcgtccggcgccgccgccggcggcggggtcggctgctgcggcctcggccactgctgctgctgctgctgcggctgaggcttcggcttgggctggggcggcggctgctcgggagcggcgcggtggtggcgcgacgtgcggttgcccatggctactggaggctgggtcagtcggggtggggaacgcaggcgatgtggtggagcgttgggtttgaacaggaagcagaagcgcacgagtagtagacgcgctccgcggagacgaccgaggggcgaccgcgacccgccgctgcggttatcgcgtgacgaggcgcgcgttgcgacttgcgagttgtgacagtggggatcgggtgcggacggagtgcgacggcgacgccggcgggggatcgcgtgtggcgttcggatctggcttgggggtgggggtggggtggaaacgcgtgggtggtcccggcctccagggtatggtggggtcgtggagtcagtggggagttggtggtggggttgcggagtcagtggggagttggtgggtgggtgcggtcgcggttgtcgatggagattcgctgttcctctgctcgcgggccgcggcgggtggtgacgactagcgactcggcgtggatattttcttggacagcgaatccgtgtgccacggacaagtgtattgtggtgtggtccggttggacgctgccgccagcgacggctaagggtaaaatctcccttaccatttacaaaactagacattacgacgcgatgcgcgctctatcggggttttatagtcatgctaagattatcttttgtggtagcagcggagttgacataccaaccaccttcagttaaaagaaaaacaggtaaaaaccaatgaaacgataacataatacatatacagcatagcatatgcccaaacatccttagatttctatcatcacttgtctttttttttaagaacaatcatcacttgttatgcatgtgctgttgtttcttgatcaactctatgtcttctgtcggctggctgcctcagtagctttccatcgatggagagggagtcgaggccccaagcctagggaggcaagaaaggggagcttcatgacctcaaaagggagatcttgcaggtctctttggagatgaatctaaaaaataaaacctgcactccatatgttgtatcattataaaatctcccagacatcattcgtaatccaatgaccaaatacataaaaactgatacatctttcttatgccacataactataacttgtaagagatcggccagaaagatgtgccacaccttgcaagtagggcaaactctgtaaagaacatcgactttacctctacaaacctacaacaacacaatataaaatgcatagtaatttttttggaaaatgaaaaatcctcaagctaaacatacctacaaataggttgagtgtataaagtaagaactaccatgttatttttgtaaggattgtaacaaagaataacaactattattattccgatagtgaataaaatctttcagagtttccttctctaaaggagaaaacaaagggtatacccttgaattgtctagtttgcaatcagaatcagatccttcagtatcatgggagtgaactgaaagaatagaaatgtgtgtttagaaataatggatgttggcactgccatcattttcagaaagaagataactactatctaactctggttaccttacaaaagcgcaatccaattattccttgaatcctaaacctacagcatgacactactattaatttgtagtagcaatcaatagtactttcttcactggaaattatgcatagtcatatatggattatggatatttattcaactaaaaacattatacataaaacattctagaacctgggtccacattaaactgaattgttgtaacgaaaaagggaacataattggagagctgcacgttgagccaagaacacaataaacaaatgactattacatgttacaatagctaaaataactgaatttagaatctctgaagcaaagctctgctttggactttttgttagcttcattgcacagaagaagcatacaacaaatcaggatggagagcaaagaccatagaagatttggaagccaaaaaaagaaaggtgtagatcgcgtcaaggagaaacagaggtgaaggggactcacacctccaaatgggaagcccctagtgctttaacttgaaaattgtcataatgtcttctcaattaagtttaaacaaagaggacaattctatatatttgctaggaactatgagaaaaaatatggtcaccctccaaagtatgcacatatctttctttaataccgatttcagggttttaacccggaccagagattgggccacgtagcgtcatataaatcaagcttcgcctctcgtgaaaatctgccacgtgtcaccttgctctctcccgcaccatttcctacacgaaaacgccgatgagcacccaactgcagttgcacctgttatcctgaccatttagcccgctttgagatacgtgcttgtttataccaatgagcagttaaagtgttgtagagtggcatgtaattccagaaactgtgcgattagattcaattgttaggcttgggacccatgtctttgggacggggccatttcaaatttaaactgcaccacggtgcatgcgtatacaaaccactgtgcaaaaatggagtacaagtatttgtgcatgatgcatgatttaaaataatgttaaaaaacaaatgctcaatgacccaattggtagagccaaggtgcacatatatacattttccatacgcccttttcacagaagttaaaaaatgataatgtggaagtgaaatacatttccatgaacagtatatattatgctgataccaaatgaactctcagatacatttatatcacaaaaaaaatcattttaacatagtagtgcatacaaacattcagaaatgtaataaaaaatatgatctcccaaagtacattcaaattgcagagtattgcgtagtaatgatttcttcaacaaaaaaaatggtgtacttcgtttcaaaatatgctcttaatgtatcttttgtttcagagttctcccgctttttgaaaattgttgtaccatgagtactagttgcttgggtttaaatttagatttaaattgcaacacttatgaattgctcaaaaggcaaatatatgtacgacattgccagaaaacacagaatacatttatctttacagcatcatatatagatgcattgtgttctatgtacattttgcacaaggaaaaaatgttcttaataataacttaaatttgaatgcacagtaatatacacgtgcaaattttgaatgcacagtagtatacacgtgcattcaaaatgtaatgcattatttctcaccataaaaaaatgctactaccaaaaacttatatatctgcattaaaacttaatgcagtattttcttacagaagaaaaaaatcctttgagaaaacatttgaattgcataacatttatagacagatgcattcgaattgtgttattaaaataatagattttctcgatttttatagacatacagaggcaagggcggagccaccgcctggctagcccaggtggccgcgcatgctcaccgacaaaaactccactaaatttatatgttattgaatgaattgatgatgaaatttatacaacaattactagaagtgaagtttgcttagggttaaaaatctttctagctccgccactgtgaggagagataaaatgggaataagccgtttcattactttggttcataggaatttggaatttttgcgcatatattcgacttccaacttatgtccatgaattcaatgtcttgctgctttaaattaatatatgaataaaagggtaaagtttcatcatttgaggcattaaataaataaagaaattaggtgtacgtatcagactccctacattccatattgattattatataacttttttcacctagaccaacaaaaagtattaactttcctatatttcattttaatgtaagtatgtgatagggaaaaatcaagaaacacgcacactttaactccttctgagccccatatataagaaatgatagctttactacctcaaattcctacattcatgcgcaaactcaattttgatgcttaaatgcaataatattacatgtctaacgaagggggtgatgatcaatttgaaaattttaatttgtgttaaacgttgatcaatatgaaacagatggattattttatactggttggtccattatcggcaaagccacgtctattttctagtatattactaaattaaagaaatcttttctttagaaaaaaacattagtttgggctatagcctccatctatgactaacaacaatttttcctttccaaataaacagattcctcataaacttaacatttttgtgctggaccaaattgctagactatcatcagcaagctagcaattaaaggccttgttgaccatgcagaaaaggaatgatcgattctctgagctcatgaccaaaaataaaacatgcatgcatacaaaataaatggtaagtgtcaatcttaagtgtaatgaacaccctgcacatctggtacttagagtaaattcaaaattcagttggatgattggtgtactcagaaaatcttaggcggctgaaaaatataagtccatattaactattttgcatatgttttagtcccctatctttacaatattttttgatggtgaggagtttacaggtttatcgacacagttcggtatgaaatctgaaactgtggcacaaatttatcaatagacatggtaccttgtcactgacctcatcattcagagattgagtacaccgtgtattgtttcctttaaaaaaaatctgaaattgatcaaaggaaaatgtaaacattacactgcaaagctagataaaggctttcagccaactattaaaatgcagtaccccaagcatgcataacagcagatgctagatcattctagagcaagggaaaccaacctatattattctacttgtagaagattagcaataagctaatacaactttttttcctaatggatatagtccaattaagaatagagaaacagatcgatggaatataaggagcaagcaaaagatttggacaaacctgattcaaagcaggagatggtagaggaggcagcaggggggtgatgagggtggccaggagatgctggtggtaaaatcccttggcttgccatcgtgtccaacatcagagctgctccggatcaagcgctgcaccaccatatggagccctcctctggattatgggaggcggcaccagatgaagcagcgaggggaggacggaggatgcagcggcggcggtaggcgatgcgaggcggctcgtgattgtctaaagcaggcgagagaaaggcgcgagggggacccccaccttggagaacaccgtgccgacgccatcttctcgcaagctcgaggcgtccgcctcctgggccaatcagtctacaccaccacggtggctgtcatccgcttcagctccaccatcgtcgtgggctcctccccctccccccgagctcgccaaatccggctactgcaaggcagccgtcaccagatctgaaggcagaatgggcttggattgtggagacaggtaaatcgacgacgaggtgatgcagaggacgaagacctaacccgattgaaagccagatagactgactcgtcgccgacggacggagacggcctctcaccatcgagcttgagctcagaggaaccaacggcaaggagagagagagagaggtaatggaggacgggcagcagggcgcggcagtgtcgggcgcttacatcattggcatcgcatgattaaacatcagcacgcgcacttccctccgttttcgatgccgacaggggcgaggattggtgctggagaatgaagcggcggcgcggggcgtcaatggggcggagaggggaaggaaagcaatgattctagggttttgggggaaggggtataggtatatattgtttttcaaaaaagccctttgatgctcgtttttcagagcgcggtcctatttttagatttctctcttcttcatgtaagattttcttggttatggagggcttatacgtaaaagaccacaacgtcgcaccgtatttcttgggttctaaacacattaacaatgcaacggagggttttttttttgaaaaattgccaccacactcttgacgatgatcgatcttagccgtcgctgcgacgaatcgaacggctgggagctgcacggcgcggacgcacgagagggcgcggattccgcccgcctcccagcgctcgcgggcgacgtggatgcctctgcgtacgaacacgccgctccgaatcgctctcagctcgccaattcccagtaggttttaatataaccgatttcatccgaaacattatctgtgttatactcctttatactgtcttcatttttttatataaactatatttttttatataagacagttaacatttttgacatatgttcggtcattcgttttattaaaaaaaatcggacaagtttcacaaatcttcaataattgaacagtttcttgtttttcaccttccaattacatgtgtttagtaatttccactaacacaagtttaatcccatccttgaaacttttgagcatgtcaaatgtttgacagtagtttttctcttgggaaaaaaaatctaaagcaccaaagctccccagagcttagttaaccttgatgcttcatgagtaatttggattcctctttcttttgttcatggaagaattgaattgaactaaaacaagaaaataatcattttgaaggtttttttggtgagccatattgtctataaaaaaaccttttatatatttttttggccatctcaaatagtcccatccatcccattttgatcattccataaacaaagagcaacgaaaggacaccaaacattcatcattttgaaattgatttaaggcggttctctattgtttcgttccaataaaaaataacttacactttaaatgttgtgtcacgccctgaactagccccgagcgagactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttctccagcaactgggggggattatttatatagagcaagggtgagtacgggagtactcagcaagccatgagaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtcttttgaattgttcaagattggcacccggccaacaactttcaaacggccacccgggcctacaactttcaaacggccacccgagcctagctgatcccatcagctgcagattttccaaacatcgatcccctttccacaacagcaatttcacaagcagtagtaaaacaaaactacgctaggaatcacctcacatccgcccatgaccgtgggtacggctattcgaatagtttgttaacctctgcagaggggggtacactttacccacacgacattactaacctggatcacccagcccgtggggatcagccacgtcgggagacctccaagctttcatgacaaggcattttcgaaagccgacacaggtttaccatatgccgacgagaggggtcccagaccaacaacaggttaggtcccagaccatactgtgccaggaagcccgggggtcctccccgacaccaccccggtgaatccacatgtctctcggcatcaaggctcccctgataagctagttactcagccaggggtgtcccattccacccatgtggtcgtacttgtcttatgttcggatgaaattccaaggaaacgatccttaagtgcaagagcgggaaaccgtacacccggtacgttccccggtccgcggttttggaaattcatttagttcgcaagcaccgacccaggtgtcgggttttccaagtcttttgtaaaacccaagttttacccaatatgtttttcagattttaagtttgaaggcgaccgtcgatactcgtgcagagtgcacgattaccgaggcacgactatgtggttacaagggaacatgatatagcaattaacagaggaaggatcaatgcaacaaaataggtaggtccgccaatctgccttgcagacgggacaagcagattaagtgtgatcctatcaatgcataatatttttcaagcaacataattaagttcaattataggctcaagatgttcaaaggtggcttgccttgctcgagatcttgagcttgatcctcgaaatcctcgcactgcgggtcttcgggctccgaaactacacgcgaaacgggacaactcaacaaacggcgaaaataaggccctattaatgacctctcagcgtgccattagatagatctcgagattcgaggaattttggaagttgaacagagtcaaacggacttacggttgggaagatattgaatttctaagattattagatttttggtctaaaggaaaaaggatttaattaaacccttttggaaaagaaaaggaagatggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtcccgggtgggacccgcttgccagcggctcggctcaccgtgcggagggagcacgtggcgcggcgctagggtgtggagcggggcgcggtgcatgcgcgtggttcgcggtggacgcggatgcggcgggcccacgcgcagcctcacggctcgcggtggaccgcgcccgcgagcggggccggagggagcggctgaccggggtcggctcgacccggtcttggccgagctggcgcctacgtggcagcaacgcgggccggcgggaggttgaagaagacgccggccggaacggacggcggacggcggtggcgagcggcggagcgaaacacggcgatctaggcgaaagagagcacaccgggaagttgcgcgggacgaggggagtcgagccaacggctcggattcgctggagggagctcgacggcggcggattgcggcggcggccaccagcggagagaaaaggggaaaacggcgacgaggtcacgaggggccgattcccggcggcgagagcatctacgcggctacgggaatccgtcccttgcgccggattaggaggaaacgcatcgaggaaggccggcgacgagaggcgtttccgagctcgggcggcgacagcggcgagcacacggcgagcgacggcaaaggtcggggcggcgctggctagctacgaagaggctactcgtgctactacccgagtctaaggggaggagatggaacgaggagggagaacggagggatgcactaccgtgcgggcgggcgcagtgacgagagccgacggcgcgaaacgtgatcgtttcggcctcgggccaaggaagaggaagaagagggcgcgcccggagtccccttccgcgtcctcgctcgtgtcggctcctccgacacgcgcgacgacaaacggtgacggcgaacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaaagggaaaaggagggagagaaagggggcttgcccgttgcctctttgagaaaaggaggaggggagcgggggcgacgcggcagagggagaaggagctctgcctccgtcccttggaggctagcgcgtggagtggcgggggccgggcgatgacgacggcgatgacggcgggggcggtgtggagcgaagcggcgacacgggcgacaggcgcgggcaggcgcggcagggctgcggggccggatgacgcagacggcgtaggcgtggcacgggcggcgaccacgcgggcgcgcgcgcgaacaacggcgcgcgggggccgatttcgcgggcggggtgctcgccagggatggaggcggggaggggggagcgaggggagggaggaggcgctcggcgcggctcacgcgcacgcccgcgcgagcggagagagagagggagatagagagaggagatgggagatgggccgagagggattcggcccatcgaacccgagggaggcgaaatagacttttgcggagggattgatttggaaggatttggattcgggattgaattcgacgatagatcggggatttgagatctgagatggcacggacactagatcacaagcaaagaaacagctttcgcaaatagggtttttaagagatagttttcccgctaggcgccatgacggaacgggcgctacatgttgcatgagttgaaccaattcaagttaatattgattggctacacgcatatagttgcacgcatgcatggtattccacgatgcacatttataaataaacataaggtattttgttaaaataataatttttttgagaatatctctaaaatcttatgtgatgaataaattgtgatggatgaagtactagtttacaaaaagtttccacatataagagcaacacatggagtatgttgctagagttgtgggtgtccaatgccacgtaataaaagtccaaaaaagggtcaaattttggcaacaaaatggattagggccaatgtaaaaagggaccttattcgaaatgtttgtaatacaaaataaataaaggcttgaaatgagtttttttttctcttcgtactagccacggtggcatgccaggtccttccccgttggcccacgaggccacgagggcgcggaggcggaatccgcaccagcagttgctccttctccacccaaacccaaactcccgaccccaagcaggattagataagcaaaacagccacctaagcccacgccgcgaagtcgccgccaccgccatgatctccgcgacggccaccgccgccttcctcgccgcggcgccggcctcctcctcctcctgcaccacccaccgccggcgcagcggccttcccgccatctccgcgtccctcgcaaccgcctcctccactggtaaaaccaaccgccctgctgttactactctctctctcctccagttttcctccattttcgccctaatctgacctgcatctgggcctcccgcatgtccagaggagccgctgctggtgcgggcggcgaggggcgaggacgggctgccgcggccgccggcgtggatgatgcggcaggccgggcggtacatggcggagtaccaggcgctcgccaagcgccacccctcgttccgggagcggtccgagacgaccgaactcatcgtcgagatcacgctgcaaccgtggcgcgccttcgcgcccgacggcgtcatcctgttctcggacatactcacgccgctgccggccattggggtgccattcgatatctccgactccaaggggcctgtgatccagtctcccgtgaggtccgaggagcaggtgagggagctcacccccattgacttcgagaagctccggttcgtcggtgagtcgctcaagattctacgcactgaggtaatgcgcagccatttttgtggtatggaaaaccccctttctgttaaaatttgttgtataaactcggtttgggggctcatgatgaattggtacaatgtaaatctagttatatgagctggcagttattgtgaaagtaaaacgacaagctgtgttggcctttacaggattcaagtaaaatttggttcagcattatttttatgaaaatgctaataggggatagaggtttttttacattctagttctatgctggcgtagttagctgattcacgaaagctacttcgttaggctagtggcgttgtattgtcgccactaaactcacctacttatataaatacaattttgttaatgttggtgcaagtggtgctgaaatatagtatgcgtatttgctggcagcgtgtcatgtttatagactaaggtgatttggaatcaatagtgcataattattatcaagcccgctgtgtagcatctgcaaaacaaaacggtagtggaattacccggtgttcattagtagagtcgagtattcttctgccgttcctgacaactgactaaaattaaatatcaggaaaatttggctttcataaacgtaagcaagttaaggaagtcttgacatttttgtggacctatcattgctgcaccgtctcttctaaacatcgatcacatgcttatttccagagtctgctcctttactatgcttgatttgaatgtttgtgataatagttgttttaaatttttgggattcatgatattgtgtgattcacttaaatccttccagcaaccagtgagttgcagaccaggttagacaaggttgtgccctacatagggtaaattggttactggtgtctgctcacttggtatatttgtctccaatttcataactgtttgggaacatcaacaatgtataagtatcattctgtgagagtgtattggattaaattcagttttcctatgcaatttgatccagtattattttggttcttatacatctcactttctcctctaccctctagattgatggacaagctgctttgctaggatttgtgggggccccatggacaattgcaacttatgttgttgaaggggggatgaccaacacttacacaaatataaagagcatgtgccacacagcaccaaatgtgttaaggggacttttgtctcaccttgcagacgccatatctgaatacattatttaccaagtaaactctggggctcaatgtatacaaatatttgattcatggggtggacaacttccacctcatgtgtgggagcagtggtcaaaaccatatatcaagcaggtagcttacttttacttttctcggtcctgtttgcttccttaatccttatgactaatttcatgatgggtggctgctctaaggttaatcaggttggatctacaatgtatagtactgcatcaatgagcataccccctaaaatttctgaagttctttaaaatgttgagaaatatgcctctatgtatttaaacaaatactttatcaattgattggattccacacaacttctggcagcgcattcgagcttggtatggttatggttgcaagttactacataacctgtgaagaaacacataaataaacaaggagtgcataaagaaccaatccgttgtaagcaatcagaaacaaatgtaaaatgctaatgctagcttcacgttgtcatatacatgcatttgaatgcaatgtttcactatagtttagctgatctgcaagactgcatattgacttagttt

SEQ ID NO: 24364 - DNA, 641 bp, Oryza sativa
atcgtattgcccgagcagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgctttgctaggatttgtgggggccccatggacaattgcaacttatgttgttgaaggggggatgaccaacacttacacaaatataaagagcatgtgccacacagcaccaaatgtgttaaggggacttttgtctcaccttgcagacgccatatctgaatacattatttaccaagtaaactctggggctcaatgtatacaaatatttgattcatggggtggacaacttccacctcatgtgtgggagcagtggtcaaaaccatat

SEQ ID NO: 24365 - DNA, 316 bp, Oryza sativa
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaacaaaaaaaaaaaaaaaataaaagaataaaaaataaaaattatataaaaaaaaaataaaaaaaaaaaaagaataaaaattaaaaaaaaaaaaaaaaaaaaaataaaaaaaaaaaaaaaaa

SEQ ID NO: 24366 - DNA, 5909 bp, Oryza sativa
tgccgtccaagtataaaatatcaccgttctttcgttttggccatttgtttggacattaaggatgatgcaacaactaaacaaaagaaaatgtttactgcctttgtaccaagttcacgtcactttcagtcgtgcattgttatacatctttgatgcattagcttgagtttgtttttcctctaagttcctgttatctcattgtgcctaataactgtttgatactgggcttctttgttagattatactccctccatttgaaattataagctctatattttttatacggtcttcaatgatataatttgaccattaatttattccaacttatgttcctaataaatatgaaattagcatcacatgaaagtactttaaaatatatatctagtaatataacatgcataatacttagcatgtatatggttagtatgataaatagttaaaagttatcaagtttgatttactttaaaaagagaacgccctataatttggaatggatgaggtaactttgtaagactgatgccctttttgcaactaacatatgtttttttctttaagaaaaattataatctcgttgatagcatttggtctcatatttgagtcccatactaaaattgccatgttcattgatgtttgatagcatctgttcccagcacatgagcttggattctcgtggaatgctgaccaggactgggctgaaatagaatcactggatatacagagttatccacaagctaattttgctacagtgcaggataagctcggagctgagatatactgatatttgccaccggtgtccgcgatttgtggttctgccgctgagcaggaactacaagtgtcggcaacttttaagaggggtgggtcaatcgccttggtgtctttgtctcgataaatcaaatatgattgccttttcagaaacagcacaacggagaatggaccatatgattttgattcctgtggggtattgccctacctgctccatttgctttttcctagcgtcctggtggtctggttgatattactggttagtttaccacaaacattttcaactttgcatgattagtacatgtgggtcgtaaataaccaagcatgaattttacaagaatttgcatgaattagttcaattcataaaaaaaattctccaaaattcatccgcttgaaaggagaccttattccgaccagtcctgtgagaaactgagaatgtattgcattctgttgcaaactgtcatctgagctgccgttggtctagaactgcagcacacgactggggcggtgaatagactgttgtgatctacagtacacgttcatgatgggagagcgcattgttgaatgcttaattattgtgcttggattgccatgattaaactgactgtttacttgattgtaaagcaaactgattactgatcggatacatcagtctcgacgatgagtggttttagtgcgagcagatctaagggtgtgtttgagaagaagggattgaggagactgagaagatacgcaaaacgaggtgagctattagttcatgattaattgagtattaactattttaaattttaaaaatggattaatatgattttttaaagcaacttttctgtagaaaatttttacaaaagacacaccgttgaaaatttttacaaaagacacaccgtttagtagtttgggaaacgtgtacgcgaaaaacgaaacaaacaaactcactctctcaccctctagaacgctgcctaagagatggtgacaatctctagcctacttgtgatggagccccttttgtccaaaatctcactccactaccagtctaccactatgcaaatgagcaaatcaatgtcagctgccgtgcagataggtcctcctctttgcacgctttggcattcaacacgcacatgaccgcgcaatttgcatgcttatattctccagctcatattggccattagtagctaggaaacccatgaagattttgtttgcacgtgttaacacgctactccgttagtcgctaacgtcattaagaactaagcatccaacgcccaaaccgtaccgtcccacttagtttagtctaatgagcgaatcctcttaattcccaaagacaatgaactgcgtaatctaaaatgcccacttacagctgcaggattataaatttccagcggattctctttaagtttgaatccatgttagtatattcttgctgacttgtgctttcagtggtaggcgacgtatccgtcgacagcgaggcgtctgtggtgacttcgtcaatctcttcaggatttgccggcagtcttcgaagatgcttgtaggggtagaatttgcgtgcatattttcatagggatgaatgcgcgtgcgttgtgagtgtctgcattgtactgtgtaattctaaaaaaaaagtctcctttagaacacaagaattttgtataactttcttttaacagaaattagtttgtttcttttgaaatttccgctaaattcctcggttcccagggaggccaaactacaaaggcgatgctttctacacattctccagccgccattgcgctctgcatcggccggccgcctgcacatccacactttggcacggccacggttgcgatctttccgcctttcggtcacagaaacgcttctgctgtggctgtgctgagctttcacagtcacagcctcattttccccgaaaaataaagatctaaacccccgtgtaccccaccccgctgaaaaactttacgggcggaccaatcaaagctgccgccaccacctgcagaatcctttcctctcaagatttagttcgtggtagtaacacttttccattgcgtgccaagaaacgataatgacacggaattatcttactaagcccggattaattatttattccatttccatcaccttccagttccaccacagcgctgctcgagaaaaacatctcgtcgaaaagaccgaaacgtgacccccgcccgagccgcgagtagtatttctcacctgctacacgggcttacccagacactgcagctggggcccggacggtgcgtggtcccacctgccatacctaccccggcgaggcgagttggcgacagcgcgcggagccccaggcggccgtggcccgtgtggcccccatccccatccggttcccgagacagcggggtccatgctccgggcgcgggaatcccccgccgtgagccgtcggatcgagatcggacggccgcgagctcgcctcgccacgctcgcgttgccttaaacgccaccaccttcctcgtcttcctcctcccatccccatctccaagaccaaagcgaacggaacgcctcgcggagaggagagaagagagagagagagacttgtactgctcacgagtccagcacagtcgactgccaccaccaccgctgccgccgccgctgctgctgttgctgctgctactactggttcatggcttcggctaagccctagcgtagcagccatggggtccctcgaggacggcggcggtgtgggtgcgggtgcgggtgcgggggcggggggatacaagcgtggccacccgccgccgccgtcgccgctgctgcgctccgtggtggggccgacgcggcgggggagcgcgagatcccggctggcgcggttcctgctgttcgagaaggtggactacctccagtggatcggcaccgccgcggccttcttcttcgtcaccatcctcgtcgtcgccttcctccccggatcggccgtcttcgagcgcccgacgatgctgctaccctcgcggagagctggcggcgggaggggagggggagctgaggcgctgctgccccgcggcctcggggtggtggagacaggcgagggcgtggcgttcgagccgacgaggctgagggagaggtgggcgagggagcggagggaggaggccgacggcttggcgaagctcgggaatcccgtgaggaggttcggggtccggaagccgcgacttgccatggtgaggagttgagctgggttgtgtggtgttgtgggtggaggatttgggccaagtttcttctcgcgacgtggggtttttgattcgttcgctgtttgtgtttggactcccttgtaggtgtttggggatctctctcccggtgcaatgcagcttcagatggttagcgttgcctcggtgctagaggcgatgggctacgaaatgaaggtgcgtgctgaactggttcgctctgaattcattactgcgtagtgaacttaccggtcgaacgaaatgagtgcaacctgtgtctcttgttatgttttccgttagtttttttattatcgtagaagttgggtatattgttgcttttgcttttgttatcgcattctatactttgcaataagttcaggttccatcatgtgtgaattgtgatagtatccagtaatgtaaaagttgcatatgctaatatgtcagttctgggcttctggcttgcaaaaagaaaaaaaagttggaatgaagagaagtgtgctgaatgagaacattatgcatgagtttctgacactggtagcatccgtagcatgttgggtgctagaatctgacctaacatttgttatttgatctataatttcgccaaaaaatagttttgtgattttgcccttgaccccctttacaaattattgttgcaggttttcacatttaaggatggtccttgtactaatatttggagaactatcggggtcacagttgaccttttacctgaggacacagacttacatatatctgtagattggctagagtaagtttctgaagtatatatctcattttgttgtatcctgcaatacattttttctcgctttgtacaattgcataacatgtggcctcagcctcacttcgtaatcatttcctcatcaggtttatttgcattatttctgcagctatgatggcatacttgtaaattctattgaagcaagaccggtattttcaaggtaggtatgaaacaacaggttctatagctgtttgttgatttgtttagcattatgatataccttaaagtttacacaaaatctattgtttgatttagactatctacagtcttctgcaggagcctttcaaatccatacccgtcatttggaatgttcaagaaagttctcttgctcatcgtattagtgaatataattctagtggaatgatccagatcttagatggttggaaagaggccttcagtagggcgaatgttattgttttccccaactatgtattgccggtatttacttttggatcatataacttattgtcattgaatatagtcgtacgacctaaaaatagactgtttaactgtatttgcatcctgcaggtgatgtatgctgcatttgattctggtaactatttcgtgattccaggttcccctgcagtaccatttcaagatagaatttcagccaaaagttatgaccaagatgtgagagtcagtatgggtttaagtccgagtgattttgtaatttctattgttggtagtcaattttcatatggtggttttttgatggaagaagcacttgtcttacaagcagtagggtctctgttacaacagtatccttctgagaatagcacacaacttgaactcaaagtgagaatcttggcagaaaacgtaactgagaagcataggatggcccttgaggttattatttagcgctccttctgcctttcttcactaaatttgcttttcagaagttttaaagctttaaaatttggtctaattgcttgtgctgtttgattattataggctgtttctttaaatgttggctttccaaggggtgcagtggaacatgttgcttctgaagataaggacaacctccttggtatatctgaccttgttatatatggttcttgccttaacgagcaatccttcccgagtgtgctagtccaagctatgtgtcttgagaagctggttatagctccagaccttgaaattatcagaaaatatgtatgttcacggatacatatcatattctatcaggattg

SEQ ID NO: 24367 - DNA, 604 bp, Oryza sativa
aaccatttatacatgctgcatagactgcaattccagtattacaaatgctccagtttaaaatgattttgtttggattggacataactcataagtttattctactattattactaaaccgcaagacttttttcattacttttctgtttatgaatatcaatattccaaccaaaagcagttagcttcatcatatagaatttccgatgatgctgccaaactgaactgaatgctgttatggatgaactaatccactacacaattactatcttgaaggtcagctgttctgaaagcttttcaaaggatgtatggcgtgcagcttgatgatgatttgcataccctgccactaatgcctaatgatggagacacttggtctgtgatgcaaagctgggttttgcctacgagatcattcctggaatttgtaatgttctcaaggtgcacattatctcttttggaattcaatagtcaacatagcagtattaagtggaagatgtcactagctaactgttggtgtatacatttcaaagcacaagtacccaacactgctactaatatttgctcaaaatagctaaatgcctgttatctttctactagagaaaaatgaatcgta

SEQ ID NO: 24368 - DNA, 1760 bp, Oryza sativa
tatttagttggatgcaagtgcaacatatatattatatttgttctgaaagaaattgtatgtattatattataaacccggcttaaacaggtaaagaatagaaattgagacgtgtctccaccaactttccagtcctctcttgtacaaaacgcgtagtaagaacgagcacactagtagtataaattttgttagacgaacaataacagtgagcacaagaacagaaggtaaattattaggtctctttggctgtgtatatctatagagatcggattaatgaaaaaactattatctaaaaaagcattattagatctccacttcaaagagagcttttgaatatcaatgctagcccaacaacgcctgttaccaggtggatgtagagtggaggacgcgattttcctccaccgcgagcacgcgattttccttcgccgctggtgagatcacagtagcgcagcacctgtgccgtgacgatgccggagacagcgaaggcggcacagttggtgtaagcctcgcgccgacgcagcctcgtcgcaatcgtctcgagggtctcgcccgtcccggcggtggcgcatcggcaccgcacatcaccaccaccgcagtagccgcgctagcccgccgccgccgccgccgtcggtggccgggaaagcagcgagcggctgcaccagcgagacgcggcccgcgcgacggcctgcatcttctcgcttgattcggtcgatcgctttcttctccgggtgtgatgaagaggggactacgggagacgtgaatacgtgatcgatctgctgctattgtgcgtggttggtctcggctttatatggaaactaccggctgtgagcctgtgagtccgacgcgagtccgggtccgaatactagtcccataccggttttgttgaacacaccagcccgaaggctaaactagttatcacttatcagcgattcagcataacaccaaccagaacataaatacagagccaattatacagcaacatcagcaccgcacaaagatgcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatacagggttggtatacttttgcatgaagaagtcaagacacgacacactcccctaaatgtgccgcgtgtcattgatccactttcatgtcacaccacacccatccatcatctgtgcacgcgttagtttctgcagcacatgatgaaggatgagagtttcaactcgatcaacgaatttccaacaccaggaggaagaaggaggattgtaaaacggaatgagaagcgttgaacccctttacggggccgcacctttgttgatataggcagaaaagagccctctaccgtggcgtgtacaaaggataggattaatctcaacaacctgagacaatc

SEQ ID NO: 24369 - DNA, 739 bp, Oryza sativa
atacagaatttgttgaagttcttgccttcaggtaaccgctggaccacctttcttatttttatttaattttatccatgtccaaagatctaaagaaactagtaaaagttatagttatgccaacttacctattagtatgtttttatgtggcacctagctggctagctttgttgtctcatttgcccataccagctactttccagataacaggaagacctgttaattaactccataacgtactgttagagagattacttaaggaaacaactggatatgttatgaattagtaatatccatcgacacccgtcttgcctgttttggtctcctcacctttgatggtgtttcacttagtatggtttcaacttccaactgccagtccattattttgcatttccattaactatgcagttttacaccattccttcattcttctaatttattgtaattatttcaattgtttttacctgtacagtttgagttaaatctctctcatatggatcaattaccaatgtgcaggcagagccacaaagctttttttgataaatcggatctgttttttgtttgcatattacggccactttcctttgatattaccaagcaagattcagaaatcgaggcagctcaggtatttggaacctctattctagcaccaaactgacctatcagagaagggtcatttgttgccagtttcttattcaacctttgaactactttcatgtaaatgccctgttaacatacttct

SEQ ID NO: 24370 - DNA, 5306 bp, Oryza sativa
ggatttattgcgctagatgaatttggttgtaggtcagatgcaattaaatgcaaaaatttgtgccggatattaatacttgacttagcggcataataatcaaacatctaattgaatttttttctcaggcacaagtgacaaccaaacaagcacaggctcaggctgcctgaccaggcaacctacattataaacttgaatgctactcaagcttacaaatttctcaggcacggaggtgagggcaccaaccaaacaggctcctaatccccttgggctatttttaccgtggtttttgcacacgtggatgacatgtcggatgccacatcagcccttcgcctgagcttgatgaaattcaagttcatttgctagaacctgtctgagtgttgcttaaatcaatttaatacaaattttagacagatttcacagaaaatttacacatatcaaattcctgaacctgtctcaatgttgcttagaccagccaaatacatgttgacagacatatcaattgagtacacaacgaaagtttattgccatcacatacataacatagatatagattgcacccataaggatctaccattgtatctaaaaagttgaaggaaaccataagcagatttgtccactaagagtgtgtttggttcctggtcaagattggatgggatacggcggtccatattttgctggatatggcggtccagttttttgtttggttgtgtgaatatgacgatccaattttttgtttggttgtagggacaaaggtagatttggtgatccaattttttgtttggttggaggaagtatggtggatttgtaggtgtggtcacctctcacttgagatggtgaatataccccatcaaattaatacataatacacattccattataaatacacactccattataaatacatattccattataaatacacatagaaaaaataaaaaagaaaaagaaaaaagaaaaaaaaaagcagcgccggatctgggctcgccgacgccgttggcagcctcctcccgtcggcttcctcccgccgccggccacctcctcccaccgccgcggctcgcctcctcccgccgctgccttcctctctcgtcacccacgccggccgccgagctcgtcgcctctctcgccggccgccgagctcgtcgcccttctcgccggccgccgtgctcgtcgcctcgctcgcgtcgtggtggtgaggggtgacgcgagtcacgcaactcgcttgcccggctcgcccgagcctcgggcggttgcatccggccaaatcagccagatccctctatccagcatctagagggaatattcccctctgggccgccctatcccactctcgcccagcatccaaacaccctccaaaaagcggcggccatgtcctatctgggtatatcctaccaaccaaacacaccataagccacaatgcaactatcaacaatactaatccagcaataattgacaacagaaattcccttccctcttctaattcaatacattaagtttacaagctgaatcatctttctccttgagttttcttgtccaatcagccacatctctattgcacacaccattgtgcacaacctttagctcatctcttgcactgacaagacatgctctcatctctgagttctccttcaaaccatgaacaacattgtgcaaatcatttaacacctaccttaaataaggtgtagtttctggctcataccatctccagaatgcacagcaaccattccgctcaaatagaagaaaaatcgtacaatattatatccatttaaacaacaaatgcattatattaatattttaccaactcacgcgagctctcgcacatgtcagatacctcctagatggattattcccactcaagaaatccatctgaccgtcattgtacccacacttgcatagaatagccggagaataatcaaattgcccctccctttgtcgaattggaggtggattgctcccgccttgactggatttgctgtcatttccagaactagtcatgtccttcgatctgcttgttccaccggctgcagattccacctgctcatcgtcgcttcttccttgatcagccatctctatagcgtgtgtggcttccatcggcaaccgtcaccgctcgtgagaaggttaggccaaaacaacccagcaaatcctacgcgctgacgtagtgaagggctgatgtggcatttgacatgtcatccatgtgtgcaaaaaccacggtaaaaaacagctcgaagggttaagtgcccggtatcgacagttggaggatgaattatacccggttccgtagttcgtggttgcatttagataaccataaaagttcgagggtgtaaaatggacttctcccctgtaagcctaacccatacagaaagcttaattcaagcttcaaattaaaggggttaaagaatacaaaaccaaaaggagtttttctggcttttttgcaacctgatccagcgtaacacccgaaaaattgcctactcgtcgacggactctcacgacccgcgcgcgccacgcaagaatcaaagatccccctccagcttcaaacacgctagccgacgccgccgccgccgcggcgacggcgcgagcgacgcctcgtcgcccttggagaggcctcgacagcgcgcggcgcgggcgcgccacaagctccgctcggcttagccgtcgccgccgcgaagcgaaggccgggggccctcgccgcgctctcctcggcattccgcgcacgccacctgttcgacccaatgcgcagctagaccggctagagattaaggttgcgcgatcccatgtccttcctggcgcccggacgcggccgcctcctccgggtgctccccacaaggcggcaccgtcttccgcctccccaaggtacgccaccttctctcaccaacgcgtcggttccccgtcacggcctcacggggtaagaatgccactaacgatggtgttctgttgttgtttctgttcctggagggtcaggaggctacgcggcgtgcttccggcggtgcaaggcgcacttcttgctcgatggagtcgaggatgcggtggagggagccgccgagccgcagcagccaccggtgtcacttgcgaagagcctggcctctctcaccgaggagtcggccgtggccgctcagaggcagaggaagcccctgctgcggatggagcggaagaggctggctgagctcaggatcaagaagagggtcaaggcgcagtatttgaacggcaagtttcatgatctcatggctaacgtggtggctagcactgatactttggaggatgcttatgacattgttcggctcaattcaaatattgacatgtcatcggtgagggatgatgtttgctttgctacattggcggagctgctcaggactggtgagttcgatgtcagagcgaatgtttatgcggtggttgcaaagaggcgagatggagggaggcttgttctcccacggttgaacttgagaattattcaggaagcagtaagggtggtgcttgaggttgtttacagaccccatttctcaaagatatcacatggctgtcggagcggccgagggcatcagtcggctctgaggttcatttccaatgaaattgggattccagattggtgctttactatccccatgcataaagaagtagatagaaatgttctctctaagattatctgtctaatacaggaaaagatcgatgacaatcagttagttacattcatgcaacacatgtttgatgcagaggtgatcaatttggtatttggaggatttcctaaaggccatgggcttcctcaagaaggagtacttgcgccaatcctaatgaacatatacctcgacagttttgaccacgaggtgttcaggatttgcatgaggcatgaaggccttggttcagaggcagcagatgtttcagacaaccaggagtcaaatttgcgccactggtttcgaagtcaaatttcaggcttgaaggatagggaggaaaacagtgacaatcaaacagactatccactaaaaacaaaactatatgcttgtagatacatggacgagatctttgttgcagttgttggatccagagatattgcagaagatataaaatcggaaatgattacttacttaagaaaaacactattcttggaagttgatgacaggttgtatcttatgccggtcagaagtaattcccggggcttacagtttgctggctctatggtaagagttacaacaaaggaaagtgctgcactgaaagctgtgcataagctgaaggaaaaggttcatttatttgcttctcagaagcaagagatatgggatgctatgaatcttaggttaggaaagaagtggttggcatatggtttgagaagagtaaaggagtctgagatcaagtcacttggtcttagcacgcctttgttggatcacattgcacagtttaggaaagactgtatgaagacagatcattggttcaaaactttactcaaggtatggatgcaggatatcaatgctaaacgcgaagctgatgagagcatactcctgtcaaaatacattgctgaaccatcacttccgcaggacctcaaagacgcgttcaacaactttcagaagcaagccaaagattacatctcatcagaaactgctgccacagaagcattattgtccagcttaaagaataaagaatcagctattacctgcactgatggtgctgtcattaagatccatgctcctattagctatatccataagtgccttaatcgttatggtctaattaatcttgaaggtttccctaagcacgtttcagcccttgttttgcaagacgatgagctaatcataagttggtttgcaggaataattcaacgttggatgagatggttctcagaggttgacaattttaaagaacttaagcttatgttggttgaatgtgtcaggaaatcctgcatcaggacattatcggcaaagtaccgaatgtatgagaaaataacagaaaagcgatttgaacttgatgattatggtattccaatggccgaggactttgaggcaataatggcacctttagaatctagttcgtcggtttgcactgatgaagctctgatgtatggcatttctagtagtggattgtttgtgctcaccctctcaagagttagagttccttctcggcaatttgactgttttgtcatgggatgccaatctgcatcgctgagtatgtatgttcttcatgtcaaagagagacagcggtttccaggatttaggacaggtttctcatcatcaattcatggcagtttggatggtagacgggttgggttgtgcactcaacatgttaaggatttaaatctaggacacatctcccttcagtcgggctgcaggaat

SEQ ID NO: 24371 - DNA, 3008 bp, Oryza sativa
aatggttctaagaattgggccaatttggttaaaaagccccagggggccttcgcttccaaataagtgatattactggttcatacatgtattgccttctaaagctgagaacttggtggcaataacactcctctcttgatctcataggacaaaggtatatgcttacatttaccatggtacattgtttattcgtgttgcatatgtatacaactgacatgtttgaggattcagtcattaatgtgatctctacgttaaccatggtctgttgttcctgttatctgagcttacaacatcttgataggtctgcattattctcgttccccagtacttaccatgtgacactacactctaatcaatgttttttttaatgtaaatgtgatggcaccagcaatgcacgatttccattttatatcatctagttgtgcaataccaggtatgcgtaaatggaaattatctcagcttcacaatatttcactttaaagaaacaaaatcccatgagcataaacagtaggtgataaaataataaagcccatgtcattatgtttttgtatctactacttttccctgaatttatataggatcgatcatagctaatgaaatccatctgctttagatgggctgttataatgcaattatgcaaagtggtgctacatcaactcattggttatatgttaatttcactactcatatacgtgggagggaaaaattgaattcctaactggaaatagacagttttgattatgtatgtcaacatgtaggtggagagctggtcttatccaccaagagaatttcatacaaggacagaacagcgttctcatgttcacatgaggcaatagcaggcaactcatggactttggcaaggtttggttttctacggtaaaccattgttttcagcttgcatattctctatttggttgtcacgtaaaccagcgatggccttctgtttaaactcatgtcacatttgatctcttgatggggctgactgttccacttcctctctgatgcctatgattcaaaatttgaactgctttaaataatctgtgaggcatcaagttaagtggcccaattgttttattccttatgatacattacaaagcaaaacatcatacagttatagtgagacaccaccagacattagtttgggccataatacatgactcaggcttgagtgccttgccctttcttagttatgaactggtggcctcctatgggggttggcatggtaatccttgttaagcaatctgagaacttcatctctggactccagcattttctccttccagtcttcattagttctatatgagttgcagcaaatactcgaacctttttgttcttttttggagcccaaactcagatgcctgtaataaggcttgaatggcagtattatgatatgttggggatttggtatgttcagtgtctgctcagatgtgcttccttctagttttatgttgtccacggatggtcttgccttcatcgtcgagctgctactatcctgagagattttgctaggaaatcagtagcggcatatattcctatagtccattagttactcaataagggtaagaaacatagggaatccgcaatatggttgggcatgactttcttaggcatgttttctattggaaagcattaaacatagtcatagagtgggtttgcacgtgtgtgtgactgttttcttgaatttataaggttgacagtaggctttagcaccaagtacattttgcactgtgttgtttgacaatattgcataaagttttgacctacctaacacctagacattttttttgtcttacatgtgcatgtccatatattgctggcaaataacattctcataccagcaaatgtagatgtaggaattttcagttctgtctctagtctatgtcactatgataaaatgtaaaatatgccaacctttgacaaagataaaacatggagtgtgtccatgaaggaagaaaagatcacctttaagcttgaaggtacacgtgagttggatgagtagttgctaatctctcctgcatcaagaccaagaatatattcaattcgaacataatttgttagtgtactaaacagtaagtttcctttaggacttccttttctttatggatatttctttcccttttggtgaactcaagcttgtaagaactaaagaagtatgattgaattagtatatactgaatgcacttggagcataagaaatagtctttttgaaggagcattaacagtactattatgacacagtgaaaacagaacagattactattatatcatgattattaaacacctatatctaacaagagggaaggccataaattgacaaatacaatggccaatcaaaacagaaaacagaaagggtaagcgaaacatgctagttctagatacttggatgtaccctatatacttctagttgttcttgggcgggtggtgccggggtgtacggtaatcagctgtgaagggtatgtggccatcaaagttaacccctggaggaaattttctacttctaaaataacagttcatactcaaatcctttcttcctccatgcccacattttccaacagaatgttttgcacctgagcttggtttgcttctagcatcctttgggtggttctccatgactgcaactccaaaagccatcttccgtcctgcaaatattttgcttttgatctcctcatatgttctggtttcatctacaccatgatcctacaatcagagtatctgtagttagaaatgagtttggatattaaatttcattgagtaaaaaaagtagaatttacataagcaatgctttgagtaattctagtcctaccagcttgttttctgggcctttctcactgtaagttgccatcatcagttctgaaaacaggtaatatgtaacgtcagttctcacacatgctatttacacggaggaggaaataaacttgaaaagaaaaggaaatgaatcagcttgtacctctatgtgcaatggtgacaaagggtccaaatgttaccgataggatggccagcccaagcaggaa

SEQ ID NO: 24372 - DNA, 5725 bp, Oryza sativa
aggactatatgagcactggtgctctaccaatccattggtcaaagttagagttgcaatatatatttcctgttcatagaatgctgcacctgtacttttaattcatacaataatctgaagcctcatcacttttttttattagctttagtatattcatgtacttggaagtactaaaagtttgtcccttgtcatttgccaagcagttctttccaaagatcctacatattgtaaaagtgctccaaggatctaccattgcttgggatagaagattttgagtatcttgggcattcagcattctgccctacgtcgccctgtcgatgcatggaacgatggagaagaggcaaagtctagtggccaactagaaaggtttccggtgaccaatgccagaaccttgggtttcacctccctttgatctaaagtatgccattggtaacccccacatgtaccttaaaccatattgatgcatcagactcccaggtgataataaactaaaaattacatgtggtgtggggtgaatcagacgccctcggtacacaagagcgtacccgtgtaccatgttctacccctgttgtcggtagcaccaagggaggcttcggctttgatgcacggtgaatgcattttccagtgaattggttgaaatttgatctattttcagagaacacattattcaagcatagactaacttgagggttcctcttttcaggtgtgatcacggcaggtgactcgtaaagcatgggcaggatgccagcttgagctttggtgctgctgctggagggcattggccctagaacccctgctcctggtgtgcggattcttgctgtacctggaatgtactaatctcagacagtcagctcggtcttccggattcaagctgtaccagctgcgtgcccgctcttgccttcacaactcacgttgcgcgaaaaggtttggagagctgaactgtttctcttgcgtctgtaagtctgttcacctgaagtctattagttcatatgcactagtcaaattggtagctgtttttaaacatcaaggtcatgaggtcgtttgaaaacataagcagatttgaacttcccactaatagaatttttgtatcgttatgatgcagttgtgtgtgttggatttcgatgctgaagatagcaagttggcaatttcatcgtcaacttgatgctgtttcacatgttttggtgcaaacagttgcgggctgtttcgcacaccacattcatgcgacacagtacaagcacagggtatgcgcccaaatgcccaatacaatctgggaattttgtcggtggattataactttctagtggcgaggacaatcgtacaaacatctgttgtctataatttttcacaatttatttacataatgttgtacacttgtgtagtactagcttggctactcgtcgctttctgttaacacgcttttcaaacggttaaatggtgcattttacatgaaaactttatatatataagttgtttaaaaaagtataataaatgtattcatcaaatttttatatattaatacttaatcctatgttaattaatcatgtttctcgttttacgtacggctaattagctgtttcaatcatctaaaaagaacgcagcctaaacgcccatgcgttgcaaccggaattaaaaaaagaaccttactgtacactttaaagcctcaaaaattaaagtaaaactattttcattgtaatatatatatcatcatttttatttcactttaaaataggtttttcttatttgatgacttgacactgggaagagacaaaagttcacctagctcattgtttggaggaccaacatgatagtggtggtggcagattcaccccctcaccactaccaatcaaggttgtcaggatcggaatactagatagtatcgttttgctcaaagtaatatcgtatcataggatcatatcgtagtatcgggatactataagattttctttttttaagtttaattaatatttatattaattatatatagccattctatataaaaaaacatagtaaagatatatgtcatgcaaatagagacatttatcaagagaaacctcgttggttttgatatatttaactgatttttatataaatttgagcatatttatttacattattttcaaaccatattattttatataatatttatagtatcgtagggatcgtagaatcgggatacacctaagattttgtaggatcgtgtagtaatgaatagtaggatcgggatactatgacaattaggatactaggtgggatcagtatcgttttggcttggtatgatcataatatcgtaagatactaagatacaaatcgggatactgataaccttgctaccaatagggtgttttaaagaggtgttggggaaattttggttcgtaacacagttgggacttcgaatttgtaaaataccataaaaacttccccgctttgctggatacgataagacatggtaatttctctagaaaaatatgtaccactatcgtctcaactcttagtctttcggcctactgaaaaaacggtaatttgttggtataatggtattattctgtgacttttagtcatatttaaatttaaatttgtagtaataggatgagttacatctcatattaggtttatttattttgaaatattttttcctatgcctataaagcttttagccttctagttcaatatataatccctttccagtctttctatctcaaacatcacaaagataaaaaccgagaaataccaagacgataataacaatcttcaaggctgtgtagtctacacgctgtgctgaaaaatcaggtaggagagcgtcttgtacgtgcgtgcggccgcgcgagtgtgcgtgcgacacgcgcgcgtcgcgcttttggacttcgatgaggaccacgcgacgcgacgggtccgtggcggtggcgaggccgtcgcgctgcggttcccgatttcgggggggacccagcgagctctcgctctctctcgcgcatgggacggggcgctgggcgaacgtgcgcagcggcctcgggctccggcgaccgcatcatttggtaggccggggagcacgagggccgcccccgcaccccggcgtgccatccaaccccgcgagcgcgacacattttctgccttgaatcaccttccaaagcactactactcctagtaacgaccctctcgcatatcgcactaccagtaccacatgtgttccctacacacgccaaagatgcaagtgacattgggcccttggaacatacaagttcacgactattctactgggaacaagactattttgtatttcgaatcgcatccctagctcaactgcaaaaccggatataacgcctctcctaacttcaaaaattggtgcaaatatactacaaaggcaggattgggcccggttatggctcacaagacatccgacgcggcgtattgattgggtcttcatcccatgtcagtgaaaagaataaaaaacggtaggccccacatgtcagggactatctccttcctctggcctctcccctctccttgttatctcaaggcggcaaccagcaaggagatgggcgacgacgtctcctctctatgagcagtgcaggcgggggtgcctcgtcgggaggcaacgacccgatctggagtagttcctgactgctcctacccccgttcccccgtgagctcgatgaggcccacaccgtctgctgcgcctgcaacctcaagctcgagatccatagtcgtcgtcgcatcttcgagctcaatgacaccgtcgatgcttgcgccgctcgagagggaggacacggcacaccacccacgccactcccttccatctttgttgcgggagcccaagctccatctacaccaccgcaaagctcgaaggccacgaggttgttgcagtcaccgctcgggtaagaggacaccacggccagcgtgaccccaagctctcctattctcttgctctagctcccctccatctctgttgcaggaacctgagctccgtctgtgccaccacgagctcgtcggccactgggctgctacggccaccgctcgggagagaggagaccacggccggcgggaccccgagctctctcgtcgcgaaagagggccaagcctagcggcgacagtcctcttgctccagttcctcgtcatctttgtcgtgggagcctgagcattgtctgtgccacgacaagctcatcagccactgggctgttatggccaccgctcgggagagagaagaccatgaccgacaggaccccaagctctcccgtcacgaaggagggccaagcctagcggcagtagtcctcttgctccagctccttgccatctccatcgcaggagcccaagctctgtctgcgtcaccgcgagctcgccgaccattaggctactgtggccactacaccaaccctcgacgtcgcctcaacgacctgtcgtctctctgtctcagtttctcttctagatctaatgccgtcgttgcctagggtttgttcggttgaccaaccggattcacctcctagcctcgcctccgaccttcgactccttccacatcatcgttgacttctgcatcccatcgttggccaccgggtccccgccactcctgatagcggcccagactcgtgccaattcaccacaactggtcatgtcctatggcctcttgcctccatggttgcatatgaggagagaggaagaggtggaggaaggataaaagaaatgtaactcgcatatgggcccactatatatattttgccatatttcactgacatttaaggtcatgcgctaactcagcgagtctaaccgcagtcaacctaccacgtcagcaggaactgctttccaaaccatcgaaggagcatatttgcaccggtttttgaaattgggagaggtgttaatatatagttttgtggttgagggatgcgattcgatcaagggttagagatgcaaaatagacttattccattctactgaatgcatacagccggccgtggcgagaggccttggtttgaacctgggctatcactataaatcacattcaggcctcaatcctcagctttgcccttttcccttcctagtttcctagtctaggcctcaatcatacggaacccggtctagcagtcctggaccctggtcagatttgggccgaaaaacagttataacagcaccacgagtgtatgaaaatgtattaaccgattaccatccattacccataactcacgagtgctaatggttactcacaaataagtactaatatttgcatatcctttcttactataaaattataacccactaattctaaaactcaacatgcaaacatgccacctcatcatccactaacaataattacatgcaaaactaatacaagcatgcaacatcatctataattcattgaatttacatatcaacatctaatcatcctccttcacattatttttcacagtatttttaacatgtatatatccaatatttttataatccttaacatatattcatgcatataatcaaagtgcgggatatcatgtatatttcatctacaatctcatacatagtctattaaatgtatttatctcagaacatagtctgtcaaactaattttatttgttgttaataactaatataatttttatttttatctcgattattaaaaatttttaaaagttacttaggaatttccgcagcaaagcgtggggaatcacatagttcaccagattgtaagtacttaacacggctacgcagaaactgaatagtattaaaagggcttcactgaagaaaggtgatg

SEQ ID NO: 24373 - DNA, 13105 bp, Oryza sativa
tacgatacttgatacctgaggtaccagatctggttggtacctaaggtacaagatctagtactatgatatcagattcgatacttggggtaccaaacctggtacgcactgtcaggtaccaaatctggtaccagtgtttgatcagatacttgatacctgaggtatcagatctggttgatacgtgaggtaccagatctagtaccataggtatcagattagatgcttggggtaccgtttgatccgagacttcatacttgaggtatcatatctggttgatacctaaggtaccagatatagtaccataggtatcagatcagatgcttggggtaccgtttgatccgatacttgatacctgaggtatcatatctggttgatacctaaggtactagatctagtaccataggtatcagatcagatgcttggggtaccaaacctggtacccatggtactagggttggtggtacctggtctgatacccatgacgtatcaagaccagtagttgtatattaggcctggtacttaaaaaaaagtaccaaagcgtggtacctagcgcagcggtatcatctggtaccaaacaagttatcttcttcttcctctcgctaacacgttgtatcccaattagccgttgatccctaggcatgaaatgaaagcaacaaccaaaaaagaaagattgtgaatagatgcaggcaacaaactagtagaaaatccgtactctcatcttcctcctcctcgtggacatctagccccatgcagcctctgctgctgctgcactcctgtcggcttctcgaggatggtgctgatggccagctcaaatagggtgttacgatcgacgtggcaggggaacggctccgggtggctagtggctcgtgggtgcatagagggcgacacggagggatcagtgtgcgcgtagtgggtggtggatgacgttgtgtagacgatgagtcaagatgaggcgtggggcgttaggtgatcattagtctatcccgttaggacggtattccgttttatagattttctgttaaaaataaggaatattagaagtagagtatagagtccatatagaaatacaattaggaaatacctaaatttcgcaattaaaaataaggaatattagaagtagagtatatagtccatatagaaatacaattaggaaataactgaaattcggaattaaaaataaggaatattagaggtacaatatagagtccatatagaaatacaattaggaaataactgaaattcacaattaaaaataaggaatattagaagtagagtatagagtccatatagaaatacaattaggaaataatagaaatttggaattaaaaataaggaatattagaagtagagtatagagtccatatagaaatataattaagaaaaaaaatagaaattcggaattaaaaaaataaggaatattagaagtagagtatagagtttatataggaatttaaaattaacctaaactttggaataaacataataaaattaaagtagagtttagagtccgtataaaaatacaatttacaaatggaagaataacctagagtctatatagaaatgcattttacagataatgaaaattcagaattaaaaaaaagaaatattgaaagacgagtctagagtccatatggaaatataatttacaaataactaaaatttaatattaaaaataattaataactaacacgtatatataatacagtataaatattacacatgagtagtttcgtaaagttagtacaaaatttaaaattatattatcattttaatatttttaaataatacattgagaaagcatatatgctattacttaagagaaaatataatgatgctagtcgcgtaatctgtgcgggcctccatgctagttaattttgatataccaagatttctattaggaatgttgctgaggaaaataaagtcagctctgtttggacaactaggagatagaatagaaaacacattcctaagatacagatgcacatctctgtcatcttggggctctacatggcaattagtatctctttcatcatcaagcaatcatagggataaatgggtttttaatttttcaccgagacaatgccattgcttcatacaagacaatatatagccgcgagcagtacgtcgccggccacgtgtgccgcgcggtggccggactagctgcatgcgttaccagtcaggagattgtactggaggaggtgcagttgtttcgatctgatcgttcatctagaaagggatggcgaaggtgtagtgtgtcttgcggtggcttaagactgaggatggtttggattcacatggtttatgttttgcatctcttgttcaattctcgatttgtttctactggggtaggtgaggggaataaacaagactttgtgagacatctaaattggactctactgtatttattaattttgatctaccaagatttttttctaggaatgctggtgaggaaaataaatacaccttttatctgaataaaagagagagataatagaaggacattcctaagatagatatgatcatcttcatcaatcgatcaattgcaaactagatgcacatccgtgtgcctaatttggcgactttctttctcatcttggccgccggcgatggctgcggcgacgcatgtgatggccatgcgatgttggagaagacaccattggggaagaaggttgtcatgacaacatcatgggctatcaacaccgacttttctggttatggcacaactgttgcggtggtgagcttagtcgtcaccggtgccggtgccggtgcagctacggcagaggcagcgggtatgtatgacaccgggaaaatcaaagaatttggctctagtgacggtgccggtgcagatactaaataaaaagggccaccatttttatgcaactttgagctctcatgttattattgtagaacaaaagaactcacacacaacaatagataacacattaattcatgtcaacataattaatgtgtgaaacacacaacatgattggggagttctaaacaagaccaaagtatgggtaacacattttaaattcgtggtaaacaattaacacggaaaagtgtctaattgaccagaataggtttcaatagtttttgttcaatcataagaaactagataaacatgtttgctaaattacataatagcacaggtaaattaaaccagcgtcattacaagatgaatacaaacaacttagtaaattgactgatacatagcacgtcaactgaagctggtgctttctctgaatcatcgtcttcattcgtaattggatgatggttcgttgaggtcaaagtcaaacactatcggcctctcattcccagcagcaccttgggtcaacgaggatgcgacatcggtggcagcctgagccgacgaggagggaacgtcgatggcagcctgagctgatgaggaggggacgttgatgaaagcctgaaccgacgaggaagggacgtcgacagcggcttgagctgacaacgatgcgacgtcaacggctgcctgagccgacgaggatgcatcgtcagcagctagagacgacgaggtgtcaacgtcgaggagcattgacatcgagctcagcagcacgggctcgccctgctcaccgtcgggcacatcagcgaagaagatgtttggatcaaagtccagagcctcgtggacggcgtagtttgtcggcacaccgccaggagggatcaccacctggaagaaggaatcgctagccgccggcggtggcggcggcggtggcggcagcgcatgcgatggccctgcagtgtaggagaagataccgttggggaagagagttgccatgacaacttcatgggctgtcagaatccgcttttccggtaaaggcgtagctgctgcggttgcaagttcaggcgtcatcggagccggtggccgtgcaactacggcagaggcggtgagtgttgatgacaccgaggaaatcacagcatttggttccagtgactgtgaaggtcatgatactagataaaaagggcaccagtatctttatccagcagcaggactttcactactttcccaagtaaagctagtgttaagagactggattgtagaagtgttgactgacttgactggaaatataatatggaaagactgatggactgactttatacaactttaagctctcaggtgattattcttgatgatcaaaaaactcacacacaacaataaataacacattagttcatctcaacataattaatgtgtgaaacacacaacatgattggggtgttctaaacaagaaaaaagtatgggtaaaacacattataagttcatagtaaacaattaacatagaaaagtgtctaattgaccagaataggtttaatattttttgttcgatcataagaaactagataaacatgtttgctaaattacatgataacacaggtaaattaaaccaacgtcattacaagatggatacaaatgacttagtaaattgatggatacatagaagatcaaacgaagctggtgctttctctgaatcatcgtcttcattcgtaagtggatgctggttcgttgaggtcgaagtcaaacactatcggcctctcattcccagcagcaccttgggtcgacgaggatgcgacatcggcggcagcctgagccgacgaggagggaacatcgatggcagcctgagccgatgaggaggagacgtcgacgacagcctgaaccgacgaggaagggacgtcgacatcagcctgagctgacgatggtgcaacgtcaacggctgcctaagccgacgagggtgcatcatcggcagctagagacgatgaggtgtcaacgtcgaggagcgtcgacgtcgagctcagtagcacgggcacgtcctgctcaccgtcgggcacatcggcaaagaagatgttcggatcaaagtccggagcctcgtggacggcatagtttgtcggcacaccgccaggagggatcaccacctggaagaaggaatcgctagccgccggcggtggcggtggcgcatgcgatggcgatgtaggagaagacaccgttggggaagagagttgccatgacaacttcatgggctgtcagaaccggcttttccggtaaagtcgtagctgctgcggttgcgagctcaagttttgctggaaccggtggcggtgcagctgcgccagaggcagcgagtgtagaaggcaccggcgaaatcacaacatttggttgcattaacggtgcagttgctagtgctgatgcagatgcaggcaccaatgccggttctgtagcaggtgtgggtgccgacggcgatggagtacccacggtcaccgcagtcggaatgcgtccgcgtccgcgcccgcgcccattccaaactccacggccacgactagcaaaggttgcctcagcaacacgcccgcgtccgcgttccggtccaccgcttttggagagggttgaggctgtttggagcttcctcttcttgggtacaggtgcagcagctgcggctgcaactgcaggcggcggcatcgggaccaggatggcttcaggcaccgccgtcggcggtgccaccgccggtgcagcagcagaggcgcctggcgcgagtgtggatgaccccggcgaaatagtggcattcggctccattgttggtgctgatgcaggcaccggcactggagctgcagaaggtggcagtggagcacctgcggtcaccaccgccgaagtaagtccgcatccacgcccacgcccacggtttccacccgcaacggcggcatcggcaacacgtccgcgaccacgtgcacgtccacggccgcgctctccaccgcttgcgaagagggttgaggctgtctggagcttccttttcctatcgggtgcaggtgcagcaactgcggttgccgctgcaggcagtggcggcggtggcggcgggatcgcttcagctgccaccggcgccggtgcaaatgcggctgcagcagaagcgctggctgcgagtgtggacgacaccgtcgagatcggtgcaggtgcaggtgctgatacaagtgccttcgccggagtggcagcaggtatgggcgccggcggcggtggagcacccacgatcaccaccgtcggagcgcatttggtttcggacccacgcccatggccacgaccggcagcgttggcgatggcaacacatccgcgtccccgtccaagtccgtgctctctgctgcttgcagagagagttgcgggtgtagcaggcggtggtgcgagcgcttcaagagccgccagcgatggagccggtgccggtacagcataagcgggcgcgagtgcggatgacggcggagaaatgacagcattcggctccaccggcggcgcaggtgcatgcacagcaggtgtgggcaccggcagcggtggagcaaccacggtcaccgccgtcggagcgcatttgcctccgcgcccacgcccaccaccgccaccgcgcccatgtccggtaccgacaccgcggagaagtccacgcccaccaccaacaccgacactggcgccgcgcccgcttccccttccaccaacaaatgcaccttcatcagatgtggcaccggagcaacatcagatgatgccggtgcgcctgcaccgaaaccggagatgcatcagatgacgtcagcgctggcactggagccgcatcaaatgacggcggcacgggcacctgcaccataaccggagatgcataagatgacggcggcgctagcatcggagctgcatcagataacggaggcgcggccacctgcaccatcaccggagacacatcagacgaaggcggcggcacaggcagcaataggagaggagtaggagccggagcctcgtggacggtgtagtttgtctgtagactaccgagagggatcaccgccaggacgaaggtatggctagacggcggcggaggcggtggcggagcatgtgatggccctgcaatgtaggaaaaggcatcgttatggaagagggttgccatgacaacaacgtgagttgtcggcaccggcttttctagcaatggcgcagctgctgcagttgcgagttcatgcatcgttggagccggtgactgtgcagctgtggcagaggcggtgagtgtggatgacaccggggaaatcacagcatttggttccagtaacagtgaaggttaagatactatatataaaggtcaccaatttttatacaactttaagctctcaaagtgattattcttgatgatcaaaagaattcacatacaacaataaataacacatcagttcatctcacaataatgaatgtgtgaaacacacaacatgattggggagttctaaacaagaccaaagtatgggtaaaacacattttaaattcatggtaaacagttaacacggaaaagtgtctagttgaccaaaataggttcagttggcttacgatagtttttggtcgatcataagaaactagataaacatgtttgctaaattacatgataacacaagtaaattgaactaacgtcattacaaaatgttaacaaatgactaattaaattgatggatacatagcatatcaacaagatcatgcaataaagcaaaatggtcatgagggtcaagtaaaccaagagatctagttaaggatggtccttctcgttgtctccatctcattagtagataatccagttgatcgcgatagactcatcaatccgaagctagtgctttctatgaatcatcgtcttcattcataattgattgtcggttcattgaggtcaaagtaaaacactattggcctctcattcccagtagcaccttgggtcgacgaggatgagtcgtcatcggtagcttgagccgatgaggaggggacgtcgacgacagcctgagccaacaaggatgcgatgtggacggcagcctgaaccgacgagagtaagggacggtgactgcagcctgagtcgacgatgatgcgacgtcaatggtagcctgagcagacgaggatgcatcatcgggagccagagacggcgaggtggctagtaattggaaggagattgacttgcgagatgattcacctccatggattgttcaatggtgacgtcgggcgggtgtcaacaccgaggagcgtcgacatcgagctcagcaacatgcgctagctcatcctgctcaccatcaagcatgtcggcgaagaagatgttcgatcaggtcgaagtcaggagcctcgtggacggcgtaatttgtctgcagactgccgggagggatcaccgcctggaggaagatattgctggacgtcggcggtggagacgacgacgcttgtgatggccctgcgatgtaggagaaaacatcattggggaagtgggttgccatgacaacatcgtgaattgtcaacaccggcttttctagcaatggcgcagctgctgcggttgcgagttcaggtgtcatcggagccggtggtcgtgcagctacggcagaggtggtgagtgttgatgataccggggaaatcacaacatttggttccagtgactgtgaaggtgatgatactagataaaaagggaaccattttgtacaactttgagctctcaggtgattattcttgatgataaacaaactcacacacaacaataaatcatttggtcgttaacaataacacattagttcatctcaacataattaatgtgtgaaacacacaacatgattggggtattctaaacaagacaaaagtatgggtaaaacacattataaattcatgctaaacaattaacacaaaaaagtgtctaattgaccagaataggtttcaatagtttttgttcgatcataagaaactagataaacatgtttgctaaattacatgataacacaggtaaattaaaccaacgtcattacaagatggatacaatcgacttagtaaattatcggatacattgcagatcacccgaagctggtgctttctttgaatcatcgtcttcattcgaaattggatgctggttcgttgaggtcgaagtcgaacattatcggcctctcattcccagcagcaccttgggtcgacgaggatgcaacatcagtggcagcctgagccaatgaggcgggaacgtcaatggcagcctgagccgatgaggaggggatgtcgacgacagccagaaccgacgaggaagggacatcgatggcagcctgagctgacgatgatgcgacgtcaacggctgcctgagccgacgaggctgcatcgtcggcaaccagagtcaatgagttgtcaatgtcaaggagcgtcgatgtcaagctcagcaacacgagctcgtcctgctccccgtcgggcacatcggcgaagaagacgtttgggtcaaagtccggagcctcatgtatggcgtagtttgtcggcacaccgccgggagggatcacctcctggaagaaggaaccgctagccaccggcggtggcggcgcatgtgatgacccggcagtgtaggagaagacaccgttggggaagagtgttgccatgacaacgtcatgggctgtcagcaccggcttttccggtaaaggcgccgctgctgcggttgtgagctcaggtatcgccggcaccggtggccatgcagctacgccagaggcagcaagtgtgggcggcaccggtgaaatcacaacatttgactgtattaacggtgcagttgctgatgctggtgcaggtgtgggcgccgacggcgatggagtacccacggtcacctcagtcggaatgcgtccgcgtccgcgcccgcgcacactccaaactccacggccacgaccgacaaaggttgcctcggcaacacgcccgcgtcctcgtcctggtccaccacttccggagagggttgaggctgtccggaccttcctcttcttgggtacaggtgcagcagctgcggctgcggctgcaggcggcggcatcgggatcaagatcgcttcaagcgccgccgccggcggtgccaccgccggtgcagctgcagctgcagcagaggcgcctggcgcgagtgtggatgacacgaccggcgcaataatgtcattcggctccagtgatggtgctgatgcaggcgccggtgctggagctgcagaaggcggcggtggagcacccacggtcaccaccgctggagttagtccgcatccgcgcccacgcccacggctgccaccggcaatggcggcatcggcaacacgtccgcggccgcgtgcacgtccacgtccgcgctctccaccgcttgaggagaggcttgaggcagtcaggagcttccttttcctttcagctgcaggtgcagcagctgtgcttgccgcagcaggcaatggcggcggcgggatcacttcagctgccgccggcgctggcgccggtgcaaatgcagctgcagcagaggcgctggctgcgagtaccggcgagatcacagaactcggtgcaggtgcaggtgctgatacgaacgccttcgccggagctgcagcaggtgtgcgcgcctgcggcggtggagcacccacggtcaccgccgtcggagcgcgtttggctccgctcccacgcccacggccgcggccggcgaccgcagcgttcgcgatggcaacacatccgcgctctccgccgcttgcggagagggatgcaggtgcagcaggtggcggcggcgcgagcgcttcaagagccgccggtgctggagccggcgccggcgcagcataagcgggcgcgattgacgctggagaaacgagagcatccggctccaccgacagcgcaggtgcatgtgcagctgctgatgcaggcgccagcgtcggggctgctgcacctgcagcaggtgtgggcaccggcggcggtggagcaaccacggtcaccgccgtcgtcggagcgcgtttgcctccgcgcccacgcccgccaccgccaccgcgcccaagtccacggccgccaccaacaccggcaccggcgccgcgtccccgtccaccaacaaatgcagcttcatcagatccagatgacgtcggagctggcacctgcaccggcaccggcaccagagcaacatcagatgacggcggcgcgggcacctgcaccggcaccggagatgcatcagataacgtcggcgctggcaccggagctgcatcagatgacggcggcacgggcacctgcacaatcaccggagatgcatcagataacagcgtcgctggcacaggagctgcatcagatgacgacggaggcgctgccacctgcaccgtcaccggagacacatcagacgaaggcggcggcgcaggcagcaacaggagaggagcaggagcaggagcctcgctcgcctccgcctctgccgccgccgccccacgttcctccaccacacgctcgcggcgagctcgagctcggtcgaagaacgctagcatggaccgcatctccgccgaaagcggcgacggcgtctgcgcgggatcgccgaagttggtcgccgccgcctccccgcgcagcacccgcgccgccgcgtcgtacgcccacgccccctgctccgccgtgtcgaacgtccccagccacagccgcccggcccccgtcgggttgtggatctcggcgacatacctcgtcccaaacctcaccctcaccccacgatacttcgtctccgggtcaatctcctcccactcctccgccgccgcctgacgacgccagcgccgccgctccacggcggggacgacgcgaacctcgccctccaccaacggcgaaaccaaaacctccgccgacgccgacgacgacaccacctgatccccctccatgacgggcacaatcacgagctccaacccggaaccggccctcaacctctccctctccccgggcgacagcagaaatccgccgccgccgcccgcggcggcggcgcggcggtactcgttcccccgtacctgcacggcgaggcgcgccgactgctgggagtactccaccagcaagcctttcatcgcctccgctactctctcctccggatccattcctgcgacctactcgatcgagactcgtgagagattgtgtggagagagaggaagaagagatcgatggcgatggagatcgatggatggcgaaatgggggtggcggcgtgtgggatttaaggaggaggagagggggggggggggagcgtgtccgggcgtcgtcgcggcgtcttcaagccgagagctaggtcacgctggggttgcctttgctgccgtcgtcgcgtcgtcttcaagccgttgtgacgcacgcgggcgtatgcggacagctagcgtgggctgtgcttgcatggctgcatgcgtcaaccagtggactcgatcctctggtttagggaaggaacttgaggggatgcggttggttcgatctggaccgttgatcgtgaaagggacgatgagcggtggttagcggtgatgttttgggttgccgttttggcttttttttttctttttctttttcttttttgtgcggggaatatgtgcttagccggaagcgtgagggtttgcggggaatatctcctatcttaatcttcctatctagccagcagaaggttgtcagggcaggtaattaatgtggtggggttgttaatgtgttgctaaacatggacgtgctgcagtaattagctgcctagatcagcaaggtttgaaggtttagctttgatggatcagggcagtaccgttgatcggattgagaacatagttttcttgtttccttttctttatgacttatcgatatgcttcctccttataaaggataatcaatttctagctatgaacatggacaagcatttgtccaagttcatatatagctgggaattgatttttttcaaatggagggtgtaggctgatgacttgtatgtttctttttttttctttgtccgaattgcaatagtgttgagaaaatttggggaatgtgaactaggtgatgtataagttgattaattcatgatcaaataacgtcatagtcgtgttataatgttgtgtgtgttccattatttacaaatataatcgatgtcgatttatgcgtgtggcactattaaattatgtccgtatacgacatcgattcctcatgcgcttactaggtttaaacacaatattctatgccatcatcctcttctctttcgtcctacatttatccccctttataaatttatttctaacctataagaatcatcctaaaaaaagttcatttagggcccctttgaaacgcaggataggaaaaacatctagatttttcacattttggtccttttgaaaaacttatttcgcaaatagacccttgaaaaaacttatcccagaaatggtcctttttggggcgcc

SEQ ID NO: 24374 - DNA, 978 bp, Oryza sativa
cccccccccccccccacaaattttttatttttcttttatttgtttgatatttttttttcacgcttagggacaggcaagaaccaaccatagaaaaattgaactcaaatggacataatatgtgacctgtagaatttttcctctcatctcctctcttcgaactagtgcagaggagacagatgtgcaaattttttatttttattttatttttttgatatttttttcacacttagggacacacaagaaccaaccatataaaaaataaactcaaacggacgaaatatgtggcctgtagaattttccaaagctctaccaaaaaacttctctcctcgaaaacacaatcttgcaagcggaatttggaggttttagtatcgccaaacccggcgttgccagggagaatcggatgtaacattttctgtagattatttgcctgattccgagtccgtatgagaaagttacgcctattttaataaatgacacccgaatgacttttcggtagagctttggaaaattctacaagtcacatattttgtccatttgagtttattttttctattgttggtttctgtattctcctaagtgtgaaaaaaatatcaaaaaaaaataaaaataaaaaaattgcatctctctgtactgtttaacttatggctatcatttcatgtggttatattttgaattagagattaagtaacttcatatagtggtagagtgcattatgtttaacatgctgatcaaagggttttactaaagaagttatggtctaattttgatgaaggtgcaaagtaggctaagtggtatgctattttcggatatctagctaagtggtatattccgttcgagtttaaattttttttgtttttctctagtggttggttgtatcgtgatcctaagtgcgaaaaaacatccgaaaaaataaaacaaaaataaaaaggttgcaactctatataaagaaatagaaatggaggcgaggggtggggggga

SEQ ID NO: 24375 - DNA, 5294 bp, Oryza sativa
  unsure (1)..(5294): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtcccattggacgacggcgccagccactctggcgccccaaaaaggaccatttctgggataagtttttctaagggtctatttgtgaaataagtttttcaaaaggaccaaaatgtgaaaaatccgcggaaaaacataggaataggaaaaacgtaggaattggagtggcatattttcctaatcctacaggaatggaaaacacaggaaatatgaagagagtccctttgatagcaccataggaaacaaacaaaataaaggatagtttccaagaggttgaacctcttgcttattttcctatgaaattgagctataggaatgcaatcctaaggaaaatttcctatactttcctatgaatcaaagggtttcataggaaaaaatccttaggaaattaaatcctccaaaattcctatgacaatcctctaattcaaaggggcccttatatctcattacgcctaccgtcggctgcaaaccgaggaattttgctttgataccccttacctatctatacaccaacactacttttatattaattatggtatagagagggttgcattggctattctttggttttgattttgtgcctattcataaattaaaatcattcaaaatcatcttccatatcgggatatgtatttttgtccataaaaattttattgctggattctatgaaatcaaacaccacatgtatatctctgtctatgttgtgtataacaataataaatttgttatgaaagccaacaaaataagcgtatatatctattcgccatggtactattgtaggtctatctgcatatctcttctagaattaaataagcatatctcctgtcttatcttctagtgtgtgatttggtttgaatttattctataattttcaatacagttctattgctacatatcgcagttaaatgatgattaggatgacaaccaaccatgtcataaataagagctagtagtgctaaaaccaaacgaccaataatacatagcttttgtcacgaacgagcattgtcctaccaattttacttcttgattctaaataaactagctcacataacaaaacttgaaattatatacaccaaactgaagaggtgccaagaacaatgtatatgtgtatctgctctttttttttatcaagagcaagttttatattgtttgtttgtatatatcccctccttattgttgtctcactcctaacttttactatagtctttttgttaatggagctagcattgctgtatatatgttgattgccgcttttttcctcctcttttagcgcatgtgtacttcgccggaagggtgaggcttgcatgcgaggaacatcccgtctaatagtagccaggagattgtgagggcagtaattaattaatggagatgctctgcagtaactaccttcctagatcaccaccaagggttgaactatggatgctgcacagcacgatgggcagattttgatcgatcggagaaattggtatatgtacgttcttatcaagatgttacttagcgcatatgggtcttgtcgaaacatgatttcggcaataataaaaggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaaccctccaaataacatgatccgagtgatataccaactgctttgtaaaatatgatgcgtacaacctaaagttgacaacatctttgaaagttcacatagcaaaacaactataaagaagcttgaatgctgtgaataaagaaatctccaaagtattgggcatacgccatgcgcacactgcttcaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagtcataatattggtcaataaaaatgcacacttacgtggcaaaaagcaatgatattgtatccaatcaattgcttgataaatccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctaggtaatatagaccaagtgtagctcatatgaatagcttctgatctgatagattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagagcccagcgataaagttgtgtagccatggcagcgaaataatcagtcggtgacagacgaggcaaatcaaaggcgatgacaaaatccaccaatcatggagatgaagaaaatagtcggcgacgacaaatgcaactgacatgatgaagatgacgatgtcggtgatccagtcaatagcagcgtcacaaccaatgataatgacgaagacgctcatcagcatttgcatagtaggtcaaccgtcaaggtgaaataataagtcggcgaaaacataatcatccattagcaacagcggagatgtcagggccgatgaagcggaggtgctggtgatgatgtcagtgacaataatccatcaaattagtgttataactgttgtagatgcttcacttggaggagagttgatgttgttgcccaactcgtctaaaccgaaatatttaaagtttgttgaagtagaatgtctgctccgaatcaaagatgaagataatgactcctggagttgactcgttggttgatgaattgatttcttcagcctgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtgaaataacatggcatcgtatgccgagatgtcgaggctaacaaagacgtcgtggttggtgaagtagcaaaacttgcgaagtagcagcaatagagtttgccagtgctgaagataataaagatgaagtcgctctatcatgatgacaaagttgcattgccgtgatgaagtgaacacgagtcggcggcaacagaagcaaactggtagtgaagacgcgcagttgtgaagataaaagcaccagtcagcgacagcataaccagtcggcgacggaaaacgatgatgtttatcagtagtggtagctgtctaaaccagacgtagaggtgagggcactagtcagcagtagacgtagacagcttgcgttgaagatgatgatgcctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataacaggccagccgtgcaggcggaaacaccagtcgacggcggtcgaggcggccggtcggtgaagacgtagacgcccaacaacggcggcataaaggccagcagtgcaggcggaaacaccagtcagcggcggacaaggcggccggtcagtgaagacgtagacgcccaacaacggcggcataataggccagccgtgcaggcggaaacaccagtcggcagcggcgaaggcaagccggtcagtgaagacgtagacgcccaacaacggcggcataataggccagccgtgcaggcggaaacaccagtcggcagcggcgaaggcaagccggtcggtgaagacgtagacgcccaacaacggcggcataataggccagccgtgcaggcggaaacaccattcggcggcggcgaaggcaagccggtcggtgaaaacgtagacgcccaacaacggcggtataaaggccagccgtgcaggcggaagcaccattcggcggcggacgaagcggccggtc

SEQ ID NO: 24376 - DNA, 19873 bp, Oryza sativa
cagtcggcagcggcgaaggcaagccgatcggtgaagacgtagacgcccaacaacagcggcataaagaccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtagacacccaacaacggcggcataaaaggccagccgtgcaggcggaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatagcggaagtggccaatgtgggaacaaagtcgtccatcaataacaatgaagacaccagtcggcggcgacgaaggcggtcgacggtgaaagcgaagatgcccactaatggcggcataataggtcagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaatagcggcggcataataggccagccgtgtaggcggaggcaccactcggcggcgacagaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccaatcggcggcgatggaggcgggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatttgagattaaaaatcaacatgataaataatgataaaaatcagattgagtttccccctgactgatttggatcaagtcagagaagaggagcttgaagaagtgatcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacataacacccaagtcatgatctgttacatattacatagatataagttatcccctataactagtcggataaccatgccgtgtgggtatggggtacccataatctccacaggtctctctatgttcttatccttaaaaaaaatcaatgatagtttctagatatgaacgtggataaccatacttgtctgatttatagttaggaattgacttttttttaagaatgtgtaggttgatacttgataacttgtatctttcctctctcttttttactttgtgataaacactagttttgtgtgcgaattgcaattaatagtgttgagaaatgtggacaatgtgaactgggtcatggataaatttgattcaagatcacaggattaatgtcatcatagtgttagaatgtggtgtgtggtccagtacttaaaaatgggcgtaatttcccgctatcggcttggcttatgggtgtggcactattaaattatgtcgttatacggcggcaattaattccctatataagcgcctatatagtaggctctaaacgcatcatcctacaccctcacctcttcctcttgctgcctcaccggcattctcctctcctgcaagatccctcgttcctctcctttcatcctcctcactttttgtacattgttcattcaaatcaataccatatgaatcatcttttgttgttaaaagggtgctaccggtgggtggtttattttatcccagtgtgcactcatcgggtgctcaaattaaatttaacatgtgacaagatgcaaagaggacatgcaagcttagctccccatcatccatcaacaaatgcaagtgcatggtatggatctcaacataactgaggaaaacacaatttattcgattttgacttgcttgttttcatatagagggatttataaaaatttactacctccattctaaaataggttcactcttattctctagcatttatccccaaataagtaatttatatcgcctacgtaccctcgaccataaatctaggagttctatcattacctcttatctatctaccaaccaacagtattctattaatgagggtcaccttgttttttttttctcttcatactaattttgaatcataatgattagaaattaatttattttggatcaggggtggtagtattgactattgtttggtttcaatttcgttcctactcatgaaataaactttcaagatcatcttctatgtttttttacgggacttgttcctatatctttttgtccataaaaattacatcttcaattttatgaaatcaaactccatatgtacaataacacgatctatctattctgcgtataaccacaaatttgttcaacaactatcaaaataataatatagcaaaatgatagttgcaatggtactattgtaggtttatctctgcatatctcttacattaaataagtacatatcttatcttatcttatcttctaaggtgtgatttggtttgaatttattctacagttaattttcaatatacatctattgctatgtatcgcagttaaatgatactaggatgacaaccaaccatgtcataaataagagtaactgaagttgctaatgtctactggctagaataaacgaatatatatatctttttgaatttaaccttaatagcagtagacacctaaaaacaaacgataaattaatacaaactttttgtcacatacatgcattgtcctaccaattttactttgattctaaaaacttcgcgcaacatgaccaacttaattacaccaaactgtagaggtgcgggccaagaacaatgtatatgcagtattctttttctcaagaattaacaaagctttatattgttttgttttgtacccctctttattgtctcactcctagcttttactagtccctttttttttgtggagttagcatatttctttcttgcttaaattaagtacaaacgaccaaaccactttgatgttttgtggtgtgggggttttctcggcaagacccagcgtagcatgcttgaatgaagtcatatggtgtttggtacagtagatggtgatatggtgtatttttctgtttaagtgtattaaaaattatgtgtataatattttgttttaaatttgatagtagtatgtaatgtgcatgttaattgagttgaattctatgcaaaccttctgttttttttattctgtgtttcatttgtttatagatctttaatagtttgggctggcaagttgcatccagcagaaacttctgttccttcggtgtttcctgccatcacctcttccatcttcattgccaccccatgttatatatgtttgcaccttggccccccttccttagcgtcaatgtccctgctttgttttcgatccttgagtattgcctgacaaaggttaccaaccttcactctcttatttctcgtgcgcacgctttccaaactactaaacaatatattttgattaaaaaatttataaaaaaagttactgtagaaaattacactaatctatttttaagttttttaactaatacttaattaatcatgtgttaatccatcctttcattttacatgcggaaggtgctctgttaaagaagtgttgccaatgtacttatcagctccatttcctagtactcacttagtcatggaggcagctgtactatgaaagggatgaagtgaaagtggatgaaagcttgccctagtgacgggggaggggggagctagcgggtgcgggtgttgatggggaagacggaaaagggatggctggaaagcaaaagatttgaagcaccatgctgtcttagagcaactccaacaatctatctatctggtttggatcggtaaaaaaaaacaaaacgagtcaaaaccggggtccagcacactcggtatctcgctccgctcgcgatcccgttcggcatccgtcacccctcgtcctgcatatttgcaatgaccatcccgctcgcaatcgcctctctcccgcgcacgcgctcgtttcccgcccgcgcgctcccgcccaatcggtcccgccgcctcgccctcccgccgtgctacgccgtcgcacctgtcccgccgtcccgcgccctcgccgtcccgcgccgtcgtcggtcccgccgtctagcgcccccgcccttccgccgtcgcgccgctccggccccggccttcgtctcgccatgtggaggccgctgcgtcctgcttcaacggcggctagggacttggatcaggatgctcatcgcccggaatgggacttggatcagtcgggtattggatcgatgcgccatcgggtggttcctccaataggcgtcgatggttggaaggcacaaggtctgttcatcggtgagcaagtcaccgatgaggaggtctgcacaggtgagactcactatctacgtctgtcaaaccctttgctgttagttggatgactagatcacaggaagtttagctcgttatgtattctacctgaggattttgggattgcattcatgttggttgtaggtttctggaaataaaattgatgtctttcttcgcacctgaccagagtagctacttgttagtacagtacatttgaatgaaagattcatccagatcaaattgcttcttctttgcaagtaaataaacaggacctaccctgagtctcgttttgctataaatcttccatcctgcattcacatcacaataatttccacaaaataagatagtttacaattgcaagagagtaggtaaattaaaaggataatactctgttatttacattgctgcaaatgtccacattgcatataattttattcagctcgatagtagttacattactacaattgtctggtttgcatatcatgttattcagccagagttcccatgcaaatcttgagcttcccatgccctgaaatgctgaatggaaccagtggtgtagttgctttccctattgccggcttacagtcctacatgatgtttattctccatttattttcctgtgacagatggtacgcaatcagtttatttcactgacctcctagtaaatgatgttgatgaatctcaatttgccgcacctactagtgatccaatctccaatggagctccaacagctgccaagatttctcagggtaggaccaaaaatttcactactcaggaggacatccttcttgtgtcagcttggctgaatgtgggcatggatcctattcaaggagtagatcaatcacaaggcacatattgggcaagaatacatgaatatttccatgccaacaaagagtttgagtcaacgcgttctgaatcctctttattgaatcgttggtccgcaatacaacatgatgtgaatattttctgtggatgtatgtccagaatagaggctaggaaccagagtggttccagagttgatgacaaggtaaacacattatttttgtggtatgattatttgtcgcagtttttagttctcatgtttattttggtttcaaatgtgcagatcgcaaatgcatgtgaattgtttaaggaggaagacaagaagcataggaagtttaacttgatgcattgctggaatatcctgaaggacaagcccaagtggatggacaatcggaagaaagttggatgtgccaaaaaaccaagcaataagaaacagaagacagtggcaaattcaagtcctacatcagttgaacctgctgatcttgatgtctattgttctgatgctcaaccatctgtaagaccggatggaaagaaggcggcaaaacagaagctacgacagggtagaaccatagaagcagtggactatctgatggaaaagaagaaagaagctgatgttgtgagagagttgaagaaagaagagatgtgcaagaaagcctttgctctgcaggaagagaggtgcaagagagcctttgctctgcaggaagaacggaacaaattggagagagaaaagtttgagttccagaagaaagaagctgagaaggctgagaaggtggaagaggagagaattctaggtttggatttgagcacaatgaactaaaatcagcagaaatattatgaatggcgtcagaacgagattctcgctcgacgttgcaatatctagaagttcagctcgtagcgtagttcagtttctgaatgttcagcgtccagtgtctgtgtgttcagttctgttctaaatgtttagacttcagagtctgtgttcagttctgttctaaatgttcagacttcagagtctagagtctgtgtcgaagttcagtgtctatgtgtgtggcagtatgtgtgatatagtatggtcctaatttcagacggacaacattatgtgtgcggcagtttatgtttgaacttcagtttcagggtcatgctattatccctgcttcattatcctgcaccctttcatttccttggtctgccatcgataaatacaggttataaaaaataacattgtacaagccaatatgtccaaagctgccaaaaaaatttcatagaattgcacagcctttatgcatatgatacgtcctctttttctaaatgtccaaactgggacttacaaaatgcaaagcatatttcaaataaaaagttttcagatgttttatgttctgcgtctagagaatgataagaatcaatagggataaacctcttttggacaacaatctcataaatgggacgcattaatctatatgatataaatctccatggttttgccacaagtgctcgatgaggtctacctgaagctgagtgtgggtttccttgttcttcattttttttttgtaattctgaatgaaagcttatagttcaggtgtgtcacgccctgaactagccccgaacggaaccagcccgtgacgctccaaattaacctgttaaccgataccagtcccaggaaatagagctggtatcataggaagacagaatatcacagcaacagaggtctctttattatagagtaggagtacagtcatgttgggctgcggacagaccccgagctcacaactgcattacaaaagaggaaagcggaagccaagacttggacctaacatcacaggcgcgacttgggaaccagatcgaaaccctataactcatcatagccgacttgttcctggaagaactcctcgtcagcgggatccatctcatcttcttcagccactggggaggattatttatatagagcaagggtgagtacaggagtactcagcaagtcatggcaattatgtgtttaatgaaggcttcaaaggaaaggctgttgtttttacaattgattttttagttaaactcctttttaaaacaactaagtgagtgcttctcaaacgacacggatgagacagtgcatctcgtccgatcggagtatgtgcaatgtatcagtctttgattgattcaagattggcacccggccacaactttcaaacggccagccgggcctagctgatcccgtcagctacagatgttccaaacatcgaacccaaattcccaacataattcaccaagcagtagtcgaacaaaactacgctaaggaatcaccttacatccgcccatgaccgtgggcacggctgttcgaacagtttaataacctctgcagagggggcacactttacccacacgacattactaacccggatcacccagcccgtggagaacagccacgtctggtgaccttaaggctttcatggcaatgcatttcgagagctggtacaggtttaccatatgccgacgagaggggtcgcagaccaacaacaggttaggtcccagaccatactgtgccaggaagcccaggggtcctccccgacaccaccctggcgaatccacttgtcttactctttaaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcgcacagatcccaaacaaccctttgagcatgttgatcccgtttaaagctattgtttctattcaactattgcaattattttcgaatgtcattgggtggaattaacctattgtttgttatagcccttttgttcttgattactttattccttgataccttgggttattataacttgactagttgggctttatatattggttcagctagatattagatatgattgcttagccatgcttagaaacattagcacactattgagataatttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcgaagataagcccacgggagttgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcttggtttggaatggtacattcctggtttggagatagaactgtgcagccgggatggttgttcagaatggttgggcctatacaacagggtatgttgtatagcgttggattaatattgtttaattactacttaactattttattaaattctaaaatgtttattaaatgatgtttatgcaaatgaaaccctactatgccatcctttgttatcctgtgcacttgcatatttgctgcgtggcttgctgagtatgtcatatactcaccttgtaatcattcatcagcggaggagttctacagtgatgctgatggtgtggaggattaggtgtagccctggtcgagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtagtcgaagcggaacactgtggaagagccaacaacacgcttccgtgcagtgcggatgaagcgtgggccacggtggaaggaagcaactggagtgtgtccgggggtgtaggagggactaactgggtgtgggtagggagagtacactggtgagtacggcgcacgcgagctaggggagcgcgggccactgggagtgcgagcagagccgcgggagctgtgggaagacaggtggctggcgtggcagaggcggctggagtcccaagaggtagtgtcaactgaggtgacaccctcctcggccaggcgggcctcaagtgcagcgtagcggcgtgcaagggagcggtaagcctcaaggagtaggtcgtgctaagtggcctgagcctcagaaagctcaaccatgcgagtcagcacgggctgagactcgcggtacagacaagggtacctggtgtcagtgcggcctgaaggaagccgtggaagctgccgaaagacggagcccccgaggcggtggctgtagtcgtgggccaaacgatgaatcgccgtccaggagaggtcctggtacgcgatctggagagtgggcctggccacattgaagtggtgtgggcgaaggccagccccgtgtatacctccacgagggtaaaggtacaccgaaagctcacaacgaggggggacacggtccacagagtaccccgtgtactcgggacacgagaagccaaggaagcgggtgaggtcacgaagctgagcgacgtggtgaccatcaccaaagccgtgggaactgaagctggcgttcactgccatctacaattttgaaacagggagaaaagatcagtaaccattttagaaataaactactgaaagaaaggaaacaaaagaagccttagctttttgcaagtatttttgaacttagcatccttagagtcgtcctaaacgttgggtttcgctatagggccaagcctgtgctctgataccatcttttgtcacaccccgaactagccccgaacggaaccagcccgtgacgctccaaattaacctgttaaccgataccagtcccaggaaatagagctggtatcacaggaagacagaatatcacagtaacagaggtctctttattatagagtaggagtacagtcatgttgggctgcggacagaccccgagctcacaactgcatcacaaaagaggaaagcggaagccaagacttggacctaacatcacaggcgcgacttgggaaccagatcgaaaccctaaaactcatcatagccgacttgctcctggaagaactcctcgtcagcggggtccatctcatcttctttagccactggggggaggattatttatatagagcataggtgagtacaggtgtactcagcaagtcatggaaattatgtgtttaatgaaggcttcaaaggaaaggctgttgtttttacaattgatttttagttaaactcctttttaaaacaactaagtgagtgcttctcaaatgatacggatgagacagtgcatctcgtccggtcggagtatgtgcaatgtatcagtctttgattgattcaagattggcacccggccacaactttcaaacggccagccgggcctagctgatcccatcggctacaaatgttccaaacatcgaacccgaattcccaacagcaatttcaccaagcagtagtcgaacaaaactacgctaaggaatcaccttacatccgcccatgaccgtggccacggctgttcgaacagtttaataacctctgtagagggggcacactttacccacacgacattactaacccggatcacctagcccgtggagaacagccacgtctggtgaccttaaggctttcatgacaaggcattttgagagccgacacaggtttaccatatgccgacgagaggggtcgcagaccaacaacaggttaggtcccagaccatactgtgccaggaagcccagggctcctccccgacaccaccctggtgaatccacttgtctcccggcatcaaggctcccctgattagctaattactcagccaggggtgtcccattccatccatgtggtcgtacttgttatatgttcggatgaaattctaaaggaataggtccttaagtgcaagagcgggaaaccgtgctcccgacacgtcccccggtctgtgatttttggaaattcatttagttcgcaagcaccgacccaggcgtcgggtttttccaagtcttttgtaaaacccaagttttacccattgttggatattttaaatttgaggggaggactccaatgtgcgtgcccgaaggcccatcgaagtacaacagtcgacaaaggaggtttaagtgttcaataattcaaggagggtaattgcagcaattaggattggggccggtaggctatctcgcaagccgcggccaaatttcttgtgttaatcctatccatgcattatttgcggaaaagaaatacttatatttaaattttaggtgcaagatgatcaaaggtgacttgccttgctcgagatcttgagcttgatcctcgaaatccgcgcactccgagtcttcgggctccgaagctacacgcgaacgagacgactcaacaaacggcaaaattaaagccctattattgacctctaagcgtgccattgggtagatctcgagatttgaggatttttggaagttgaacagagtcagatggatgtacggttgagaagatattgaatttctaagattattggatttttggtctaaaggaaaaaggatttaattaaaccctttgaaaaagaaaagaaagagggaggaggaacagacttccctcgggcggctagggtgcggcccgagagaaggggcgcggctcggccgagctaatgggccggccggcccgagaaggcgacccaaaggcacgcgcggggagagggggaggggaaccggtgggctgggtccacctcgcgtggtcccgagtaggacccgcttgtcggcggctcggctcaccgtgagcgaggtgcatgcggcgcggcgctagggttggggtgggtgcggtgcacgcgtgtggcttgcggtggacacggcgcgcaagtggcccacgcgtagcctatcggctctccgtgggccgcgcgcacgcgagcggggatggaggaagcggctgaacggggtcggcttgacccggtccggccgagctagcgccgacgtggcgccttcgtggctgccacgcgggccggcgggaggaagacgaaggcgccgaccgcgaatggacggcgggcggcggcggtttctccgggacgccgtgcgatgacgagggtgacggggtgtacaccggaatgacaaggggaaaagagagggagcgagccaacggctcggattcgccggagggagctcgacggcggcggattgctgcggcggcaaccggcggcgagaaagggggaaatcggcgacagcgtgacgggagatcgattcgggcgagctagagcatctacgcgactccgggaatccgtttctagcgtcggattggacggaacatcgccgacgaaggccggcgacgggcggctactaccgagcgcggcggtgacggcggcgagcctactgcgagcggcggcagcagtcggagcggcacaggctagctacggggaggctacacaagctactgctcgagtctaaggggaggaggaagagcgaggagggagaacggggggggtgttctaccgagacgagacggggtgctgtgacgagaggccgacggcatgggagtgatctctccggcctcgggccggggaagaggaagaagatgagcgcccggagtccccttccgatcctagcgcgcaccggctcctccagtgcacgcgacggcgaagggcgacggcgaacagggcacggggcgaggcgacaatggcggaaggcgaaagcgagggagatgggtttgggggaggggatcgggtttatagggcggctatgtcggttcagaaaccgaccttgggcggtcaagccagcgagctagcgccccggctagcggccaaaacggcgacagggaggatgacgccggcggtggaagagaaaagggaaaaaggaagaaagaaagggggcttgccccttgcttctttgggaaaagaaggagggagagagggcgacgaggcaggaggaggaggagctctgcctccatcccttggaagctagcgcgcggagtggcggggccgggtcgatgacgacggcgatgatggtggggcggtttggaagggcgcggctacagggcggcagatgcgggctcaggcgcggaaggcgctgacaacggcggcggcgacttgccggtcggccacctcggcgcgcgcgcacgggaagcaatgggtggtgcggcgatttgagcagcgtcggcgggaagcggcaacgagagcagagagggagggagaagtgaaagagagagagcgagctctctctctctctcgctcagcgcccaagcggcgcacgttcctcacacgtgcgggcaaggatggaggggagaggagagttgggctgaggaggaaatgggccggggagaagagatcggcccacgaactcgagggaggcaaaatagacttttcgagaggatttgatttgggatggatttgagattagggtttggatttcgacgatggattggagaattgagatctggaatggcacggacactagacaacaaacaaggagacaattttcgcatttaggatttttaagagatagttttcccactaggcgccacgacggaacggacgctacaaggtgcatcatcatgggacactgacaccctttctcccatgtcgtcgtagttgcaaacatattggcctttattgttgaagttgtattcgtagtcatctcgctcatcttcaacaatcatgttatgcataatgatgcaagccatcattatatcatggagcgtgtcttcatcccacatacgagccgccccacgaacaattgcaaagcaagattgtagaaccccaaatgccctttcaacatcctttcgacaagcttctcgtgcctttgcaaagtattttttcttattaccttgtggctctggaatggtcttcacaaaagttgcccacgatggatatatcccatctgcaagataataacccatcgaatattcatgaccattgatgtcaaaattaacttgtggaccttctccctcagcgagccttgcaaatatatctgatcgttgaagcacattaatgtcattgtgtgaacctggcatgccaaagaatgcatgccatatccatagatctttagatgcaactgcttccagtataattgtaggctcctttttatagcccctatacatcccgtgccatgcagtaggacaattcttctagctccaatgcatacaatctatggaacctagcataccaggaaatcctctgctcgctccaattgtaagtaacctagcagcatcctgttcattaggcttcctcatgtactctggcccaaaaacctcaacaactgctgcaacaaactttctcaaagcttctagagcggtgctctcaccaatacgaatgtactcgtccaaagcatcagctggtactccataagccaacatacggaaagccgctactaccttctgcagacaagataatccgagcacaccggctgcattcctcttctgcttaaaataatcgtcatgttcctcaacagctttcattatgcgaagaaatacatgaagcctcatccgaaacctatatcatgatgcaattaaattaaattagcaatactataaaacacggcacataaaaattacataaacattatagagaacatgcgaacctgcgtctaaagatgtttggtccaaacgttggattatctgagaaatagtctttgtaaagaagattgtgccacaatagtctatcccgatgcactacctcatgtccctgaacagatccaattcgacccagattatttactgattcctcaatgatcatttacgcagcaccaaaaaatagatcatgctcctcattcgacgaagagggatcaatcaattcgttcattacgaactcattaaattcatcatcagactccataccctgcacgcaagagtgatcaatttctactgatgttaattgaattcacgcaagattgcagtaccaatcttcctctacatggcgatagtgcacgcacctgttggatgagtggccggcggcggcgtgatgacgcaacaaggaggcgcgcggcatgcataaacgatctgccgccggcgacgcggtgcaacgagaggcagcgacgtgcagaaggaagcagccggctgtgaacgacgtccaagcgatggccggaaaccagcggcggcagcggagaaacgagaagtcgcggagtcaaccggtccggaagaacgggagccgtgacgtggacccttttgaatatggagagtcaatatttagctaggctgttggttttacccctctgtttgggatcttttttcctttttacagacctctttactctctaaacttagctaatcatatacataatctcttggagttgcaaataggttgtaagaagaatgcccccacgatgaccttggtccacacagagttatttttccctttgacagaagctgaatatcatggcatagcatcctactatttccaggatgaactgacaaatgccggtgtattcgaagggcgtacttgcgcaactgatgcaggccagtagtttggcagcttctaaaattttgttcattctgctagtgcatcaaaggaggttgcgttttcttctcaaacattgttagtgatctgcaacagactttgggttcacacgatagggctgaagtgttcgtacaggggtgtcatttctgatcatcaatatggcatgagtcattttacacatgttctttcttctgttttattcgatagcttacactcatacaatttagttttggaaagaattaatatataacctgttgcatgctcatgattctctcataaaaaatatgtgcccataagtagcgaaagaactcctctacacattatcttcctaacttgttcacatgtaaatgccatcctacaagttggccaaaatggacaatgtcggtcatgggcctcacctttttaagtacttcatgacaagaaacaagatacccaatatagcaccgtgcactttgtttctgtgctcctcagatagctattcgattcttggaaatccttaggctacccaccatagtaacataaaatcctacataatttcatggctaggattctttatctaatcaatttggtggttcttttccttggctttaatctgcacagagctctctcatggaggaaccaaagttacatgaatgatatcgctgatcgatgtgccccttcaccccatcctttaagtatgtgccagtcacgagcagcagcttttggctatccatgtgaagaatacaaggtacgactacatcttagtcctgtatggttcgcttctgtaagaaaaaactcatttttataaagtatacggcatgacttgcaggtcacaacagaagatggctacattcttagtttaaagaggattccccatggtcctcatgactctaacacctcgactgagatgaggccaccggtactgcttttccatggacttatggtggtaaggacattgttgtaccaatcttgtgccatctgtgctctcatcatacctgaatcaagtgtgttgtttggacaggatggtgctacttgggtaatgagtactccaaaacaatcacttggatttattttggcagacaatggatttgatgtttggattgccaatagtcgtggaacaaattccagccggaaccatacctcactctccacaaaagatccggttctcatctcaagctttatcaagatttaatttgccatagaattatactaaaagcatgttgggtactcttttcaggcttactgggaatggtcgtgggacgaacttgcttcctacgatcttcctgcagtgctgcagtttgcctatgatcacacaggcgagaaaatccactatatcggtcactccctggtgagctcatatgtgccacttgaaaatgtcaattactagacacttctgccttttcagtgatgctgtaaaaaaaattgctacttgcatttttctagggaaccttgatgattcttgcagccttctctgagcacaagttactagatgtagtgcgatcagctgttttgctctgcccaatagcttatctgagcaggacgaaatccaaactccttaagcttgctgctcacatcttccttgcagaagtaaaatgctgtaaactttcttgttcttattgttactggcagatcatggttgattctatttatctctttgtttgtcttgtgcagacagttcactggctaggcttttacgagttcaatcctgttgggtaggcacttccacaaaacttctaatgtacttgaaaaaaaaaatcagtaaatgtacttcaatgccaagttcttgcttgtagtttttgcatatcacagcaactctattaattaccagtagagatgcccatacttgtaactcataacgtgactatcgtatcatggaacgatgtgtcactgtcaccaaatttgctattgctatatagggatagtctacagtttatactggtattttggataactaggcccaaatgtgattgtgcttacttaaagccgtaagcattgactactatgggtgtcctgctgcatgacaggccagttgcacatgaagttctaagccaaatatgcggcgatcctgaaattaattgctatgatctattttcggctgtagcaggtattttttttctttcctccaatttaccacgccctaaacaatatgtgatattaagctcatcctagtaacaccaattgcatggatttgattttgtgactgaaggaccagattgctgcctcaatacttcaaccttttgtgcctttctagagcatgctccacagtctacctccgtcagaaacctcgttcacttgtcgcagcgtaagaacctcttatcagaaatatttttaaggatgttattcttcaaacctctgtcacatcactcactcttctatttcctgatctaccttccaaaacagtggtaagaaatggaggtgtcagcaggttcgactacggcaacgccaaggataacatgaagcattacaaccagccacgcccaccgccgtacaacctctcctccattccgaatcatgt

SEQ ID NO: 24377 - DNA, 5041 bp, Oryza sativa
aagtagcagctgtatgacaagtttcagcattgaagatttcagtctcactgagcttgcatccatcagtacatctttgtcatgtcaaagtatatatgtcagttccaccatgctagataacacgaaaataaaggatttgataaattgttactcgatctcgttgtaatcacaatgttcttgattcactggtctcttgcaaaaaatgaatatggccaacctaatttgtttttgtaccattaattcttattttctattgtctatcagatctattgcttctagcaacaaatccaatcagatgtgttgtgatgttgatagttgagatgctgccatcaaaaagagatggagtatctgaattgggcgctacagccgccagaattgctaggaggtcccaggtgtcccaactcccaattgtccggattttccttttcccttccaactattttggtagaaaatcacatgaatgatgaatcgtcattggtttttttcccccttgatttctagcggcaaccgtcactgccgctgagctgaatggtggtaatttgcgtgacttagctttgatgggatgtgatgagatatttgacagctttgaggtcatggagatgcacgcgattcaacttggctacctgccatttcatacctttgtgaggtttataataggttactggcatactcgctccgtcccaaaataactcgacctagaatgggtcacaggttaatttattttgggatggagggagatattattgagctgaaatgtagaattacttatatagatagatgatttttatttcttgcatatccagtgccaccaaaggaaagaagaggttggtagctttatatggaaacaagacaacaaagtaaaattgtatactagtatgtttttcctctttagatgtatgacagagagccagagctttcttgcaaataaaaaagaaaaggaaaaaggagtttttaccccaaaaagaaaaggtcagagggagacccaaattaactgaacttattttatttccagattttttttcctttttattcatgtcctcctttgtgctgccaagggttgccaagaacttggcagcaaactgagccagatgttcatgtggctctctctatttgcctccagggaattatgtgtcatatctggctgcaaatcagggacaggaaaaaggctttgacaagtgcttggcgttgacattgttatcttttcggcaataatgctctagtcaaataattctagacaggttaatttgtatataaaatatcaaattattgagaagagtccaagtctcttgctcctgttgagtttctctttagtctcttcccttcaatgaaaagagcctgacattttctcctcaattagtacagtactctgataacacagagtagctgtgataaaaaggccaatgtattaattgacaggttcttatcagataagcaaacacatgagtacatgacctataggagaaccaagagtccaaacaaaaaaaggccaagtgatcaaggtgacttggcttccatgtttcatcaatcaaacagcacaaaagggaatgaaaagaacttgccaattctttacttttagaccatgtgtgactcagcatcatctgttcttgtcccttcaggagccaaagaactacagtactactaccatcacttggaagcgtagcgacagctttccgagttcaattaggattaactaatcacttgattaaggaatctttttttaagtaaacctgattaattaaagaatctggagccacactaccacctggagatatcaaccgcggtttctgacgacacgtcgtgccggatccagaaccttgtacctgcaatgatgaatgcaatcatcagatgcagcaaaagaccaaccgtttcgctcatagctgattataaatcatactatttattagcatcagataataataatttatataattagaattttcatgcgttcttagcgattgaaaagctaatattaaaaaagaaactatgatataaaaatgtgaaaatcaactcgaaaattaagttttgaaatttatattatggataagttttttctgaattgttatccggtcgctttctgatcatctggttagattagatcacaggcaggaggatatggcttgctgatggccagctagcccagcagatgagcagggtgtgtggttatgtgtgaggaatcaggctggatcacatggatgattggtcgtgatcccggtggtttactgctaatcatctcacttggctagtcggcccgcgttcttcgccgcaccgtctgctgctccttgattttccttgcaaatcattgcatctggcgattataaatttgtaataattcgttagctcgtgaagcttcttgtcagaacttgttggaagaatactgtactgtactggcctaacacaactgtaacaactggttcctgagatatcttcccttctcttgatctggaagatatatcttctctgaatcacgatatgtgcctggtggtggatgattaccgcgcatacatgcagcttggaaataatctgcaattacgcgcgtttctgattcagttagtggcatatgaatccccctcggatcttgacagattcctgaacaataccgaaaacgaaaggaactgcataattgctccaagttatcacccccccccccctcctgtgaaatcgtgatcacgacatgcatatatacaacctatagctatcgtattttgtgacataaattatgaaacaaaccgaagagaaaaatgcagagaaaacgaagaacacaagaaaatgtaaacgtcatatgtgttggctgttctgcagagttgcaggcatatgctgctgttgttggcgagacgccgacgagaacttaacgcggccgctgtcgcggtaggtccggcgatcgatcagctggattttcttttttttttctttgttgcagttgccctccgccctctccgggatgccgttgatcaggtgacgcttgtcgattaccgcttgtgttgggcacaataatttctctgggtgagagcgagttctcgtgcttgatttggccataagtttccccctctttctgagattgttgttttttcccctcttttgtgatgcattgtaaattttacctttttcagatttttattactttctttttttcacttacatgcctattttttctcgattacatgaaaaacacgcatgtaaacagtatatgcgtgcactccacttctagcacgcatacacttttcatgaacatatttctaatctgttaggtaatgaaataaacattttggcctttgcttaatgagctgtagccaattattataaaatccacacatagaaacactcagcacgtactgacataacataaagtaaacacaaactaaaaaacaccaacacaagataaaaaaaaccataattacttaattctatttgtaaatctccatccgaagttagaaaaagatgcataatcattgattttaaatttatgatatgcatcatttattagcttattgtcgtcattatgcctttgtaagaacatatttctaattaggccacggagtaatctctggcctcgtctattaaacctatgttataatattttctagtaaaataatgttaaaaacatgcactgccccagcaccaaaacacgcgtgataatgctatattaggggatcctcctaagctacgttccaaactacggcttaactaggtactagtattggtagtataaaaaccttcaccctctggtcacgtaagcttccattcatcggcggaaacagggtaatggaaaaaccaattgcggctctacaaggtaacgtacgtcaaataaaatcaaagcctgtcattttcgcgccatcctaaaatttactgataagaaattgcaatttgtgtcctctccctgctggtgaagtagtaagcatccgaatcttgattttttttatttttttattttttgtacttttaaaattttaaattctaaaagtaaactttttccgaaacttattttccatttgaactttttaggaatgttagtcatactatagtgacgaaacaacactatcacgttgatctacatgacgtgacaacgttattttgtcatgctggtctgactagcgtgatggtgtatttggccacaccatcctgattggcgtgactaaggccctatttgttttagcttagaattattataatctggattattagcaataatttggaacaaataggtagattattataatttataaactaggttagtataatctggtaatctcctctaaacgtactttttttcatattattgggtggttaaagacccactacccttaaaaacattatagaaattatccattgccattgaacctaacagcctgagcacatctgcttcctctctcctccagctgcgcgccgcatccgcttcctctctccccagtcgagcgcaaatccttccccaaacccttaaccctacgtgcgaatcattccccaagcccccaccctacgccccagctcatttcccaagccgtgtcgccgccgccttctcatcctcctcccctaagcccccaccctacgccccagctcctttcccaagccttgtcgccatcaccttctcatcctcctcccactcgccgtctcatccttctcccactttgcaatagctaagggcatccaaaataacttgggacattataggcattagcctttcaaacctaataattcatgcttccaataatcatataaacagataacttataagttattctactatagcttattacggagtataatctagcttattgtaatatgcctttacctcaataatctggattaatcaatcttaagttaaagcaaacaggacctaaaagatcaaggtttttaaaaaataagttttacaaaggtttatttttaaaatataaaatttaaaaagttcaaaaaaattataaaagttcccgaatctttcgctcgcctcccttgccggctcgccttgccgccctgcgcctcccccaccacacacctgcacgccacgccaccaggcccaccaccaccagatacccagatcccaggcacacgcaat

SEQ ID NO: 24378 - DNA, 9807 bp, Oryza sativa
ccgtccccgccgcggcgcacttcctcctcgcgttccgggcgtcccgcaggccgttctccgccgtcgtgcaggtctcgctatcggcggcgtccgcggcggggttcctctgcctctcctcctccttccgccgcatcggcctccgccgcctcctctacctcgacaagctccgcaccaagagcgaccgcgtcaggctcaactacaccgcgcgcctctccttctccttccgcctcctcgcctccctcgtcgcgccgtgcttcgccgcggaggccgcctacaaggtgtggtggtacgccacctccggcgaccgcgtccccttcttcggcaacgacgtgctcagcaacgcggtcgcctgctccgtcgagatggcggcgtggatgtaccgcagcgccatctacctcctcacctgcgtcctcttccgcctcatctgccaccttcaggggctccgcctcgaggacttcgccgggacgctgctcgtcgaggtggaggaagggagggccggcgtcgagcgcgtgctccgggagcacctcgacatccgcaagcagctcaaggtcatcagccaccgcttccgcaagttcatcgtcgcctccctcctcatcgccaccgccagccagttcgcctccctcctcctcaccacccgccacgactccgtcgacgatctcctcaacaccagcgagctcgcggtgagtccccgatcacggccaaattctttgatcagcaacactcgatttggttcccaaagttcgattccatcccatgtatagcaatcaatcatccccaatcatggacgaaacgaaacttccagacaatcttgtcttaatttacacggaaccaacatttcttgatgcttaaattaagcacaaattgacctgtaaagttacaactattaaacaatttgggtggacaccttgctaattcagtgctactacttgtactaactccgaaatggaaaatctccctgcattctgcgaattaaatccttgctcctaaaaagtaacaacgttttctggttcgattttgtgcagctgtgttcagtggtgctcatgtcagggctgatcataatcctgagcagcgcggcgaagatcacgcaccaggcgcaggcgctgaccgggcagacgacgaaatggcacgcctgctgtaccatcgagccggtgccggacgaggaggcggagcccgggtcgaaccacagctcgatgctcgaggtggagcccgtcagcgacagcgacggcgagtccagcgaggagaccggcgacgaggacctgctcgagaacaccaagatcatgctgccccaagcacacgtcatctccttccagaaaagacaggctctaggtaaataccgttacagcagtaacaatttcatgatccatccagttacttcgataataatcgttgatatgatagctaaggtggtgttcgaacatgagaaatgcatataaaacgagaaaaccattagcacataattaattgaattttcattattatgaacataaaaataaatttatttgttgtattttggagtaactcctatagagaaagttttcatatgaaacatattgtttagcagtttgaaaaacatgataatggaaaccaaggtaaaatttacattttaattagaaaagaattggacctaagtgaattgggaaattattttcatccctcgaggggatatctcatcgttgtttgcatgtcactcaaatggttatgaaaaaatttaaaaaagattgaggagacgtgttaacatatgatatatcactctacaaacatgtaagttcaaattcaacttctacatctcacaacgtaaaaagtgaattgtacattgttgcatcagcctaaacttttttggatgaatttatcggtgtatgcaacttgacaataatgaaataaaatgttcactcatgtttggtgcagtgacctatctggagaacaacagagcggggatcacggtgttcgggttcacgctggacaggtcctacctgcacacgatattcatgctcgagtggacgctcttcctgtggctgctgggcaagacgatcggtttctcgtgaaagcgaggtaaaaaaaaaagttttcctgcatacaacaagttcaggttgttctggaacacatgtatgtttggttggttggtgggttgcaattttgcggatgcgtggctgtgcagttggatcctcgtgagtggagtcatttttgggtgctcacgatagtagcgtgcgcatgtatgtgtatacgcatgtatgtgtatacgtacgtatgtattgatgtttgtataaaaactggtgttagcggtgtacagattttgagtccattgcttcgttcgcgctaacaccaccttagtaaatgagcgatatatgtagagcgttaggacttgtatgtacttttgctgctttagtttgcggttgtgcacgcgtgcggcttcctgttgctaacgtgcaggctttatcatccggttttgtaatttgtatagccgatgaaagttgcagagcaaattttatttacagttcagtttcaaatttcccatgttttggagaagaatttatcgttctgtatttctttttctttttgttgaattgagatgcgtcatacatgaatgtagcagattttttttttatgaaaggaaatgtacctttttattttattgtgatgtgagtgaactcagattaaacccacttaaggccttgtttggacggaccagtttaaggaaaaagtaaatcgaaggtccctgaacttgtcatcgagttaaaaaacatcctcaaactgtaaaaccagatatctgacgttccttaactaatcaaaaccggttacaatagatccctaagcggttttgatacaggttttgtcctgtgtggcggttgaatcagcgtggagcccacgtggaccccacatgtcagcatgccacgtcagcctcttctctatttcctctcttctctcacttcctcctctctctctctcactcctctgtggggctctggacggccggcggtggggaggaggtcgccggggcatggaggtccgacggccggccggcgatgagggggcggcgacccagaagggaagggcggcgggcggcgggagcacggaggagcaacaccagcgtcttgtgccgcgtccacaacggcgtgccagcgccggcggccggcgaggtcgcgttggcggtgccggacattgctgctgctgctgctgcctcccggaactcgatcgagacacatcaagggatccaccagctgggatttatctacagccatcgcagccattaaatcgggaatcaaagcttgcaaatttggcatccagcagaaacaggcaagaaattaatttcgtgctacaaatgccatctcgtcatactcatctcttcttatctcatccaactaagaggccatagaaaatcagtgtcattctactggcaaatcacaattaggcaaaaaaaatgcaagaagttaatctagtacagctaccgcagctcgcagaagggcaccggcgaggagctcgccggagcgccactgccgccgctttgcctcagggcccttatcaagggcttggtcgccgaccacggcgaggccgcgccggccgtgtacgcacacacggccaagctcggcctcgaccaccgcctcgccgtccgcgatgggctcgtcgagctctacctcgcgcgcgtcgagctcgcctccgcgtgggcgctcttcgacggattccccgccggctggccgggacgtcgtttcttgtacggccatggcggatgatagcggcgtgtgcatcgacaccgtcgccgccgccgcggcgttctcggcgtgcgcgcaaatcggggaccttgcgctgggtcgggagctttaggaggatgcccgtgaagaagaacgtcctcgtcccggccgccgccgccacgtcgcgccggccgtcggacctcctcgccccggcaacgaccaccccaccgccggccggcctgcccaatccagagagaagagtgggagagagagaagggaggaaaggagaggaagggagaggctggtcgctgacgtggcatcctgacgtatggggcccacatgggtcctacgctgactcagccgccacattagacaaaccggggtcaaatccgctgaggacctagtttacactgttttttaagttaggggatacgttgtatccagttttatggttgggggatgattttgtaactcgaggacaagttgagggaacttcggtgtactttttccccagtttaaacacatcaaagtagatggaccggaaaatttgacctaaaactaaaaggcttaaaatccatccacatccaagccatatgttaaagggggaatgttactgaagagcaattctacggttcttgatgaggtaacatgagataataaaaatttagtgtaaaatttgatacttaatggtatctcataatacctaggtatcaagaggtataaatttacaatataaaaagtagtaccttgtatattttctgaccgtaaaatagctcgttaatgaatggtgtcccgttcgaatagtacaataccatttggatatcacatcttatgtcacactggcacagactaatacccaacggtactagatttggtatctcatcgatacccgatgataccctacggaatcagacatgatacctaagcaccaacctagctaatacttgtatatgccgatagtccatcagacatcggtactagagagaaaacgaggccagaagtgaaagttgaaaaataatgatgtgctctaagtctaaagagcatagaagaacacataagaagctcattttaaattttttaaaaaactatcatagacgaacgtgttggttaattacaaaactatcgtgaagatggggctcatccatccaaccgtatccagtgttacggacaagaatgcggcgcatcgtctgcgagtggatccaagtgagcgaggggaggagtgactgagggatgaggatgtttcatgttaggcctctaaaatagtaaaagttttactgttttagagcactttttgttaaaataaatctaaacactagtagcaaaagttggcaatttgacatttgttatttgggagtcttatagagtagcaaattttgcaaaaaagtgcgttggaacttggaagccatgctttctctgtctttactagtaaaatggtaaagctttaccatgcatctaaataccatctagcaaaactttaataccaaatcttttaccaccaaaacttttaaaaaaaattaccacagcaaattgatctaaacggctcttagtgatgatatgagctcgtcggctccaattaggatcaggtccacctccatagagcacgacctcgtcggctgcaaaatgaacaagatagatggagttgtgtttagactgctccacaacttcactcaaatcccaactcttgaaactaaatttagaaggaataagtttattttagatcccttaacttgacaacgagttcaatttttgtcctgacacgaaataccaaaaacaatggatcattcaatcgtctaaaccgatgcaaataaggtcccaaggtggtttggatggtagttccgactgacgtaacgcctacgtgctggtttgacttggtccttattctacgtggtggtgacgtggcattagaaacaaaataaaaaataaaactaaaataaaaatatgggacccatgtgtcagtcagacaaaatataaaaaagaaatagtgggctatctccaaggacgtcggtgtgtcagtggctcagcgccgccttctcccctctctctcccagccatcctcatccctccgcaagtttcctcgccgatcggctaccgccgctgccaccttcctgcagccgccgcaatcaacaaccacggagaccaacagaagagaggacttttggagctctaccaaacgggtcctatatgggctaaatcaccagctattaccaagacatgggctgaaatgtggcccatgtaaaatgcggctcatagagtgcggacccacaaacctctgggcttctgcagagtaaagaccgaaatttctcaaggcaggcctaaccgtttcggcacaaaccttcttctccatgaatccctcccagtccaccaggagcccaaaataaaatccccaataaataggaataagttcatctaaggtctcttaacttgtcaaagaatccgattttcgtcatcaaccgcaaaaccaatacaacgggtccctcaactatcaaaacaggtgcaaactaggtcccttggcggtttcgatggcagttttggctcacgtggcgcatacgtggctaatttgactcagtatcgatctgacgtggcgcttacgtggcaatttgatccgaaaaataataaaattcggggactcacatgtcagtttcacagaaaaaataaaaaaaatggtgggacccacgtgggccccacatgtcaatctcaccctcccttcttcctcctctctctcctcgtctccttctcttcatctctatcccctttcctctctcttctctgtccagcaacaccaccaccgactccgccgccgctcccgccaccgccacatccctcgccgccgcttcgcctcctagctcccttcttgcctctcagcggtcgtctccgccgtgggaggccgtggcgggtggcagcgggagcgggaggccgtctccgccgcagccacctcgacaccgaggatctccgggcggcacgccggggctgcacggcctgcctatggagatgacgacgggggagatggaggccgccatcgtcgccctccctgcgaagaaggaggcgctgcgggaggccccttcctcttcccctcgccggttgccgctgcaggcgctgccgccgttgagccgactcgattaattatacttccattccaatattctatggaagcaagcttaatttgcaaaagtgaagtgaagctgagcatagcatagcagagcatccagctcgctcagatggccttgaggaggtcggcggcggcggcgatgtcctggccgtcagcaagggtgacgatgttgggggactctatggccacgacgtcctccgtggtaaacccgtcctcgtcgcagaggagctcttcgctgccggcggcgaccatccccggcaggatcaccgtcctgtgcagccccgggaggaggcgctccctgtcggtatcgcccttctcgccgacgagcaccgccaccttggataggtcgatgccccactgtatcgacaggtacctgaaagattaatgcgtcgaacggttagagacgacgagatggtgatgaggtggtggtggtggtggactggtggtgatggtggcgtcgctggcggcggcgtctcacctgatcgcgcatggccgggagagagggatgatgttgaggcacatgcacgcgcgcgtgtagacgaggtttctttggaagccgcgcatccgcagcacctgcttgatccaatcgatttcttcaagaagtgttgtcatcaaatggtgttcgtggcaacggtggtgctctgcttaacttggatgtgtccttggcgacgtaggcgtggcagtgcacggagcaggcggcggcgtcgacggcgaggtccgcctcctgtgcgccatcggccttcccgagcctcggcacggcggacctcacgtggtcctctccccccggagagacagagagaggatagagatgagaggggagaaagaggatgacatatggggcccacatgggtcccaccattattattattatttttgtgtgtgaaactgacatgtgggtcccactggttttattatttttctggagcaaattgccacgtaagcgcacgtcagatcgagaccgagtcaaattagccacataggcgccacgtcagccaaaaccgctataaaaactgccgagagacgtaatctgcaccggttttgatagttgagggatccgttgtatctggttttgcggttgaaggacgaaaatcggattcgttgacaagttaagggaccttagatgaacttattcccaataaatatcaacgcgcctttcggcccaaatcttcttctccaagacacagcgcgagccattatcttacgtcacggcccaaacgccgaggcggtggtggtcaagtcgcaagggggccgaaggggagaggaggatccaaaccccaaaccccccccgatccccacgacgcgccgccgccccgcaccgagatggccgccggggacgccgccagggcgccaccggccgcggaggcgcagtcgctggtggagtccttctgcggcgtcacctccgcgacgccccaggaggccgccttcttcctcgagagccacaactgggccctcgagtccgccgtccgctccttctacgactccgccgacggcgacgcctccgccgccgccgccgacgcggccgatccgcccccccgccagcccccgcctcccccgcccgccagcgatggcgccgactccgacgacgaggactacgtcgtcggcggcggcgacgaggatcaggacgacgaggactacgtcggggatggggatggggacggggagggggacgatgatgacgacgaggacgccgccctcgccgcggaggaggctgcggcgtcggacgagcggaggaggccgctgaagaggctgaagaggggccaaaacgcgcgtggcgggagcggcagcgggaaggggaatgtgcggacgctctccgatctcggcggtggcaaggacagcgcggggtccgaggactcggaggacgacgagtataagccgccgcaggaattatacaccggaggcgaaaagaggtgagctctactcgccttgtatcttagggttcttcgatttcatttctagctagattgttttttggatgaacgcatttgtagggttttaggttgttttgcttagggtttggctagaatttgtaagatacttgttggtttgcattgaacgaggtcaggggtgctggattggatgcaacaattgtcaaatgtgttcaaaatgatgggagctatcatgcttcctgagtatgaaccgtgctaagtctgcattatatgcctagatgttggccctttagagtacctgatttttccctattaataataatagccacagattgttgatccatgtaatccttgtgataataatagtctttgtgtagactaggatttatgatgttgtgttgcaacttatgcttggcagctctgcacttttagagacacatgagttggttgtgagtttagccacgtgtaaggttctgtgatgttcatttcatttctagctagattattttgggtgaacaaatttgtagggttttaggttgctttacttaggcctttgctaaattttgtaagattggcttgcccgctgaaggaggacaggggtgctggattggatgcaacaattatcaaatgtgttttaaatgattgaacctttcaatatggagagtgctaagtctgcattatatgcccagatgttggcccttgtagtccctgattttcccctttgcattattagccacaaattgttgatctatgttgcagtccttgtgataatgatatggtgtccttgtgtagaccaggatttatatgttatgttacaatttatgctttgcaagttggcatttctggagcacatgagttgattgtgaactgtgagagaagtggttcattaatgacctgtatcttgagtttgtagtttgtactcacatgtgttgaaaattttgagactatagctcattcaatgcagcatcaaaatgcagtgcttcaccttagctactagtataggatattcacatggcaaaggattagttaaatctgatggcatccaacttaaatgtgacaattgcagttttctggtttctagttgtagttccaaatcaaatcacgccttctcttgttactctctccattgggg

SEQ ID NO: 24379 - DNA, 8642 bp, Oryza sativa
ccatagaattttcatgtgaaacacagatacaaggaactatgtttatagtaaggaaagtatattctggagagtttgaaatccttgcgttgttaatgccatgatcataatcagatctcttgacattgttagggtggctaatacctgctaattactgttgttataaagcaaaacacatgatcccctgtttgttaaattcgtgataagctagctgtttgtttgagttatgagtgaattaacatttccaacctacatttataacttgttattacctcgtgcagtggaatggtcgttagagatcgatctaagcgtaaaaaccgtgcggatgagatctttaaggaagctaagaggaagggagcaaagaaaggttcatttgaggctcgccggaaatcaaagagctttgctgggacaggcagacttctaacaggtgaatctgcagagcctgttgcgcctcagtcaccagaaagtattgtccacaacatctatttttggaccaatgggttcacagtaaatgatggtccacttagaagttttgatgatccagcaaatgcttcctttttaaaggtaaatactttgacctgtgcaaaatgtgtacctgttttatctgcttattatgtttgtctcatgtgccattatgtacttataccatttatttgttttggaatatcttaattcaccttgtttccgacctagagtggtagctgttgcaatattttgtcatcatgatgcaccctgttgtgcttaacgtaatggctagttaaaataaattcctcatgatgaaaacaaatcactggaatggtcttctttcattgagtgtatccattgatgttcttcagctggcttccatcatagtgtctcacaacctttatctcatttttgggctggtcctcatcaattgatgtagggcaagatgtgttttggtaggaagggtactggccaatccccccctccccccccccccccaaatttgccattgcaaaacagaaatctttctgaaaatttctggaccaagtaaaaatagttggatttcacatttcacaggtagcttgttcagtaaaactacccaaactaatctcaacattaaaaaaatgcactgaggcttttttttgttggtaaaattcggtttagtgttaccatttttcttttatggttattctgttgcttgatctattgtttattttgatcttattcttagcactttatgttcaggtcctctgtaacttgctatgcatgccatttcttttgttttgttacatgtttatgaatttgggttatgtcttctcttgctaaatggaatgtgaattaatcaatctattatttttcctttttcaattgcacagagcatcaagaattctgaatgcccatctgagcttgagccagctgataagaagtctcaggtgaatgtgaatcttgttcggaaagaggaaaagtgtcctgtaagttttgtcagcctttgctttactgtttcaattgttctagacgacgatcccggccttgacaatgtccattgctcgaatgatgtaggaacctgtcaagcgcgcagctccattccatggagcggcaaaaactctggggacgccttctgataataactccacacctccggaggctacttctgcagcagccgctgcttccagcacagagaccgcctccaagaccgtgacgatcacagtggatgattctttgccatcgacctctctgcagatcaggttcgtggacggcagccgcatggtcgcgcatttcaacacgagccacacgatcgcggatgtgcgggcgttcatcgacacaacaaggccaggagaagccggtgattacacgctccaggccgggttccccccaaagccgctcgatgacatgagcaagactatcgaggaagctggcgtcgccaactcggtaatcattcagacagcgtagcttcgacagaaaacagtttgttgaccccccctctcttcaacaaagcacactatcccatctgaagcgtgcaaatttcctcccctatcttttcatgccaagttttctttttctcttgaatctacccttttctgccttccatggcttcgaccaatagctgctccaggtatgaagagtgtaaaacagtgagatctgggtatctcgtccttattcatctatagtgctatacttttgctctacatgtctgtttcttgcccagtccacatcacgtttggtgcgtttaactgtgctcctttgttcttaatctaacgccctctttggtactagaatgttggtagtacttatggacaaagttagttgcaacgggtgctccttaattcctgtttttccaatgttcttacgctaattagaatctgagcccaaccgacgtgaattgaattgtttattactagaacagttcttgtttagccaaagcctcacttttttctagtacaatcttttccagcttttcgtcggatttccagtgttgaaaagcctaaagttatgctagcagatcagccacatacgtcaagaatgtctttagttggtagaagaaaacaaaaactttatgtaccggaattggatttcttctgtccttgggttgatgtcccactgtcacaggttcgtggccggagagatgtactgtatgcagtgacagatcctaacctggtgtcagaaaaatgacagagagtacgaggacacctttacagttatacgtgttgctttccaagatgaatggagagtacatcgtctggttggaaatgtttcgtcctcttcatcatcaccacggcctcattcctcgcttccttgtctctgtctcacctctctctctctcttttcagagattagctgttgcgacatggttttctttgctgtggcctaaacaaatggatctcgtctcctcttcctcatttaattgttctactacgagctcatcagctacttgtgttttttttcttaacagatgtgaataaaagggagcaagtgattgcaagacgatagagtacaatgtaaaatcacctgtcggtttggctaattggattggtcgatccaaccaacaactgacgacaagtaggtgagccctgatcagaaaaacccccaatgatttcgtccttttctccttcctcctcctcaccacctgtgtgctctgggaccgtggtgggctcactcaccatcgggggtccatcgcggcgacgtgacgggaacgagacgccgacaaaataccggacgcgcggtttcgagctgtaaaagtgcgtgagaactgaagaaacgccaacaattccccggctctatccggtggcgcgacgccgacgcggatgcggtgagcgattgctctcctcccgccgctgtagggaagcacgtaggtcaacccgcgaactcacttataaatcaaataaataagtagttctagagatctcatgtcgtgatccgacttaccgtatctctggcaaggtttaaaattgcagaaagaaattttcgaaattttggtcctatcggccgattttttttttgaatttggtagtattttgttcaaatttgatcaaaatttatttaaaattttggaccgaaatttctgaaatttcaaaaattttggtatatcggcactctccgatacaaacgccaaaaacgaaataccgaaatatgatctagggatacaagtgggacgatccgtgaacccatttatagattaaattagtaggtaatccgcgggttactaattttgtttataaatggattcgcgggttgattcacttactttcctacccgctggtgcatcggtgatctgatgatcatgggggttgtggcctgtgtggcctactggccacgagcgctgcctctcacaggttacgatttgtcacgggtgttgcctattggtgagatgctgtgatctgatggggttgattaatacggggagaaaccggattggtggcgagcatgagactgggagcttccaacttggttaaactaagaaagcttggggagtgtccaagattgattcgaattcaacctttattccgcaattcagcttctactattggcttaatcacgtgctcgttggaaacttattgaggtactgacgtactgattggagggggagggggatttttttttttggccgtcgcagctgctccaaaaatctacagctattctttagtagctgcgaaattaaaggtttgtttggaggaacttaaagcaatcacaataaaaatataaccttaagacaacaattacacttataaaataagtcatatacattgtggttatccttgagatctaccacaacacaagcaaatagaaagtaatttttttcactctcattcacttcatgaacgagagctgaaacatttttttttcatttgatgcaggctcattttgtggctaattctaatgatggtattgtgggaattactttaacgatgatctactattcatgtgtctcaccttaaggttacattacaccataaacattgaggttgccgtaagattctgagaagcaattggttggtatacaacttttgtgaatttcttagcttctagcttttagtttattttttctaaattctataactataacttttcagaatctagataaaaaatagacagtttgaaagagtttctgatttttgaagaaactacggcggctagaagcctaagatactcttaaaaaaaccccgcaataaaaaaaagatactcttaaaaaattactacatccgtcctaaaatatagcaatttttggattgtccagattcatagctaaaaatgattatattttagaacagagggagtacttttgcattgttgaaagcagaaagctctcccaaacaggtcccataagctctctcaaacggttcaagttacttgcatcatttatttcacatgaaaagtctaatttggttaagaataaaaggtaattcacatgtacttcgacaaataaggttagactaactattggtaattcacatgtacttcacataatggattatttacgtcgaaggttagaatgggacctcgtatgtctattggtttcgacctaaggagaagcattatgtctcttggtttcgacttaattgtgtgatgtttattccgttgtcataagtatctgtactagttctaagaagaacctttggctctggcctaattcaataaatgttgtaggacactgaaatacaatatgtactgatttctttccctttatatttccaaatggttggattagcttctcctgccaacattctgattagcaaggctctcagcctgtcaaacacatgtagccatccaccaaacagtttcctgtcctctcagctgtttaattagctaacaacactgtactcagtttggtcgaacgtcgcacagatttcgggtggtggtaatctggtatgtttgacgaatggttccctaatgactaatgctcctaactaatcaattcactaccgacattttgcagtaaatctattaaaacaacaactaacatgatgtgaaaactacaatatattctttgcttacaaaccttcggttcacactaccgaattttgatttctcctctttttttttattagaccctcgtttgtcaatagcaaaacatcatgccaactaatgagtgataataagtgtagacaatttgtacaactggccaccttaaacaatgtttagtagggacgaaaacgtggagtgtgtgtaactcaattggttagtccacttgcggtggaaacagtctatccatatgagttatagacttaacacaggtgttcgtatttacgattaattattcttttagtggtaggtgatgcacctgtcgataacaatgtgtctatagtgactccttcaatctcaagatataccagcttagttttatgaaggtgtcataggagaagggtgtaagtatgcgcatttataacagcgagtgtgcaaacattgtgagctcttggatttataccgtgttctcaaagaaaaagatagggataaaaagggtgatagaaatttccgaccaactgagcatagtttttttgtaaaaactgataccaaccgtttttattctaaccccatatatttgttttttttgtttcttttatcatcatattgtaatcatcactggttttcgtgaagatgctaccgttttcgaacatttttcatacctacttgtaaccgttaaaaaggtccctcttcatctgtagcaaaggtgcattcctgttacaacttacgacttgacactgccagtgattaattaaagctcacagtgaagtgttgggtagtgcagagagcgagtgagagagtagaagcacgtcaataatcgggtggaagagggtcacaatcggtgttgatcaatgaagccatcagcgtcttcttccaacagttgctccgctcccacatttatcatcttaaccccaaaagctcactcactcactgcagctgtactgccacacccccacctcactgcggactagcagcagcagcaagagagagagagagagtgggagagtggggagaagctaagaagaaatcaagaatttcaatctttgccgacaccacactggatttccttcctcaagcaaccatggcagcagcagcagcagcatcagcatccatcgagagcatatattagctatccgtggtgatcatgtgatgccaagattgctactataagcaaggagatagcgagggagatattcttctctttctttttcaggtgggggagaaggtgaaggtaggaaggagggagagaggccaagaatggcggccgccgctttggccggcgttctcctcctcgccctcgcggcggtggcgggagccgacaccgacggcggcgacggtaatatcaattgcagcattcaccccaagttcttggtttcttggaatgcgtgcgtactgtttgatgatatgtctgcacggatgatcagttgcttttggttcttgcagccgcggcgctggggaatctgtactcctcctggaatagcccggctcagctcaccggctggtcggccggcggcggcgacccttgcggtgccgcgtggatgggcgtctcctgcgttggctccgccgtcacctcgatgtaaataaaagatcttctgattaaactccccccaaaatgtttttgagtgatgaaaagatttcgcgtttgatgcctttcatgttcgtggaaagcaggagtcattttgctggttttcttttcactgcatttcgtaaaaaaagattgccgtggctttgtcttgacgtgtgggcattgaaagccgctgatgaaatcctgaagtgtgttggtttttcacattctctatctttcagtaaatttctgatagataattggaaattctcatcctttgcagtagttgattgattctactatcatgagataaaacgttgtccaaaaaattttcattggatgcctatgatattaagagatagaaagtttttttttcctccctgcatgatgtcaagtggtgttaatataattctactctactctctgcatcgattaatttgccagctcagagtttgggagactggatccagccatccaggcaaataatggtgctctgctggttttcagtgtctttttcagttgtaggaaaaagggctttttcgtatgcataaaaaaatatttgatatttgttctcgttcaaaatctgatgtctgggtaacatgcaacaagcagaatatatctattctggctaaaatatagattatacaaaagaggctggagagtgtatcttatctttaagaccataccttaattttgctattttcctctctttttttttttttgtatatgaaatcgcctcaaatggagatgctcgatgctgaaccattctgtttgttcccttgttctgcagcaagctttctggtatggggctgaatggcactcttggctaccaactatccaatctgctagcattgaagacaatgtatgagctactacttgagcacaagtatttattgtcttgttttcccctaatttatgtccttcatttcttaacttacagggacttgagtagcaacaacttgcatgattcaattccttatcagctgccaccaaatctcgcctatctgtaatgcttcctggcttgcacaagtttattcaagtagtttttgatgcctgcatcttcaataacagttgcgatgcaggaatttggcaggaaataacttttccggtaaccttccatactcgatatccaacatggtttcactcaactatctgtaagtgctggccattgcaaatgtgcaattcattaggtggagattgttattttggttgacatagtctaactgtaaaaaaacacatctacatgcagcaatctcagccacaacttactatttcaggaaattggtgaaatgtttggaaacctcactgcactttctgaactgtaagtcctacaggacctttctttgcaaggcttgttatctcgattgttgaaactcttggtttcatgacatgatcttgtacaatttgaaatctttacagagatgtatctttcaataacctgaatggcaacttgcctatttctttacgctctctgtcaaatatttctggcatgtaagttcttactaatcctcagttcaaacttccaaatttcgtatttcatttcatggttctgatagttcttttgacccattgtgtagttatctgcaaaataaccaactatcgggcacagtcaatgtactcagcaacctaagccttactacactgtgagtgattttgtaca

SEQ ID NO: 24380 - DNA, 2981 bp, Oryza sativa
caatattacctacatctttggtgcttttcttttgcagcttctaacagggaaatatgggatcacacccagcaagacgcacctgtttcaagttccgtgctcccgcctatgggaaaaatgactcctgaaagggtatatagtacaaacagctctatgtcaaagaagatgaaggtctctgtcacagcgaatccatatacagttgcttctctccaagttgctacaaacagcttctgccaagattcgctcctaggtgagggttcacttggtcgtgtttacaaggccgacttccccaatggaaaggtaaaacatcacttgcagtaatctattgttggtcaatacagaaatattactttgaacttagcatggtattgccttatatatgttcaacaagtgtttatttgcatagctatgacgcagtggaactgaattctgtgcttgatcgcaggtacttgcagtgaagaagatagacagtgcgtcactttccttgtatgaagaagataactttcttgaggttgtgtcgagcatttcacgacttaggcacccaaacattgtgccgcttgcaggctattgtgttgaacatggacaaaggcttcttgtgtatgagcacattggaaatgggacactgcatgatatattgcattttttcgatgatacaagcaagatccttacatggaaccaccgcatgaggatagcactaggcaccgcgcgagctttagagtatgttattatttgagcactctagtgtttttcactctatgaaaaggttatgttaatcaagtataatgctacaatgcaatgccaacctttcttcagatacctgcatgaggtgtgcttgccccctgttgtacatagaaacttaaagtcagcgaatatcctgcttgataaagaatacagtccccatctgtctgactgtgggcttgctgccctgacaccaaatcctgagagagaggtaagtaatgtagtaccacatctctatcaatgtagttatttccaacatttcatctttaggtcctacagtagttctttgggctaaaccatgtgttatgatgcaggtttcaactgaagtgtttggatcttttggatatagcgccccagagtttgccatgtcaggaatatatactgtaaaaagtgacgtgtacagttttggagtagtgatgttagaactattgacagcacgtaaaccgttagacaggtacattaccttattatttcagagctagtaagtagtaagaaaatgagtaatgtatttctttattagtaacttcaaggccgtcattcattcttgtgttgcaatgtgcagctctagagagaggtccgaacagtctcttgtcacatgggctactccacagcttcatgacatcgatgcgcttgccaagatggttgatccagcaatggatgggatgtaccctgcaaaatcactctcccgtttcgctgacataattgcattgtgtgtccaggtaatattcgttatctttcgcacatttctttgtcctgcatatgactacccatttcttgttcgcccaaaattgttcttacagcttctaatatgaacaactcactgagcagacggttcagttctatcaatcttaaagttggttttggataacatatgaactagaaatactcttcagaagcacgctaagatcgatcatcattttcagtttgtaccataatgctgtcaatgctttgtagcccgaaccggagttccgtccaccgatgtccgaggttgtccagcaactggtgcgcctggtgcagagggcaagcatggtgaggcgtcaatcaggagaggatgtggggctttcatacaggggccctgaccgcgagggaggcacagccgacgccatctgagaccaaaatcttctcagtctctcagctatgcagggttacaaaagtttcagagaaagcaagctgggactgtggcaacatcccagtatctccaaagctatggatcagatcacttgttcctgcacaaaatgaaaagagaagagaagaaaagaaagaatgatctgatcacctgttgagtttggcatgagctgttcagtgttcagttttttcactctgttctctctgtggtatctgtccaattgtatactacagtatgtggattttgggccgctactgggactttgtgaatggcatgtatagtgttcaggtggctggtattttggtagttgttaattaatttatagtagataagaaaagaaggtagataaatgtacatttatggacttgtgcactgctactgtcaacagctgaacattccaccttctacggcgagctgtacactacatgcttatagttttaagagatctctagttttaacggtatttacattcttcgagcacttcctcttttttttttttgaaatataagtatttatacgttgtttagcagagattatctttgggaagaaaagactttggtgtcccatattaagtgatagatggttgggaggtaagatgtgaataaatttcagtaggaggtgactgatgggataataagtggagtaatactctgaacaatgctagaagtgtttatattttgctacaaatttcaaatgttagaaatgcttttatattttagaatagagggagtagtttgttgttcttctaatttaatggtattgtactcttgtcctgccataagataccaccgtactctacgactatgtgcatccatgatcatcatgttcatcctctgtcttaaaagataaaactgctgaaaatttctaggatagtgacatgtgcctggttggtaagtcaagcctgagtactacagcatatcgatgacagcaaattgcgatgcaatcatgcaaagtctgcaaacacatggcaattaaattcagtaacaggaggctgacaactccatcatttagtattaggtacaactaaaatttaaattttaaaatcattttaatatatattttttcatctaacttattttttaatcttaccagttgaatcgttaaaaagggctgcaggaat

SEQ ID NO: 24381 - DNA, 6973 bp, Oryza sativa
aaagcattacaatttataatcagtcgtatacgaaaacgaagagagagtaggaggctctactccagacctccagtggtgtcctcttgcgtgctaatgtcaaaccgtgagatggcgatgcggtttgacgttgaaggcatcttgatctcttccctgattctggctctgttataggagtatgtttgagtgatcagctggtgtgcattgaatttgagccagaaattgctctggtcgaatttagtttcaaattttttcttcaaactttcaactttttcattatatcaaaacttttctacacacataaactttcaactttttcaattttaaccaaacttctaattttaacgccactgttcgaaaagttggtgcttctactaattaaaatggaatataatttcttcttctaaagttaaatcagttgtgccacgtgaaccatttggtttggggataagcagagaactttcagatggtcacgtcgacgggacaggtttacttgcccgtctaatcaccatgcgatcacacgccattacgagactagggaatatccatttgtagagcatttgtagagcagcagcattaatgcagctggagaaatgcaggatttaggaatagatttttcttttaaacatcattaaaccagcatgtagggatcatatgctcacgtaaggaacagatgataaatggcatactacttcttaatttttatgtacatagcttatgttcataagcttgtatagaactttatttattttaagatggagagggtaacattactgtcaaattattataaaaaagatagcactagcaatatggtggcatattttacccatataagaatcgttccggtgactatgtatattacccatatggccacatgtaaatgtactttcagtgaggccagtaatttctcactagtctccatctttctgtgtgttaacgaacgtatttgtatgtgggtacgtgtctcctctgtataattgagaaaaaaaaacctatgaaatttgacgttctttctagctgcgtcatcttcacctaaacgaaagaaagaaatgcctccatgatatatcgacaaggaaaataaccacatcttcttttgaaaaaagaaaaaaccatgaataagaaaggaagacaatcactatctactctaatttaataattttcgttcagaaaaaaactttaatttaataatgtgaaatgctctctatacaacaatacggtgcaagaattttctctatatgaaatgattcgcccatatgttaccgccaccaattgacgacgacggaacaaattaatcctctgactttggaaccaaaaagccagatacagaacagttattcaagtactggtgccataatgatgtgtgcagtatgaaccgtgcaggtactgtaccaaaagggctgtaagacactgttaccggaaattaatccatccatgttaaaataagagaacttttacgatataatatactaccagtatatactgacagtatataaaagggcatattaggaatttgatagaaaataaaacaacactttagtaatttttggttcaaattgaatttaattgagagtacctggtcctggatcttatcgtgcactagggaaagagcatcctgagcgccatttgatgacaaagcacgtgatgatagcacgatttgatgatagaataacgaagaaaagacaaaattaccctttcaaactttatactgcaatctaattaaataaaaaattaaatcaatctacaccgttagatcatatatacttgcagtatatactagcagcatatcgtatcgtaaaaatcctctaataaactagttcgaaaagcttaaagtttatcccaatacaaatcaattcttaccttcatgtatatcttcggtccacaaatcgagaagttatatctattgaatacctttgtctatatgtaatttcttattaactttcttattgacgaagagtagtttaatcttttatcatcactactaaatactttgtactaaatgtatctttgtaatgcaagagactgatttatttaggaaagaagaagtatacaactgagcaattgtattatttacgcgagcaagtttaatagtagattataaactaactataaacttatatagattttagagaactagaaaaataaatagtattggctcttataaaagagctaactcttcatatactattttaagatgaatggattaaattcataggtaagagaaaaatggagagaaaaatagagataacgttataactcatccactataaaatgttaaactctaatataaacataatagttagctctactattaaacttgatatgatactatagcaagttgacctcatccatcagctacctaaatcaaatgactccaaattccaaacccatgaagttatatcgatgttccccttgactttaacccactcaaattcagaggaccatttccacgacaacggccactctagaagatcacagaaaggctgagtgccctggttgagcggctgagcccgagagcaagtcaacaagtactatagacattcaagctcttgcttaaggtggcatgatgagatgaatgagagaagagaagagagatgatgagtcactgcttatgcaatgggtaatatccacacactcctagatagatgaaagaaagagaccaatagattaagtggaaataaataaagtaatactccccctacctacttttgatagtcatatttcatcttggcacacagaccaaggataagtaattctacttatcattcatttaaacatgctactagccattcctcgtaaacaagtgattcattaatatttacatttctcaatgcccatgtagccaatcatgtgtggaagaatagaaagtcacacattaaatccgagaaagtcattaagatgataggttgttggattgaaatatgactatcaaaaataaaatttttagatttggaaatatgactatcaaaaatagatggagggagtatattgggacaagtgctttagaggccatgtattgtatagattacctcgtaattagtgagtaaatgatttcaacaaaattaaatatgaccatcacctctactatagaactgtattcgttagttcaggttgagaacttgtcccaccaaaaaaaagaacatgattagtattagtaaaaaaaaacttgaaaaatagattcatatgattttctttcaagcgacttccctataaaaaaatttctaaaaaaacacaccatttaatagtccggaaaacatgtgcgtataaaataaggaagtagaagttgggaaagagaagaaatgaaaacagcctaaaatttgctatgagcaaacaccgtgtaaactatactccctcggtaaaaaaaaaaagatacagtaacgtttagggatgaatcttcactgttctaacaaaaagataatttttagggggttttaagaaaaatatgaagtgaaaccctgaaaattaccgtttgatcgaaaaataaacgtttgagattcgtccatgtcaccataagtaaatattttacttgggaatctcaaaagtctatttctaatccaataatagtttccactacatatttttccctttttcttaagggacacatgggtttttcctcccccctccctctactctgtttagataactacggatccgtcaaccccctccacccatctccatgcggcgaaaaacgcacaaaaaccctttttgggagcttccaactcctccaaacagtcagaattcttatccagattctgcaaaaatgtagctatagaatcgtgaaaataacctagaagttttcaaagactaactaccaaccaattactcaaccaaaatccccaaacagagctgaaatcccccgtgccacggcttccccagccgatccaacagtatccacccgttacttggttccccatgcggtgagagccggtgaggtgagacactgactggatttttcacatttttgtccttttaaaaaacttattctacaaataaactcctaaaaaatttattatagaaatggtccttttcgcagcgccaaaatcattggtgccatggtccaatatgatggtgccattgacgttggcgttgtcacattcacccccggtgaaagctaagttagtaatgtgaaaggggacggtgtcagcgtcattgcaccaaggacctatttgtaaatatttttatttacacgtgggttcattttaattacaaataggttctttccaaaaaaaatacaaattggtactcggcaccaatcacgttggcaccggcctccttcgcatttataacttagcttccactgggaggctagagggacggcaccaatatcattagcgctgttatgatgtactatgtgccaataatattggcgcagtaaaaaggattatttttagaataagattttttttcgacattatttatcgaataagttttggatgaaaaactgaaaaatccgggagacaccgagatccggaggccgaagaatgttgccgcccacgcgcaaacgctctccacacctgcctgcctgcgtaaaataatacacggcgtggcggcgccccgcgcgttgcgctggtggtggtggagtaaataaaacccgggcggtgatgcgctgagccatatggccgcttccgcctccgcagccgcaacgctccccaccactctcctgctccgccgcctcctcctcctctccctgcgccgccaccctaccacccccgccccccgccgattccgctcctgctgctgctcctcttcctcctcctcccccgccgccgcgccggctcacccccacccgcccgccggaggtgcgtgctccgctcgactccattccatccagctagctttagcttagctaccaaccatccacgatcccatctcgcgtcagttgccgactgcttcagaaaccgagagagaccctgctcgaactcgttcgtgtgcttccacccgccgcgattttttttttttttgaggaggatgatctcggtcgcgcccaccgacgttctccccctggatttacaatgctttctttcttcattctgcttctgcttctgcgctgccatgtaaacgcgaactgaaatcgctcggattatccgtacaactccgccaaaaaaaaaaaaagaaaaaaagtttgaggtggggaatggataaacgtggagaggctgggttcccagatgctggggttacaggatgtagaccgggaaaaagaaacaaagatggatgcaaggatgaaaaagatggtcaccatggtaaagaaaagaaaagagaggagataatcacgatggagacaattcagcggtggccactgggccgccttcgccatatgccgttcccatttgcatcttgactatctcttatctgtccatgggaatcgaaaaaattttcaatactgtgtttcaatcatttttagtgcacgtttgcttatgctgaagttctatatataacgaacatgtgcttcaggtaatggcagtccatgtgtgtttgatttgctcaagtgtggtaggtgcagggagaagactgagaggcgagctgcgcagcagagccatgtcaagttccacgaattcgacggttttggcggaatcggtagcgactgggagctcagtggatgttgagcttctaccctttgtgaatgacaaacatggtggtgtgatcgttgagatgacggccccgatggatccccaattgttttcagcttccttgaaagcatcattgtcaaaatggagggaacaggtaatttccggaacagtggggtatacacttataggcgtatgattttctttgggtgttagcatatgttctggatgattggttagtaatgtaaatatcctttaatattcatatttatatatgcaacttaataaattacaaacagttcaagtttgaatagtgtccagtttttcaagattcataatggcacctatgcactatacgtatttaagttaatattcaatacacttaagatttacacagaagtcaatggtgtgcaaaaaaaagacctgaatattgattgatatttggtatgtatcatttaaatgcatcccatgcaatgttctatgtacacatgtggctgcaatgaccactagaaggtttcagtgctatgcggaatggcaccctgagagatttaaatatttcagcaaggagaacggagtctaatttaaataatgtttatgagggttggggatccatcatgatacccaatgaatgccatagatcagcaaaacctattaatgttcatacctaagtgcacttttcatggcgacctgaaggagataatgttataacgcatagccttcatacagtttgttaattaaatataatttcctgtatgatattcccgttggtatctctgtaattgtttatcattttctttgcctgcccttgttgcagggaataagaggtgtctggataaaattgcccatcagccttgccaaccttattcaatatgcagtggaggtagctaaactcacatatttacatctctttagtagcaaaactagtttcatcctcccattctcaatttaatttgccacggtactattattttccaaattgagatactttagtagaattatgcatttttaagttggaaatagcaattattctagttttttatagtagttaatatgcatattaccatataaatctgtttggacatttttatggacgagacagtaagagattatcttactgtatgaatgaaatgcgacattgtacaggaagctgtttgattgatctccgaatcacttttacttcatcttcatgtaggaagggttctggtaccaccatgcagaggaaacttacttaatgcttgcatactggcttccagctacaacacatacattacctgtaaatgctactcaccgtgtgggtgttggagcatttgtaatgaatgacaaaagagaggtactgaatttgaatacaaaagcactatttcagggattcagaatttcagatagtcatggttctgttatatcttcccagcatcctt

SEQ ID NO: 24382 - DNA, 919 bp, Oryza sativa
ttgtattgaatatttataggcttacaaataatgaaaaacatttgttggacacttggacttcactagaattttctcttttttgtactacttttatcttttgttttgagcgtgtttcatcggaggaaatctgaaatacatagagcgtaacctttgccccctcctctatccccattcttctcttatgtttcatgaaactcttacggttgtttgaaataaacctctgaactacaaaaccgggtataatacacccccaactatcaatactgaacatctagagcttgtttggttgctgccctgacagcaagttgctggaagttcccagcaagttctctggccggagacatgcctggcagcaagttgctggaagttcccagcaagttccctggccggagacatgcctgagattaatttgtgagtgtttggttgctaacctgaggctccttccacctcgcctggcctgatgtaactcaggcgcggaattagcctgagccaggcgaccgatgggctccaggcgcagcagcgtgctacacattagcaccataatcccctcatccccgccgtgataactccacacgaagccgccgaggccgccgccgttgccgtcgcgcgaagccatcgcagccacacgaagacccctccggagtgctgcgtcatgcttcacatgcagatgctcttctatgatggatgcatggattttgcaattctattctgatggatgcgacatggatctggggatctctttgctcctgttcttctctcttttttctcttcttgatgatttccttgttgatcctggtgtctacgcaaagcagcgccgccgccgtgcggaggcatcgtgtcgccaggcaaggatttcttccgcccgtggttgagtaagcagatcgactttgcaatctgggtgcaatcgggctgcaggaat

SEQ ID NO: 24383 - DNA, 2653 bp, Oryza sativa
  unsure (1)..(2653): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacctaaatcattctgtagttagtatgagctgtgtccttcataagaagcaaacttagtaaaaaagaagtactgtacagaacagttgacagattagaaatgggacctcactgaacagactagtatcagtgcactgaatgtggtaataggcagtttctgcttaattggacatgcagatgcagatgattcaaccgaatgatacactcatctgcattcagcaagacaataatcaattataagtttgtttagttctttgggtgtaaagtttttgaagtatatggacgaacatttgaagtattaaacatagactaataacaaaacaaattacagattccgcctgtaaactgcttgacgaattcattaagcctaattaatccgtcattagcaaatgtttactgtagcatcacattgtcaaatcatggcgtaattaggctcaaaagatccgtctcgcaatttacatgcaaactgtgcaattggtttttttcctcacatttaatgctccataaatgtgtccaaacatttgatgtgatgtttttggctaatttttttttatctaaacaaacaaggcttgtttaccgggacaagatttttgcccatgtatcctttcgtttcatggattaagacacaattattgcctcttgagaaagtgggtcactgcttagcagtgttgctgccagttgaggtgtactacttcagttaagaagtaacttagttccccaaatttttttcttaaaaacattatatcgaatctttggatatatgcataaagcattaaatatagataaatgaaaaaactaattgcacagttaggaaggaaatcacgagacgaatcttttgagtctaattagtccatgattagccataagtgctacagtaacccacatgtgctaatgacgggttaattaggctcaaaagattcgtctcgctgtttccaggtgatttatgaaattagtttttttattcgtgtccaaaaaacccttccgacatccggtcaaacattcgatgtgacatccaaaaattttcttttcgtgaactaaacaaccccttacattcactttggagaaacaagtgacatctccaacttgtctgtactactgttaccttgactgatagggaatttctgtctagtagtaccagatgtaaactgatcctaattactctatacatttatgtgttgacaagaaccatcattgtacttccataaatttacatcaatagatcaactggaattggactgtactactcccttcgtacttaaaaaaaataaacctagaacaggattgtatttttttataaaacaaagaaccttatcttttttcttatgcttatcaaccaaaatttaaattttcaactctaaatttggagttgattttaggggtttttcattgtaatttatttttcagcctttgtttttagatcatttagaatatgtttataaatattttattcacaaattattttttatttgcaaatatgttgtttggcttattccaccaaacaaccaaacgatggggttgaaagggagtacacattttcaagtgcaatcatccctcgtttgcgctgtcactaacatgtgaatttgaagtctcattccaaggaacagaagttgaagtctaaggggatgtttggttgatgcctaaccttgccatacctaagtttagactagttgtagcatggtggtacaaatgtgacttagaaatagttggtcacaagtgtggcatgcttagctctaaatttgagagcatgacatgtgggtcccaaagttaagaaagtatggcataacacaattgcggcagcgaaccaaacacatgcctaaaaaaactgtggcatgactaaagtgtggcgtggcaaagtgtggcaaccaactaaacagcccctaaattctttttagattatttactggatggttgaaacgggatatttgttttatgcttagttatttaccggtttctttagcttcacacattaggccaggtttcactgctctaatcaaggcttccgattgaagtttagtaggagtatagtgtagtgttagtgtacactgtctttaagatcacattaagaactaatagacctgtaaaccctttcatctagcaggatgatgctttgggtgatgagctggttgttgagatgtgaagttgtttgccattaaaaatgctcctgaatatatctccaacgagagacgcgtggcagtaacatgcatccccgtggcttatgcttcacattacacatttgtttatacctaaacctaaagcttaattactgcattagcttccagatcgacgctttcagttccaggatgagatgcctacgtaacatgcgaatctcgttaccggatctcgttgccagttaaagcgtaaacaagtctccttaaaacctgactgtttcttaactgaattctttatatggg

SEQ ID NO: 24384 - DNA, 2723 bp, Oryza sativa
attcctgcagccctatatcctctctctctgtatatatatattccacttcgatatgatccatatgtcagtggcacagtaacccttatattctaatcctaactacacttatctgagaatgccacttatttatgataggaaagagttacagtaattttttcttttgaagcttaatccctcttttaatcaacatcattaaccttttaatgactaattatactatgccacccctctgctgccgttctcgccgtctcccttttcttctccgatcgccgcagcttccgcgaagaatccgccattaaaaaaaaaaacccgagctctcctcgccccggcgaacgcagcaccatctccagcgagcagcagcagcagcgcgctcttcctccctgcactgcccgtgcccggcggcgaggagggagggggggagggagggatgggggcggtggcgtcgacggtggcggcgcgcttcgccttcttcccgccggccccgccgtcgtacggcgtggagccgccgccgtcgccgtcgccggcggccgcggcggaggacggggcggtggtggagctcagcggggtgccgcggcgggccggggtggaggcgcggcggctgccgacggggcggggcacggaggtggtggccatgtacgtgcgccagcccggggcgcgcctcacgctgctctactcccacggcaacgccgccgacctcggccagatgtacgagctcttcgtcgagctcagctcccacctcaacgtcaacctcatggggtattacgccacgtcactctctctctctctctctctctctctctctctctctctctctctctctcggattggattgctttggaacgtgaccctcttctttatcatttgcgttatgatgcatactagttgcttaattcaggcgaaagtgtggatctctgaagtatagtttgtaggaagttcatgatcatttgattgtgcgtgtttaggatcttgtgatggatgggtagcaatgttttggtctccactactgttctcagttttgcatttcagtttaggagttatatttcaggtatagtgccattggccttattttagttcgagggaaaaatgtgttatgcggtgctctttactttttactaatttgatttgagtgcctggcgaatttgatggaatcatggaagatttcataatgttcaaggccgtgattgcgattggttttgtattcgcagaaggtggcgattgctactgttgctattcatagttgtctcgaagtgtattgggttatgaagtgtggtggaagattcatgtgttgttgcatcagtgggaatgtctgacacggcagttgttatccggctgtgtggctcaagaaaagtgaggctattgtggtgaataattgatagatttgattgaagttgatgattagtttatgtactaagctttagagctgactggaaagtttggaggttactgtgctgtcctagcaataggtggggatgtttgcgtcatatcactagtactaggctgttagtaccctgtgatctggtgttaaatggcaatgggtgttatggaactggtagattagatatttagatatagtggaacccaatgtagttgccacatttgataaaaataacacctcattggcttatatcaaaggattggtaagatgacgagttgtttttatattctgatattttttgagaattgtttattgatgtatgtgccttgtggtgtatttggtgatgtgcatatttgtatatgatttttattggacaccgatactgtataccattctgttttttttatacagaagttaatcgcctaaataaattaagtttaaattatggatcttatcgtattgcaagttgtgtgccaacgttggtcataaatcaggacattttaagactatttgcacccatttagagggagggtagaacatagtttgattcttaactcttctatttaccagtttttcgatagaaatacatgttctatgagagggttctttgatgaacgttctgttggcctgcttccattaaatctgttgccctttggctcttctcaattaaagtctgggtttttatttctggtttaggtgtagtagtgaataaaaaatactggaaatattgtctatagctcccttccatacttacattttaatacagtactaggtttttagtgaaggaagtaggcattgatcccatgactacgttcaatggataggctggcagatgatctgtttgttggatagtcattgggtggttacctggatctaacacagatacgttatagccaatttctgatcttatcatgttgatcgattgctgtgttctgcattcccattcaactactcatattggtcatttgtttttagtaatatgaaaagtttatcaccaagtttttttgttatcctggtagggacctggttgtggtctattatgcttttactttgacatgatggcaattacagtttgttgattttgatgatcattcagtatccgcatagcttgcttaaatcactgaatcatgattatgatataagcttcatttgatatttctctagtcatgattgtttcaatgtgataagcctcactgatatcttaacataaagtaacttcatatttatatttttacagttacgattattccggttatgggcaatcatcagggaaggtataaaatcatcctttcttaggaaagtgtttttccttccttttttacccatttcgttttccttttagtgaatt

SEQ ID NO: 24385 - DNA, 1095 bp, Oryza sativa
ctgattatgatgttttggatgaagaatgactattgagtagctacgtgtatagtgtacacaaatatttttctaaaagaacaaaaaattatgtcatctgcagggtacagctgatgaagttgtcgactgttctcatgggagggcactgtgggaactctctaaaataaagtatgagcctctgtgggtcaaaggtggaaatcattgtaatctggaactatatccagaatacatcaagcacctaaaaaagtttgtcatggccattgagaaattaccacctacaaaagatgaatcctcagggagctcaggtccttcagatccttgtgaaataggatcagaaagtatgcagagctcaagaaaaacacggatgtaaaggataaatctaggtcaagcattgatcacaggcatagcgttgataggcgggaaaaaccaagaggaagcatagataggagagataaaagcagaaagagtatagatcatcctgataagccaagggctagtgtggatcaacctgatagaccacggagaagcatcgatcggtgtgtattcttatatgctctcgttttgttttcacggttctttgtggattcctgttaccagatgagatttgactgttgcaacccattgctgtgacagttttggagggatgatgaggtcggtgacatccgtcaagttgtgcaatattgactgtttcaaagtaacctatgcttctgggagctgagaatactgaaaggttagtgtttgtgagtcatctgtatttaccccgtttgcattctttgttcgtttgtggctggctgtggaatgtgtatttttttttcggaaatacgctgtggaaggtatattgatttgggtaaggccttgtcttctcttgagttgtttcttgaaaagaaatagccattctttcccaacccttttgagtttttggagtacattcttttgttgagttcaagaacgacactgccgtggagcactaaggagcaccgttcttacatagatgtcatgtacatattgttgtatcattatactgtccagtttttctttcacacgggaacatttcacagacgtgatctaacaaaactgggaatttttttgtccctctcg

SEQ ID NO: 24386 - DNA, 1809 bp, Oryza sativa
gaggcgccccgacccctcgcgttttatactccacgtgtatgggttaggtgagcacagcagggctcacctaaccgcatttatcgcgcctctgctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcacgtcgtcagcacacagccaccttcccacgacgtgcccgcctcaggcagaagtggaggtaggtatgtgccgtcccatcaggaggattttcggaggacgaccgtgcaaatctccgtccatttatgaaaagaagaaaagtccagtttggaaagggaagggtgcatgtggtatccccttgaagtataaaaggaggaccttgcccatagaggggtggattctttcgagattcagagcctagaacgagggagaggtcggctcacactttgtagctccttcatacacagatccaccaaaacacaggagtagggtattacgcttctcagcggcccgaacctgtatacatcgcttgtgtttcatattctcttgaaaggtcgcgatctttccgtcatctacagagagagcttgagatctcaccctgagcccccggccgaaccggcaaaggggggcctgtgcggtctcccggtgaggggccacgagctccgtcataggtagtccattggatggtcaatatatactagtataggaataagccgataatcaagttctgacagagaatggcctctaatatgtgacatcacgtctagtaatattttatatacagtgtcatttagaattctagggcttacgtcaaactagctagttatgccaataaacgcactttacatcaaataattttccatgtaagaaacgtttttggccaacgaatactcgggtagatactagggcttacgtcgaactagttttggcgccaataattaatagtactgtgatataagtcatctgatgaatacattccacgtaagcaacgctttttttctaataagtcctagggtttgcgttgaactaattttgacgtgaaatccaaatttcctcaacttacttaaaacaatgaatctatatgatttttttttgtttctcgcattatacgatttctaataaacaaagcatcgattacaagattttcttttacaccagtggctaaaaaataagttcttaattaacctacctgctagattgtcattaagataatttattatctgacacttggttaccactgctcaatagcaaagaggttttaccttttggagcataacatgtcccctgtgactctagctaggcaatagaggtagaaacaatacaatcatggtgaaacgtgtaagtagtccattggtggtcaatatatactagtgtaggaacaaaccaacaatcaggttctgacacgaagactaatatgatacgtcacatctagtagggaaataacaccttaatttgtgccaatgaattttagggcttacgtcaaactagtttcgccaataagcgaaccaaattttgacacgaaggttctctagtgtgtacatctagtaactttccacttatacaat

SEQ ID NO: 24387 - DNA, 813 bp, Oryza sativa
gccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagccgtgccggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaagcaccagtcggcggcggacgaggcggccggtcggtgaagacgtagacgcccaacaacggcagcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcggtcgaggcggccggtcggtgaagacgtagacgcccaacaacggcggcataaaggccagccgtgcaggcgaaaacaccagtcggcggcggcgaaggcaagccggtcggtgaagacgtagacgcccaacaacggcggcataaaggccagccgtgcaggcggaaacaccagtcggcagcggcgaaggcaagccggtcggggctgcaggaatcgcccaacaacggcggcataaaggccagccgtgcatgcggaaacaccaatctgtagcggcgaaagcaagccgttcgg

SEQ ID NO: 24388 - DNA, 549 bp, Oryza sativa
caggcggaaacaccagtcggcagcggcggtcgaggcggccggtcggtgaagacgtagacgcccaacaacggcggcataaaggccagccgtgcaggcgaaaacaccagtcggcggcggcgaaggcaagccggtcggtgaagacgtagacgcccaacaacggcggcataaaggccagccgtgcaggcggaaacaccagtcggcggcggacgaggcgaccggtcggtgaagacgtaacgcccaacaacggcggcataaaggccagccgtgcaggcggaaacaccagtcggcagcggcgaaggcaagccgatcggtgaagacgtagacgcccaacaacagcggcataaagaccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtagacacccaacaacggcggcataaaaggccagccttgcaggcggaaacacc

SEQ ID NO: 24389 - DNA, 703 bp, Oryza sativa
aattcctgcacccctagtcccttgacaatattcatcaccctggagctatgtactttattcccacattttcttggaactatgtaaaatttcaggtttgcattgcatttattttctgaaacacattgagtattataaaatggtcttgcattatctcaccgtacatgttacatgttgcctttgtaggatgttgcttgacttttgtgggaacacttcaaatgaaaaaccgccacaagatatgtcagagctagcaatgatggagattgtcatgaagaggtaagagtgtttgaatatttatggtgtcttggctttgacagtcatagcttatttcaaggggaaaatttgcacgctcaaaagtcacctggaattattttgcttttgtatcggaatctattgacaagaaaaaatttgtgtttgtcaagtaccattttttaatttttgtttgtttcgaaactaaattaattcagttggtactggggacagaccttgtcttttttttttttggtggaatgaccaaaggaggtcattcaatgtaattaagataggaagaaaaagttacagaccttgtaatgaaaaactaaatattagtgattctcataaggctgtacataagtgcatcccttgatacctccgaggggtataagtttcgtttgaaaaaagtagaaacgaaccccacccaacactaacacgtaacaccccttactct

SEQ ID NO: 24390 - DNA, 1579 bp, Oryza sativa
ttctgggtagcagtttccacattttatgcgaccaatgttaatacactagtagtatacttgtgaagtgagttttactctaattcttgcactttcagatttctctataaaactattccaggcctgttctagctgatagacaacagatgaaactaagtttatgacaattatttgaggatacaaatgaatgagttgactatcagaaatttgataagttgattttatttttttctaagaaatgttgatgaagaatgtttttttttgaaaaaaaaactgtttaggagattaggaaacgtgtccacgataatccataatatgtattgtcattagaatgcccgtaatacttgcattttgacaatatgttggttggcactaggtagtcagcttgtatctggcaaatccgaccaacagtatgttatgcaaaagttttttttgtttgttattatcaacatttgtttgtaaatccaactggtgtgtgccagtgttaaaacgttatagtcatgcgtggtattttgaagaggaatgaactgacgaagttccactgttattttatcgagaaaccgtttttttttcttgcaattatcaggcatctgcagctgtatggctcttgaattttgacttatctgcaacttaacgaatctaattgcagcaactggtttataaatgtctcgttgctggtcagaataatcaggcagctgacgtatctgtatggctgtatcagaggtgttagtccacttgacgcttgctcattttgcaagtactagtaggggctgtaggacaagtcaaagaaagcctggtagataaaagaggttaccgccaaatatttcaactcaaatcgaaagcaacttgatggaagcactgcatgaagattttcaacgagatgtctaaattattgcaaaatgacgaaggcatcaacaacgacagattcacagttaaaacataagtacatgtcacagcgttaacataggttgaaatggagctgtaacaagctgattagacccattaggtttgcgttattatgcagcatcaagttactttaggaactttgctataatttcgtaagaaatactaattccccctgttaaaaaaacatcttttttttactatgaatatggatgctttgggatgatactttgcttgcatgctgcagcattcaacgaaaagtctgaacatgcaggcagcaatgtttctacatgcctttctttctctgaaatattcggcaaagataatatatctgctaagaaatataaaagagtcacaatatttttaggccatgtttaagctactcctaaaatgtcctcactagctgaagacactcgtagggaaactcagctcgcaatgtaggatacccctagatgggctcctcaaaatctgaagtaacttaatagagacactccaacccataataggtattccaatacacaaagccccatatttatttttactaccctacccctaatctctctctctcccaccccctcttctctttttcttcgccaccatcctcgcctttccctctcgctgccgccgctcgcctctcccgtcgccggcggccgcgaggatgacgaggagggccgcctct

SEQ ID NO: 24391 - DNA, 4564 bp, Oryza sativa
aattttataccctgtcacatcgaacgtttgaacacctacatgaagtattaaatataggctaaaaaataactaattgcgcagattgcagctaatttgcgagacgaatcttttaagcctaattgcttcatgatttgacaatgtgatgctacagtaaatatttgctaatgatggattaattaggcttaataaatttgtctcgttatttactgacagattttgtaattagtttttttattagtgtccgaacacccccatgcgacatcatatataatacctgatgtgacacgacaaaactttacactccgtatctaaacacccccttattttatacgcaacatagattttgaaagcacgagagatgaatataaaaatcagtggccaaatgataggctgctagcgatatgcgtggcctatttctttttagaatcttcatagcttcccgagatatcagcacatgctcatgctcttagtcactctagagtctattactatacgctccctccatctctaaatataagtgattttggttggatgtgacacatatggagggagcagttactactaagttaaaaagaacaaacatatatacaaacctattttttatgagatggagagggtactctttctgttccaaaataattcaacttaagataaaatatgatctatcctaaaacaacaaatttgtattatcttagaatatgttattttgggatggaggaaatagttatccttgcgatctactccctccatctaaaaagggcaacctgcaaaaagatgtgaaacaatatagtacgatgaatctggatatagaggttcagagttattatactatattgtgtcatatcctctcatagtcctttttttagatggatggagcatattatagtgatatagtcatcccagttggctataattggaagtgattaatctggtcaaatcaaataaaagagaatatcccgtcttaaaaataacaagtcattttgaacttctcgagacccattttagaattttgactacctagttcagtataatcattatcataaaaaagttatttagtttgttcttattttttgcataagtgtaatattatgaaagctcttgttaggataaagttgaatatatcattttcatatacccaaaaagatattttgaatggtttttatggttaaaattaactctttttgaatgttcgtatttcaagcaacttgtttttgagagcgggggtatgttacttatttatttgtcatatcggatctagcccaaggaaaactttccttttatattggatcaatcacaaaaaaagcgaaacgtcgaactgaacgcaaatagtgtttctcctttcccttttcttcggtttgactacaggagtgataaaagcatatcggtccaaaatatctttcctacaatcatatttgtctcgcacaacagccaaaacatagcaaaattctaattttcattaccatgttcatatagaaaggcaatgtcgaaagcttcagataccaacgatacatttgaaaagtttaaaagttggattgaaacactcaatttttattttggtacaaagtgacagagcgagagacaaaaattactcgcacatctgaaatgtgaccaattcgatagattgctgcaccattttcatataaaattcgaactaaagcagtttgcacgcaccaaacacatgactagttgactactagcaatcactgcccactcatacataatcccggcaatggcggccgaggcgaccaacccctccacctcgcctcaccaacctcctccacgactccggggaactcgaatcccgccccggatagtcgccgccgagatcgatccatggcggccgaggaagcccaccgcctcgccgacgccagcgccaccgcgccgcccaagaacgccgccgccgtcgatggcgtcgccgtggcggcgccggcggccggcggcgggcatgggagggcgccggggaacaagctgtcgctggtgccgctgatattcttgatcttcttcgaggtcgccggcgggccgtacggcgcggagccggcggtgcagtcggcggggcccctgttcgcgctgctcggcttcctcgtcttccccttcatctgggccgtcccggagtcgctcgtcaccgccgagctcgccacggcgatgcccgggaacggcgggttcgtgctctgggcggaccgcgcgttcgggcccttcgccggttcgctcatgggcacgtggaagtacgtctccggcgcgatcaacggcgccgcgttcccggcgctgtgcgccgactacgtcgcgcgcgtcgccccggccgtgtcgggcggcggcgcccgcgtcgccgccatcgtcgccttcaacgtcgcgatctcggtgctcaactacacgggcctcagcatcgtcgggtggaccgccgtggcgctcggcgtcgcgtcgctgtccccgttcgcgctcatgttcggcgccgcgctccccaagatccggccgcgccggtggcgcgccacggcggcggacaaggactggaagctcttcttcaacacgctcttctggaacctcaactactgggacagcgcgagcaccatggccggcgaggtggagcggcccgggaggacgttcccgcgggcgctgctctccgccgtcgccatgaccacgctcggctacctgctgccgctcttggccgccacgggcgccatcgacgcggcgcccgaggactggggcaacggcttcttcgccgacgccgcaggtaaattcttccgatcaccaacaacgccatcgaatcgaatccagtaatcagatcacgttcttgcataatcacaaacacctagcacgcgcgccacgccgagattcttgattgattgatttatttattactttttgctcttttccattgacattggtacacgattccatcgaacgtgtggaccatggaaaacaaaaaagatttttttttctttttgcggggaaatcaatcttttttagtgttgttgtgattgtcatgagccatggcaagttaacaacgtgggaaagaggagaccaagcaattaggcagaaaggaacaattagatgatgatattattgtcgtcgaagaaaatctctataaagtcaattccccttagaacaatatggcaatatctttacagtactgtcagtacagctacctctccaagaacagtacaaaagattatgtgtcagtgtcaatgacatatactcctgtttagagctagtcaaatcctataaattaattcatatatcttactgtattatcttaatttggtgttccatttggacaatgataatgatgcccaacatttctaccattcttcagctgcacagatgaaattaattacgcgctgcatgttccataaaaagaatacaacaaagaatacaacataaatagtagattgtaacgacgcataattaccttatacctctctctttctcagaatttaaggcctgatcaaacttgacaatagtctccaaaactaatatttttttcgcatgtactacctctatttcaaaatatctgttgttttagattatttagtaaagattaatgcttaaaaggaaatgaccatagcgccccctattaaatgatgtatgatggggagtgtgtcggtagtttagagtaggatagagaaaattttcaattagaggtaactaatgtaacaaaaggtacttttaagtgacaaagctttttgacaaaatttaaatcctaaagcgtcaatattttggtacggaggaattactacactgtctataggaacagagtcatagctataagaaagtatattcaaatgtcaatcccgaatccaataataccgttgtcaacaagtaaaatttaatttacatcaaactaattgtcagtaaaatattatattgtgatgaggaggagtgagtattttccaagcttcacacaacaatcgatttacgcggcgcattaatttaacgatctctgcatctgcattgcactactgtggatggttgatcattttgattgatcactttctctgcaaacgcatgaacacgtacgcaggcatgatcgccgggggttggctcaagtactggatcgaggtgggcgccgtgctctccaccatcggcctctactcggcgacgctgagcagcgccgcgttccagctcctcggcatggcggacctgggcctcctcccgcgcgccttcgcgctccgggcgccggtgttcgacacgccctgggtcggcatcctcgccaccgccgccatcaccctcgccatgtcgttcaccagcttcgacaccatcgtcgcctccgccaacttcctctacagcctcggcatgctgctcgagttcgccgccttcgtccgcctccgcgccaggctccccgccatgcccaggccctacgccgtgccgctccggggcctgcccgccgccgccgccctctgcgccgtcccctcggcgttcctcgtcttcgtcatggccatcgccgggtggaaggtgtacgccatcagcgccgtcttcaccgccgccggcgtcgcggtgtactacctcatggacctctgcaaggccagagggtggctcacgttcagcgccgctgccgcagaccgcgcaggca

SEQ ID NO: 24392 - DNA, 16212 bp, Oryza sativa
  unsure (1)..(16212): unsure at all n locations
agctgtatatgctttccgatgtttgtttatctgtgtgtgtgtgcgcgcttctttccttgtgcagaagagcataggaattgagtgatttgtaacagtcttaattagtcgtagatgctgatcaaatcaagaaatgggttgcatattactttcaaattagcaaattgtacattcatgaaagtggtagaactaaagaagcatacataagctcaaagagaaattctcgacctcactaaaatcctattgaaaacccaccaggatttcaatcctattaaaggaaaatgagcaattctaaggcacaaatctaatgaaccaatggtagcatcttgtccctgattgcaagaaatcatggacaagctcaaaatcgcggcgaacatggttagcacttagtagctagtacgaaacacctagaaaaactttgaaagaaatacaatcttggctaaccgaatgcacacttttggagaaggtgaggagccatacctacatgggcgcgacatggcttgaacaggaggacaacacagcagcatgccgacggcgtgatgattcgatgatggcacgcatgggcgtcacaggacacagcttaggaagaagaaatggtgtgtgccgtctcaggtcatcatggagtagtacatgatgtttgctttgctaggggtatttgagaagagtgtgttttcttgtcttgaactgttgatgttgggggagaaactgtatttgtcggatctgctacagtactagtactcctactcttactccgtaggccggtacatttctgttgggtggaaatgggaggaagacttccggacccatcatttcgcttattcgcggaataagccaagcggcacatttgcaagcgaaaaataatttgtgaataaaatttttatatttgtagctatgcttatctctgaagtcgatatccggcgtcttgtcttggcgcatgttggcttgtatgttgatattgtatcttgatctattgtttcatgtcccctctcctcctagggggccttatatttatactcataggtatccccttgttcaagtagaactagggaaaccaatatggatacaatccgagtagtccttgtcgtttccatgtagaactctattcatccttccttatgcggaactcctcctatatccgaaggttgtttccgtataagacatggtatgtggtgggtcctgccaagatttagtcaactactataaggtatgtggtatccataacattgacaatgtgttcttagcgatccaaaagaaaatgctgaaaaataagcttcgatgaaaaaaaaaacctcaaaatcagctccaaatgtaacattgaaaattcaaatttggctgataagcataagcataagtaaaaatatgaggcccttcctctctgttctcataaaaaccggtactcggtaggagggatgcagcggttgataagaaaagtaaaatgtgtttgaaactcacaacgcgggaaaagatgtagtgcaaactacatatatagtggaaacatgaaaactaccattagaacgtaaaatggatgttcaatattcgtccacgtatgagtaaaatttttactcctgataatgtggacgaatatcagacgttcatttgatccaacgatagttttcagattcccactacatatgtagtttccaccctatattttccccttactacgcagcaaacatgtgacatagaggaaatccaaaatcagaaaatggaaatgctaacgcatttagaaatgattagactcatttcttagacacgcaaacaataataagagagtaaagcacgagagctgtcttgtttgtttgtgtaggccgaaattcaggcccacccatttgtatgccagaattgggcccatcaagacgaggccaaggttagctagtgggttgggctggtgtgggatgcttccaggtgatatttataaggcaataagttcatattgattcccttaactagtaattgaatctgattcgtatcctataccggatatctcgatcctcaactattaaaacggctacaatttgaccccatcgataattttagagggtggttttgccaacgtggctcctacgtagtgattttgatctagtcttcgtggtgcatggtggtggtttttttttcctttcctagctaatgcctattaagaatcaccgcaccatctggtgttagtcgtcgtaaaaaaaaaaaccggtagattctcgttagcgaacttgtaccagaactgctccgtccgtgtgaagcgcaggtcgggggcgtcaaagaagaatcggcatgagctcgatctcaaagcagaaaaatcgccatgcctgcgccgtctccacgcactcgaacgtcaccgacgaccccggcagccgatccacgaatggccgccagaggcaccacgtacgagtcgtacgacaacacacccttcgaagctcccccaggaggacgaacacaattagaagtataatagtataatagtgagttataagcctactataagtttacgtggatgagagaggtaacaaaaaaaatcaagagtgtaatggctctcatgcaagagctagcttaacacaaactccaagacaatacattaaatgtataagtgagagatagagagaggaaaagaaaaattgtagccgaccttataactaatctattatatatgttggctttaaaatggactaatagtatgaagtgagctctactaccatctttgctcttagctgcaccgggttcctggaaggacctgatcacggagttgatggaaggacctcttgttggttcttttctccaacaagagagagttggatgaagattaagatttttgtggcacgcttttcaaactgataaacggtacgtttcgttctatatgaaagttgctctaaaatatcatattaatttattttttaagtttgtaataattaaaactcaatcaatcatacgctaataccacctcgttttgcgtaaaaaacttaatattcatcttcatcttcagaagaaaagaacaccactatatatactatatgtgtcggttcttaatctaaaaccatcacctatattttaagaataggtgataataatttagaaaaaaccagtatctatacggagagaaatatagctgtcggttccagccccaaaccaacatctataatatattataggtgttatttttcttaaaaaacagcacctatacgaaaccgagccgagccaagccaaggagagggatcattttccacccgcccccgcagctcgaccctatcgttttatccgcatcttagcgctctctctcccttcccttttttcagagagtagcatagcgctgtccctttccgtccttctcttctccttcttctcttctggcaaggtgtccacggcggtggccaagggcaaggatagcagcggcgggtgggacgaggagtcctccacgtggtggtggtggccaaggacattggcggtggccaagggtggtggcggcaacagtggtggtggtggaggtggccctctctctgcattcgtcttcccccttctcctcctccagatctgccagccgacagcagtggcgatggtggtggaggtggcccttcttctgcatccgcctccccccttctcctccaaatccagtgacggtggtggagaaagctggcgcagagagtgaggtggcagccggaagcctaaaaggaggtggtggtggaggccgtcacactcctccccccctcgccaagcacttcgttgttggctccattgggccttttttttattatctcattgaatactatacatgttggttgtggggtaagaactaatacctataatttctgtatgtactggtttcagaactcctaggtatagatgccaataaattagtgtcggcttgaaaactgacacttactggcttttaaccagtacctatgttggtttctgtcgtagtggcggccatgccctcgatcttgtggaggagtctcgtgctcgccggccactgtgctggtggaagatcgagcagagaaaagcagcaaagcagcactgaattcctccttgcgtgacgccattagcgccatagttgcaaaataacccacgcagccgttgcaaagattaacccgtgctgagctcccccccccccccaaaaaaaaaaaaaatctttctcttgagcttgttggtgctagcatctgaatggagcctcgctgaagaatgagccggtggaactcattggtgcaggcagagctcaagctagtgctcgggtccgttgtgctgcacggctcatcgtacgctctggaatctggatgcctcgcacagggcagacagagagggagcgaagagaagcagaaggaaagaggaagaagaaggccctgaaaagctggctctccattactttatttttttttctaaccaggcataccaagtagacgaaaaccacgcaaatgctttgcgccgagcgtccgatgcaagaagctatcgtcggacgcgcgcggcttcgttacatatctacatagatatatgtttgatgatgtcacagtatacaacatgcaaagaaatagctacaaacttgattttcaaacaacattttctcccgtactatttattcgatttacgatttgattgcaccgttatattcgttacaattaaatctctataacaagatctcacatgatcatattccgatgaaatatatatatatatatatatgtttcaatcgttataattatatgtttcacgtatgagaaataaatgttccaattaggatttcactttgttgcaatttttaaattttctattgcaaccgatctttatttaatgtcaccgatagtattgttaagatgtttcaacatgtatttttcaatgtttcactattgcattcataaatattacctacaatgcatttgtcgagacatgcaagaaacacctcgtgcaacattcacaaatgaaataatgaaacatcacaaaatacctatttgaaacatcctgtgtgtgcaacactaaaaaacaccattgttaaaaagacatgaaaaatatacaacattgtcgagttccagctgaaacatttgttactcattcatgaaacattgaattataatgctggaaacatatatttttttaatcaaaatataatcatttgagatgttattgtaaagatttaattataaagatttaattataataaatgacatgaaaagtaagtcacctaaaaggtttctaaatgctaatataatactaatcaatacatgttagacttgttacaggatttgctgcatatagtgcacacgctgacacgcatgttgcatgctacagagttacaatcacaggcgcacggcaggatggcatgcatatgtcagcactcagcagcaagcaaaccaggcatccgatattaggaaaaatatcggacgtccgatgcggagtcgcctcccgaaaaccactctaatttggtaaaaactatcttagaagtgtaaattaaactgtattgatagttgagagcgtacgatatcaggttttaaatttaaagggtgtgatttagacaaacgtgatagtttgggatgtaaaatgggcttatcccttatcgctcaccttcaagagtcttgatgacattacgattcattctcatttagaaccctagctactttccaccccaaaatcttccttggtgccaccgcgcatcccctcctttcctcctcctccgaccactgtgcctcccctcctccttcggccaccgcacctcccctcctccttttctggccaccgcatctcccctcatcctccaaagctctggtggcgtggattgatgtttggttttgcaaatcgagcttggtagcgtgaatcgatctccgagggcgctagtcagacgctagcggatgatcgagctcgggtggtgtgaatcgatctccggccatgcaaatcgagcaccggtggtggatctagaccaagcggtgtggcaggtcgatcatgggcggagcagagaagtggacgatggcgagctcctctgcgcggcggtgtagtttgggggacggcgagctccctcccaggtctccatgatgagctccctcaccggccaccaagatgagctccctctcttccctctctccctttccttgcagtgcgggtcacaaactataggctagaactgacgaatcctagcacatcccaacgaggaacttgtgcccaaactaggatccgcgtacttcgcagagtaacgagggacgcagacgtggcatagaatctttgacatagctcgttgggggtagaatgacacctaatcacactgtgaaaagccctaacaagtgaaatatcacttgtccttataaacaccgtgctgttacggtggagttgtggatagatgtcttcactcactaagttcaaatcctgatgcttaaacatattatgcacacaaaggtgagctttaactaaaattttagcgagttgaaagatgtgccgctagactccatttctttaagtttatgtgagaagacaaatttgtgagtgtatacgtacgatgctacgtgtgtaatagtgtgtgtgcatgtgcgtatgacatgtaagtggaagaaactttacttgtccttggagtgccctgttattctttgtccttccccattcctcacctcaaacttaaacatccgcacggtcaccaaaaggacaacacgggaggaaaatgactgaatcccaaatcttgcttccctatgtttaaattgtagttttaaatttattgccaacaaatcttgcttaccgatataacctattatctccattttgaaatataaatgcttctaacatttaaaattagtactagatataaacacctctagcactattaggagtgcgtactatttgtctcgttaatcacgtctaatttattttttctaccttatgtccaatcacctttcgacttccaaccaaaccaactatctcttattaatattttttttctcattctgcatttatgctgaaaaatcttattcaataacatgtattaatatttatttttcacgttcttaatctatgctgaccaatctagagataagaactgaaaaattgatagctcctgatgagaataaaagattcatgtgtgatgcagacagtcatacatctcgacataaggaatactttatctgtcccatgaaaaatcaatctagtaattgtataagattcttcttagtaaaataaataaggaatactttatctgtcccatgaaaaatcaatctagtaattgtataagattcttcttagtaaaataaatgtggatagactcatatctaaattcattatagcagaaaatatctcatttaatactaagtttggtttttgtcgggtgagtaccggagtagaacgcagacagctctccttcccgcacctttcggtggtcggccaacccagccgtacggcactgtggcgaccgccggatgtgccgtgagttcgcaatcaacgagtcctcctgcgtaataattcacgatgtaattggacagaacaagcaaagctgcacgtactccattcgtcccgtataaatcaaatctactaggacagtacagcactccctccgtcctaaaataaatataattttacattgttcatatttatatatgtttgactatttgttttatttgataatcttttataattaatatttttattgttattagataataaaacatgaatggtactttatgcgtgactactttttctaatttttcaaataagatgaacggtcaaacgttggacacagataccaacggctgcacttattttgggacagaggtagtactaagagcaagtttaatagtatatctaacaaccggctccaaatcatttgtagtcaattttataggcaattcatacaatagttacctataaacatatactgtacaattaataagtctcacctgtcatacacacatgcatcttagagtccatgctaaagttggctataaatctgtagccctctactcttttctctccttttttacctcctcaaaatatgtttataactggcttataagctgctaccgtcagcagcgcgacatgcacaataaaacatgtattgtggtgcacggtgaatggcaattaattaagccgatgactgctgccgtaccccccaccctcccgactaaaaaacctaaactagaatttggatggatgataatctaatacaacgaattcgacatgtataatccaaatccaaatcctaggttagttttttttaatggagttttttttaattggacatctagctagggatgaaaacggtcggaaacgatacattattttattatttttttcgaaaacggacgaaaacggtcgggaaattttcatacttatgaattcatctatttagtgtcaatttcaatgccacgctgacagaaattaaaaacactaaattttgaaaacgataaccatcgctaaaaatattattattattatatagttttacggaaacggtgtatatacggtccgaaaatttttataccgttttcaccctgcagccttgatgttaccagtcacttgacttaatggctggcaggcaggcttatcacttgagtcgacgtacagccccatgatcaacagttcaaccttagtactccaaagaagtttattttgacttctttatgtaaatctaaaataatttttatttttatcaattattacatgagagtttgtaaaaataaaaaataaatatattgagagtagataaagtagaaaataattatattgagatttatccaatttaatataatcattataactaaatactctatgtcctattaaaaaacaacttccggggatgaacctggataagcatttatccagatccatccctacaagttttttttcattttttttcttggacggagggtgtaactcagaggattatattttgctcaaagaaatatgcatgtttcaatagcaaaatttcggttactaaaaatcaaaattcggttttttgcaatcatggaggttggagacttaaaaaaaaccctgtaaaacaaggcaactaagagagattttgctttaatttaagctcgcaacaagcagccaaagaataatggcactagcaggtacctctcctaggccaaaataagttgatttgtatattagttaaagtttatctagctcaattggttgtttgtcagatttcttgtggtgaaaccagtccaaatagatgcaagacctaaacttgataagagtgttcgttaattagttttttcagtagtcactattacataacatctaataagggacatctcatatatgacttataggtgtcagttgggagacataaccgacatcaatgttacttaagaggcccgcatataaaaatctattttcgcaaatagacctctaaatacacctgtatacaaaaacaagcctattttcgtagacggaacttttaagcagccacatgagaaaatgcattttcacatgcaggcctctcaaagccccacctacaagtctgacctttgtcctctcttccctctccactctcagcgccttcaaaatgtttaagtctcatccttatctcctcaccttctctccctcacctttaatttttccgtagtcttatttcctctctctctctctctctgtcacactccaatccggcaccgccgtacaacggcacctgacaggagcgtgtcgtaggaaaaacggcgcgaaccgcttcctacgaaaccgcaattatagtaccagtcccaggacatagtgctggtacccacggtgacaaatatgaatcattgcaatccttaaaataaataaaggacttatttaccttaacttatgttgtagcttagaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagctagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggcaaggaatcagggtagtacaatctacaggaattagtgcgactactgggtaggtccgtcggtttggcacgcaaaccgaggccaagcaaattaagtgtgtgattctaataatgcaagttacaaacaaaataataatgattttccaattatatgagcaattggtcaaagggtgacttgccttgctcaagatcttcacgaagcttcatgaatctacgagaaatccctgatcgacgaaaatccggtaaccgcggctatacgcaaacagtcaaaacctaaatgaaagactaaaagaaagaccctatttagactaattaatagtgccattaaatagatctcaattttacaggagtactggaagttgacggagtcaatcggagctacggattgagagatatgaattttggaagctcgaatgggattttctggactaggaaatgatttatctgaattttctggaatgaaaggaatggtttatggaatttatagaaataatattctcaagaatattattgacagtcactgacgtgcggggccaagggaaatgatttatggagcaaaggaaaaaggaattgatttatgaaaaagggaaaaaggatttattaaatcctttttggaaaagaaaagaaggatggatgtgatttagacttgggccgagcgaagggggcggggcccaggacatttgcggcgcggctgaggaaagtgggccggcgcacgggtgaggcggtccaaggccgggcgcggcccgcgtgagagggagccgaccgggcggaccgcggtccaccacgcgggatccggggcgggcccgcttgtcagcggctcggctcaccgatggcggggtgcatgcgagcgggacgctagggttagggggaggggcgcggtgcgcggtggacgcgggtgcggcgggcccacgcgcagcctctcggctcgcggtggaccgcgcgcgcgcgagcgggagtggagggaggcggctgaccggggtcagcccgacccaatccacgccgaggtggcgccaacgtggcgccttcgtggctgccatgcgggccggcgagaggaggaagacgaggccggccggaaaatggacggcgggcggcggccgacttcaccggaagcactacgcggcgattcgatcgagagggagtttaccgtacaagggggagcacggcaggggatgagccaacggctcggattcttcgaaaaggggccggcgacgacgaatcgcggcggcgcacgccggcggcaagaaaagggggaaacggcggaggggcgatgaggattcaattcaaggaggtgggagcatctccggggttcaaggagcccatttccggcgtcggatggggtggaagagcaccgaggagggccagcgacgagcggcggcctccgggagcgggcggcaacggcggcgaggccatgccgggcggcggcggggctaggggcagcgtctacgtgcgttcgagagtctagctgagctaccacgcgagccaaggaggggcgagggcgagcgagaaaaaggaacgggaggaaggcactaccgagccgggcgggcagtgatgggcggtcgacggcgcgtggcgagctctccagccttggacctgggaaggggaagaagaggtgcctggagtcctcgtctcgcgtccccgcacgcaccggtttccctagtgcttcggcgacggacggtgagggcgactgtagggcaggggcggcaacaatggcgcggtggtggcgacgagggaaaacgaatgagggagatggggcgactgctgttttataggcgcggggtggggcatcgaggagaaggaactgacattggggcggtcaaggggagcgagctggcggtcgtgctcggagctagcggccaaacagcagtggaggtgcggtggctgaggttggaaaaagagaaaaagaagggggaaagaggagcttgaccatgccgtttcggggagggagagaagcgggagcgagagctctggctcctggttttggacgggtgcgggtggagcggcttgggcacgcgctgcagagctccatggaacgccatggataggtaggtaggtcaatcgatggacatacatatagttggatttgagaaaccgatagttagttcgagtaggttgatagagcgataggtagataggtcgatggatagatagatagatgggtagatggttagataggttagataagcggatagatcgatcgatggacagggaaggattcaaggacggatttgacattctcggaatccggagaagtattggcaaggaattcaaggacaggattgaattccggtgtttgatttcggaagttgaatcggaattggaatcttcaggtggaggattttgatggcgatgagagggaacaacaggatttgaattgagatccagggcatgacttagactcacactcaaagaacgaaaattttcgcaattaggattttctcaaactagtttttaacgtctcacgaaaagcggagcgttacagatccaccccccttacaagaatcttgaccccaagatttgaaggtggaccacacacacgaaaccaaaaaggggatcttcagacttcatctcagcttcatactctgttggtctttcttcatctcatggttgcacactagccacaaaacgatctggtactctcactcacttaacatgcttcatcttactgtgggtttgtttcttcctgcggattctgttcttcagcttgctcgagattcataacttttccttttgtttccacttgcacatggttcagatgactttgtccaacaggcggtgaggttagcgagacagatccactgtttggtgactttgagctttttggtccgggtacgctagggaggctcgctgttggttgaacttgctttgacttgactttctgagggcagtaccatgaatagtgtcccatctcatggcagatgaaacattcgactcctgccttatgaccacgtcttttcggaggtggagggcatgacacggagttacttccttcaaggcttttactgttgatcactgtggtttgctgactagattctgacattgtcgagcgagacgtagaaccgaaaccattggaatactgaaatactctctgatagtactgtgctggcgagtttgttttttttgacacaaaccttcttttgcttgaatctctaaggatattactttgcgtctcttctattcttgcatctcttattctgcatcttctagtaacaaggacttatcgaccatttgctgaaacatcgagaagtcgtgagccaaaagtttcactcgcagtttcgcatccattccttttaaaaatcttctgatcttctttttatcagtgtctgcatcttctagggcatatcgggccaatctgttgaagcgactcaaatactcgttgataccagaggatccttgcctgatatttgcaaattcttccttcttcaaatcaattatgctttcaaggatgtgtgctgagcgaaagacttatgcaaattctgcccagacgatggtaccagcatctgtatggttagcacaatagttatcccaccaatctgcggtaggtcctctcaactgatgagcagcgtaaagggtcttctcatacggagtacactgtaccagatttaatctcctttccacatctttgatccaatcgtcaccttcaataggctcagttgtttgagagaactccggcggacgtgatgtcaagaaatcattcagttttgatcgcccattatcttgaaccatatggggttgacgctcttgtgtgtgttgttgttgcatagcaattatattctgaatcattccttgtaatatctgagtttgcatggctaggatttggtgaaggtccatgggtgggggttgattacctcttgcattattaactgattcggaagcaaccgtatgatcactctcagcttcttgctcatctgcttggttaactggttgatcgggaatctctgactgaactggctcttcttcaaaaccaaagcgattaggagcacgggtttgacgggtagaacgacgagccatctacttcaaagcgactgagatctgaccgaaccagaaatgggataagaaaaggaggaaaacaaaaacactagatcaaaacgtttttcgaaatcgcagaagacataggtggtgtattccagccggtaacccaactggtctaacacctgaacacgggctaccaaacaaaactcacacacgcactagttcaccacaactcctaccgagcgggtgacggagctagggttgcctaccaacaagggcttaactaagacgcctagaggcttgagcacacctttcttcaactgggcgtgaagacaggtttactctaggataacatgtcaaaacaaacgactagcttctacttttggacacaaaaacatttttcgcaaaactagagctaaaggggacaacgacaccttagctttcacaaatagtttttgtactcaattaatgccatcctattcaggggtttcgatcctagggccaactaatgctctgataccatctctgtcacaccccgatccggcaccgccgtacaacggcacctgacaggagcgtgtcgtaggaaaaacggcgtgaaccgcttcctacgaaaccgcgattacagtaccagtcccaggacatagtgctggtacccacggtgacaaatatgaatcattgcaatccttaaaataaataaatgacttatttaccttaacttaggttgtagctcagaacagcccgagaatgcaaccgacgacgcggacgaggaaaacaccaacagcagcagcagcagcggaaccaacggactaacacccaacaccacaggcgacggctgggaaccaggacgaaaccctaatcttcacttcacatcatcttcacttcacgacggaggaactatatatatatttatatagagaaagggtgagtactttcgtactcagcaagtcacgggaattaggtgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24393 - DNA, 923 bp, Oryza sativa
tagtatacttaccaaatatgctataaacaccttccttattctgactgatgataccaccgtttctttcattagaaatgagatactcattcaacccaaaagagagccacgtttggaatcctgaaaacaaatgaaatatctggtacatgaaaaggaggctgtagcacatttgaaaataaactattcaaatgaatctttagtacctgtaagcacaagcagaccagctaatccacaatacttaggatggatcctgataacggacgtaaggatcgaaattgctgcaagggtgaaaaagaagttccagtgcacgccatattctcctacatgaacctagaaaatgagaaatagaatatgcatctttaggaagacagcagtacatttttgttttgtgcagtacatatacggtatctagaacaagtcaacaagagaaaataatcacatggtaattgaaaatgctggataaggaaagcaaagtttgaggattgtgcataattacgaagtaaatttaatgtcaatgcatatggcaaattgtggcgaaggcataatttaggtaattgacatggttatgaataaaaatacctgataatcaacacctgatgtcgatatgagacgagcaaaaccaagaaatattagagggcttatagacatcagtgctttattccaggtcctaaggacacacatgaagttgcattgtaagacacagcatactagtgactatttgcagacctctcaatcagaatatactcttactatccagagaaaattcaaatattcaaacaatgatgtctgcgaaagtcaaacattaaaatagagtctaaataaggttttagtgattatattagacaaaggtgggatgaattgtcaacatgtcactttctcaggatggtttattatttggagagagaaataaatgggaaggatttaaa

SEQ ID NO: 24394 - DNA, 1055 bp, Oryza sativa
aagaagcatgcagctccaaaccagagaatctacttaaccaaatgtcaagacaaaacatgccaaaccccttacatgcatcaagcatgtataaaaacacataaattacaaaattatttgacacaaccaaatcgtgcatccaactagatcagagcataagaaagtctccatctactaagaaccccccaggcattcggcattgcaatctatagatgttaatctggcacgcaatgcaatgcacacctgcttaatcaaatccaagctagaatcacaaaggtgacgttaaggagcattcagccaaacccacatagtgtctccactccactatgagctgctgcgaatttgttcttcctattctatatagtaagcccacaatcgctcaatgcctcaatccatctgtcataatatctaacaaattatccgaaagaacacttggaacaaggtaagagtttattcttcctaattctggtttagtaagccctcgatcgctcaatgcctcaacccatggatcacaatatttaacaattttttcaaaaaaaaaactaattctgccgtgtagtattgattgatcctaacagattggaacaaagtaagcaaaaagagtttgggggatcccagattggggggagagagagagagagagagaggcactcacatcgacctggcccttcttggcgacgttggtccagtccctggcggagacgccgctgcgccagtcgaactcgaagccgacggtggcggtggggcggtggtcgggcgcccagaagcaggcgaggtagtccccggcctcggacgccgtgaaggcgaagttgcccgactgcacgttctccgagtagtgcaggctgtggccgtggggtgacgtgacccgcaatgagacgcggtgggactccgggagcagcggctgcgccgacgacgacaacaaggaggaggaggaggtggagccgcccccctcgggcaccacgacgtggtacttgcccaccgccatggcgcccaccttgatgtcgtcggagatgcacttggtgtggcccgactgcaggtcgaaccgcagtgcggcggcg

SEQ ID NO: 24395 - DNA, 2971 bp, Oryza sativa
tgctgaaacattatttttatataaagtgaaacaacacccgatttaaacgagtgaaacattttcaatctacttagtaaaacaattccaatatatcatgcaacatttaaaaataattcaataataagctatttttttcgtcggaatatatccatgtgtggtcttgttttgaagatttaattacaacgaaattaatggtgcaatcggatcatgatttggataagtaatttaagagaaaaaacagtttaaagtagtttttgcacataaatcagggactgatgtcagcgcccgatttttctcaaattcgatcgggcgaccaatccgaatgagcgtccagtaaagatatatacgaccatggatcaattacgatgaatagtatgtctttttttgcaatgcagccgtttgtaaccgttaattaaattaagtcgtacggtgagtcagacagctgggttgtatgcatagcaatttccttttatttttatattcctctagttttactttggttctccactttgttagatatgagaggttattgatggattgaaataatctacctacaaagtaagtgtgcctttgtcactgatatgtgagttcatggatcaccaagctcacatgttggtaacaaagtcacatgacttgtagaggagcatcatccgacaccatacgatacgttgatatgggacactacgtttttagaaaacatggatatggtaaaaaaagaaaatcagtattacttcgaattggaaaaactactgctagtagtgcccaaggagggaactggatttctttctacgatcaaagtaaagtccttggcaagctaacatttttcaattacaattggcaagactaaagatgtgttttaagcccgagtaattaaatcccatcgagaaccttgcaaacatcacccgacactcttgctatcaatgttatggaagacagaatatggctatcgggcaaaaaggatatacatctttctcgaatagagcattgatggttaatcgaaaatatacggaatttggcgtgacagattttatttatttgaaactcagacaaaacaattggattatactccacatcttgttttccagagactagacagaatgtttatgttgttcttaggtgaaagccaaatcagcactgctatacatacgatatttttttacgatggcataacgcttctctcctatcgaacattaacggttagaaggtatggatccacatggaaaaagattactctcccatagtgagcccatgtccaaggcccaaactcatcatgtctaggcctgccatctcgtaagcatcctgatacagcgaaccgaagtaattttcttcataaccaatctatatacatcatatctttatcatatctttctggtttcatataattattaacgtttaaattagaacatgttctttaaaatatatctttgactatatttttatataacatttaccataaagacaaatctatatatgttgtaaactaaatatttttttaagttattgatagttaaagttataaatatttaaccttaaccttatctaaaacgtaaagaatcatataatcagaaggagttgttgtacttcggcactcaacatttaatttatcatgtggcgaattgatcaactaagaaaatggcatgttttgcaaagcaaaaatttatattaaaatattataagagggcattttgtatatgtttggcaactgttttttctcttttataccagcattatatggtcttggacattaaataggaaagaaaataaaatggaaagtcatatttacgacataagctaagaggcaaagaaagaagatgagtctagatatgagatatgggcttgagggtccatgagctctacgctcctgacccctgtcgtacattttgttcgtactaagattgtacgtaaaatatcgtattcatagcatttcctgaaccaaattgctcgtgtaccactgccacatgccgttgctctagacctacacttgcattaacattacattcaataagctgattaatcgaagaagacccatcttaaaagaatgcattattctgccttccacgtccttccttcaagtgtagcaaagctgtaaaccaccgatgtcttggctcaaataacaacactcaatggtttaacagtgagtttttttatggcgtctttttatttcctttggtccaatatgatgggcatttgactacaaagttttggcacgggctgaatgttaccattgccaaaatacaggaaatactccgtacaatatagctatggagcattgtatacaagcaatcacatccaatttttacgctatcaatctgtttaacaaaatttaactgtggtaaccaaaaatccaaaccataccatactggaggccttcatttggaaaggagagaaaatgaagccattaggatcaatggaaatttctggagtcctacatttcctttgtcacggacacaatgctacaaattttcagcatacatccacttacggtcagaatactcaccacaaatcgcatggacatctacaagcggcaacctcatgcgggagccaataaccaagcgtagttcagcatcatatgatatcaagccccagcatcctttcacccttgcaatggagattgggctttgttctcattgaatccatacatcccatacccatagtgatctatgtcagcaatagcaaggctcaaaccgtaataaaactactggtataatgcatcccaacggtatgcaaagcaacttctctgttccgactaccaacaggacaacaggcaagcaaaagtacacaacacaacggtggattttcagcatttcaaaaataattctgaacatagccattttgagaggaaaaaacagagacacaaacttaattggaactaaagactagataatgggaactaatgaagaaacttattcgcaattctcagctggaatatcaaagttctccacgtgatgcagaggcaaagggctgcaggaat

SEQ ID NO: 24396 - DNA, 2699 bp, Oryza sativa
agtaagacatgatggcaggctgatcaataatgctctcacagcccccaaatgatggggcatgatagggtatcttaacagaatcaataaatctcctagtagcatcaaagtctccagcaacctgcacagacaaggtattttagaaatttaaatgggtggtgttatatccacaggtgagatgagaattaaagagaagaaagtacctcaaaactaatgacaccaccaaagccggtcatctgactcttggcaatgtgatgttctgggtgacttggcagaccaggatagtagacacgtgcaatctaaggataggaaataagagactcagaaaaaacaacacaacaaaaagaactactcgtagcttcatagcttgtacaacaaatgaaaagtgcagagtttgcaaacctttggatgttcctctaaaaattgggccatccgcattgcagtattattctgacattgtacacggagatgcagtgtcttcatgcctcgaagaatcaagtaggcagcattctggtatcataatggcatgaaaagttaagagacaagagaccagaatattcatcaacagtataacatacagaaatagaatgcaaagacattcacaacttcaattcaaatcgctttcagacattcacagctgcagatcatctattatagtgtgttatctatttctgtacaattgacgattttaattacagaattacctaacaagggctatcactacctctagtcaatgcaaacgagagagatattttaccagcccaaactcaccggatttagaacaccaccaactacatggtgatagatgcggactttggaaactagctcatctctgccactgatgcagcctccaataacctaaaaaacaaaatattcttgtcaaggcaatctatatgtgtaatgagtacaggaagtttggtccaaacacttacatcattgtgcccagcaatgtactttgttgctgaatggataactaagtcagcacctagagttagtgccttctgattgattggggatgcaaaggtactatcaatacaaagcaatgctcccttgctatggcacatttttgagacaagatcaatgtcgatgcatctcagaaatggattagtaggagtctcggtgaagaatagggatacctgagtagaggtcacggataaatttttggttaataaataggcatatgatagcattagaggaaaaggaaatagtacaaagatcacactcacattattattatccagtgcattttggagagcatccatgtcagcaggtctaataacggtcatctggacacaaaattgtgtcataagataagcaacaaattgtaaacatttatgtataaacaaatggaacaaagatcataggcatattccaaacaccgtattctgcagaacataaatatttaatatgcacttccaagatactggaaatttgaaagcaactatgaaatcattatacatttttggcttctacaaattgatggaaagccaatctcaaatagtaactgcagaatcaagtgtgtgcacacgcacgcacgcaaaaagtaccggtataattataaatgcctctatctggctctcacaggaatctgtacagattactaaagtagcaatgattgagtggtggtggacaaaagaatgcgagttatgttggattagtttattatacaacataaaattgaacttagaaagatgacaggtaattgctgtgccaattaacacaggaaatagtagcctccatgtccaaatataatattttaagtagatcataaaatttaaaatttgtaagccttctgctactatagaacaatgacaagtcacatcaactacaagaaaaactccattgaaagttacatatgcattactgcaaacaagaataataagatcagattaccgtaattcccctcttaggtagttcagtctccatgtaaattctcgtcttgcggtaacaatcagtggtggtcacaacgtgcccacctgctggaacaagcgcgctgagcatagccacacttgcatacatcccggatgccacaaagacagtggactcggctttctccagtgcactgaaacatcgaagtagagcaatcaaaatcccatccactaaaaccaacacagcatcaagcattcccacttccaattagcagaaccattcatttcaagaagaaaatattacaccagcaacaaaggggaaacatcacctcatcttcttctccaatgcctcagtggtcgggttaccatacctcccatactcgaagctagcatgcctcccctcctgagagaagaggaaatttttaacatttgcaaaaagggcatctaccaaatcgatttgtaggagtaattgcaaccccccaactatttacgaaagatcgccaatcatttctaaccttgaagtcaatgagctcctgcgagttgttgaaccagtaggccgaggtgttcactactggcgtggtgatcgcgtctgtggcgatccttctgcccagcctctcgccttcgataggtatatcaaaagcacgaaatggatcagaaaaaaaccgaagcagcggggggaaggcgatagatctgagaggggattgatcgtgattacccgcgtggacggcgaggctggcgtctgaaccgagcagggcctgctcggccaatgcggcggcggacggctggccgagcttggcgttggggatggcgccaacctcggccgtggcctccgcc

SEQ ID NO: 24397 - DNA, 1664 bp, Oryza sativa
gggggatccaaggggtgtgggtggcgctcgtgtgacctttcgaaatgcggtgcgggcttatttgtagtggggtgggtgagaggcctccgtggctaggtgcacccgagggggagaacggattttttttttcaactctgagcatgagcaggaccctatcccgtcgaagtcacgtgactttgtcactgacatgtggtgtggccctgatgaagacaccatgcatttgactgcaaaggatctcaagtcatgtcagctacgttcggtgttaaggtaactttgggcctattcggctgccctagctgcggctgcggcgcagccggcacgaacagtttcgcactcactgtacgcagctgcagccgcagcagttggcctaccgaacaggccctttgttacttttagatttcaacgtttaactgcctactactccatataaaaaaagttgattatcatatctaagagcggaaaatagttacatgttccttcgacatcagcggagcgagagaaacactattgtttaccgtgcaggtgtttcctaagcctgctaaacggtgtgttataagttgtttttaaaaattatattgatccatttttcacatttaaaatagttaatactaaattaatcatacgctaatgactaatctcattttgtgtatcttctcttttcctctcctctcaaacacatctatgtttggttactgctataatttgccaaacatttcaggttttttagagcttaggttctgacaatgcatggtttgtaactctgaatatcacatggcttactccttctttttccaaacctagtagtaagaacttgtggacacacctgaccttagctgaacatctgatgtgttggcgattggtgttgcgaaatgtagtattgaacccaatttaagctaaataatacttaagtgggttgttagttgttacttgttagttatacacatctacccatttaaccaaacattgctgaacaattttgagtccattgctggttgccacatttttttgacatggcacaaccttcccacaattcacctaatcttttgcaaaattgtaccttacgataaattattggccatgtcttaatcaaggtttggcaaagacttacatgatagtatttgatagtgagagatttaagaccgaccgagactcaagggagctagatggtagctatacacatccatagattttataaactaagttaggatcaataatatgatgtatgcacacagttacactgtaaagttgcaaccgccgcacatgacatttttttttatagaagggtttttttttaccgctcacatatgtataggcaataaaataattgtgatcttttatgttgtgtgagtttttcttagtttgtgtgtgcttttatttattcaggtgtgagtttttgttgaattggtgttataattggatgtagctatttgagcaaaggccgggattatattccattattaaaaaaatatgtataggcagtaaaatgtgaagttgatgttgaaaatgagaatgataaaatctgaactattggttctaaattctggtcttacatttctttgttagtattgaggtagtcgcaatttggcagtattataaacaaaattagtttattctactttcatatcttattttcagtttatgacgataatctacacatggcacta

SEQ ID NO: 24398 - DNA, 1449 bp, Oryza sativa
gtttagatctagggatgtaaagttttggcgtgacacgtcgggtattatataggatgtcgcatgaggcgttagggcactaataaaaaaaaactaattacagaatccgtcagtaaaccatgaggtgaatttattaagcctaattaatctgtccttagcaaatgtttactgtagcaccacattgtcaaatcatggatcaattaggcttaaaagattcgtctcgtaaattagtcataatatgtataattagttatttttcagactatatttaatacttcatacaggtgttcaaacgttcgatgtgatagggtgtaaaatttttgtgtgggatctaaacagggccatagtcattcaagtgcttgttgttggtgcatatcacacaccattctctagatcactatatattcaaacaacataataaactattatcacgatatactaagtactttttaggcatgttttttctgctgaatggaatgtaaatgatatattaagataacataatgtttaatacaaatatttaagtacaaatgcaacactttagtaattaatcaaataatttatttttgcaagtgtgtactctttctggattttaacgtacaacaccgctaatttttagacatacttttgactattcatcttatttaaaagttgtgtaaatatgaaatatacataaaaatacctctaataaaataaatactaacaaaataaatgataaataataaaataaatactaacaaaataaatgataattatgtgattttgttaaatacatctttaaaaatcaagagcatcatgtattaaaaaccaaaaccgaagacaacatatcgaagttccttgttttagtaaatacattttgtatttttacttgaactatgctattgatttttttctctatcattgacagtgtgcattgtagttttgaggctttttgttttgttcatttgaatagaactaagaatccaacggttcattttgcttgctgcctacatctgatggtggtcgttttgtagcctacgtggctcaatgaggatgagagaaagattaattctttcactactttagatattttccctatagtgcaggaaataccataaataggctaattgtagtcggccacaccaggacttcacaaagcaccaataggggttttcagaagacagaaattggtgttgtaggcttgtagtggcaacagcttaggatgcgttcgttcgttagagctaggaaagttcacctctagcaccgaaaaaagagcagttcattagcatatgattaattaattagtattagtcaaaaaaaaaacttgaaaatgcatcgatatgattttttttaaagcaacttttctatagaatttttttttaaaaaaatataccgtttacctgtttaaaaaacgtgcgcgcggaaaatgaggaagcggagttgggaacactcggtgccgaactcagccttaat

SEQ ID NO: 24399 - DNA, 5579 bp, Oryza sativa
tgcatgcttagatcttatacgggattgactatatatcagtcaactaaaattttaataaccctgtatctaccgtgagccgttggatcgacacctaacaaattcatgatatacatggtttatcttctccaatgagacatgttatattttttttctatcttcttacttcgaatgaacttccatgaaaccatgactcaccggtgtcatctagcctacctcatctccggcggctcacttcacctaatacataggtacctccctccgcctcatggtcactccatttcgctcaacccctgcgactagctaatctaccaaaactatgtactgctgccacctagctgcaccacccgactaccacacatcaccgaccgcccgaaccaccactcccctccccgaccatccctctaagcttcagaacacccctctccccggcccatagccacactcacactaaccctcatcccgaatcctaatctagcgatgccgacatcctctcatcatatactaacgtttacattgtaatgaaagtggaatgatggggacattggtgttgttgttattagtgaaaaaaaagagagataaaagccggaggagagttgaagaaaaggtagaatacaactcacaatgatcggattttagtccaatggtaaatacaaggtgacactgtgaatagtttactgtgatacaaatttataacttattaaaaatgccatgatttatcttccattatagggcaacattttcgagtttttattctaataattctatttcaaatttattctagcgagatggcttattgtaagggtcagcgaattgctcttctatctgttcagtttgctttaggcttgatgatttgatccttaatccttcttccgaggccatttatactcgaagaaataatcatggaatcctttgatatagttttggtcgaggtcgagtaggtcatcaggattttgccaaagttgattttttttaattcagaatcctatcctcgttatacgtatgtgggtgaggatcctctaccataatgccactgccattacggccagtgatgcgtggatcccaccgtcctattgccccacatgtcaatctctacgtacacatattgggtatgatatatgtggactagcacatccatacatctatggaatatctcatactcccttcgtctcataatataagtatttttggagttagaaacgattattaagaaagcatgtagaattaaatgaatgagggttgtgattagataagaagtgaggtagatggaaaaattgaatagcggagggttgtgactagttgtgaagagaatattggtaaataaattgttatattttgaaataaattctaaaagagttgttatattttgggacggagggagtattatacagtacaccgacaaccatttgaagacaaaaaaaaatactggtgtggaaatggtttgaacatatttttttcagacttttttttcccgctggacatagaggagcaagttcgccgcacatatcctaaccagaaagagaaaaaaaaaagatcggacggtcgctccagcagcaagatagattgtgcgtcgacatgcatgattcatggcaatgatagtgaaccccagaatttagtacagccggagatcgatgagctcacaaccttatctcatctaatcatgatttgattttttgattagttagttttagtggccaccgcgtcggctcgcaggacaggacaaggacggacagtgctgagcaaaatggcagctgcctataaaccaactgcggcagattgtttacgacgcattacatttgttagcccatccatttaattatactattattatcgaacgcacacactgcacgcacccatccttttgctgcgatccgccaatggccaccaccaaatttgcaagattctgcagatcttgtcgctaccagggccaggatgtatgtttctttaagaagggtattatttcctcgacatttacatccaactggatatatacaatcatttaaattgagaactttgtttaaccaaatatgaaattcgctcctataaattaggaacctagtcccgcaaacaatctaatctgaaattcactcctatgaagatttaaactcagaatcttatgatgctattcagatcactgcaaccaatagattacatgctctttttgcattgttactgctgctgctgcttattgccaatcattttatttggtggagaagaggaggacggatcggatttctctccttatctccacttgcagtactcaaaagaaagtctgatgaagcgtttgcgagtgtgtgtgtatgtgttggtagtgtttgtctggatcttgagacagaaatgcttttgcatgatcgatatggcgtcggtttcggcagcactgttgaggcacgaacggcttcgtttctccgagaaaagtcgttctggatttcagtgggtactaggctgctttctggcgacgtgatttgtcgtctccaattatccagagagagagagagagagagagagagaaagcaagtagaggtcatgtttgctcttccgaattgttcttgttgctgttccgcggctgcacgagagcttgacgcctcaacgaccaccttgttctcatgatcctcccattcatctttgattttaaaattttaaggagtgactacactacatatgcaggtggttggtagtcagtttttaaaattttgaaaaagttaaaaaaaatccaaagctcttgacttctagttttctgaattgcttgagaaagctagatattttgaaaaaaaaatttgcaggtgcgagaagttagtttagtggttgtgacctaagtagtacctcaagatactgagttcaaatctttatataaaagaattttagattaggttgtttgagggacaaaattcccaatttaaaaagaccgcatacatctgttttgatgcaaaagttgggtaaaaaaataccattctctaaaaagagaagttaaaaccaaagctttcatatccaaattctgcaaatcaagttcaaatagggttcaaagttgcgaaaggacctgtaacctagtggttacaagagtctcagtagcatctgaggtcctaggttcgactccccgtgaaagcggatttttcaagatttaacgacgttgtgctttaataaaaaaaatagggttcaaagttaaatccactaacacttcgggatttgactgaacagatggaccgccggccaaacgaacaaacccaccactcccactgtcccacgcaacgaactgaagctcatgcgatcaaaaattcaaggaataagtccacatagactcccttaaaagtgacccaaatctaatatgtaaccctcaaccgcaaaaccggataggataggatgactcccgaactactgaaatcagtgcaatttgactccctcagtggttttgctgatgtggtgctgacgtggaaatattgacctagttttcgtcacacgtggcgcttacgtggcattacaattaaaaaaatatatgtgggacccatctgtgattcacacaaaaatatattgtggtccccactgacatgtgaggcccacatgtcatcctctctctctctttcttcctcctccctctctcccccttttctctccaccttctctctcgtggagcaatagacgggcaggggtagcgacagcgggcgggagctggagcggcggcggccggcaatgaccggagcggcagcggcggcaggcgggctcgacgaagcgggacttgagcttggtgagcgacgaccggcggtggagtagcgcggcaacgacagcggacgcaatcccgtcgcgccgcggccgcccatgcgacaagaggaacgccgtgccgggggagaaaggggagggaggagaaagagatgcggatgcaggggagtgggtgggtcttcctcgccggccgaccggtcaagggcgtcgagggctccgccttcgtccatggcgcttggattagggcgcggcggactccctcaaatataggtcaagctgcagtttcactaattcacaacttccaccgcctctacctcgccacgagcacgagccaccaccacccctcgccgacatcgcttcgtcctcgtcacaggagccgttggcttcgtcggctgccacgcaactgccgccctgcaaatcacaacactactaaaatctgaactctgaattcctgaatgcccagttgtttggtcttcacaaatgctcctatatatacaagacaattactaccgcaagaacacagaattagatcggttttgcagtagcacacacaatgatccaaggaaaatggattaacatcaatggcagtcgttttcagcacgcggaactcaggaggcagatcggcaaggcgatcgtcgtcgtgagtagtctgaagctctgaaacgaactaatcgacgagcggcacatacaggagaagataatcggtggagagagatctcatgagctgttgctatcgcattcaagcgccatgaccagtacgccgttgctatcggttttggggaggctttgcaacctccggcaacggcgtcgtcggcgtcaacagcggtggcggcgcagtcggaaatcctcctcggggtggcgctcccggacgacatcgccttcctggctggaggtggagcacggcgatgggatcggggcggccaccgcttcagctcccgccggctgccaccactccggcccccgcccgccgccgctccagcctgtgctccccgcagccggccgagagaaaggaagaggggaggaagaagaaagagagagaggatgacatgtggggcccactgacatgtgggccccacaatttttatgtgtgaatgataaacgggtcccacgtatacgtttttaattcaaatgccaccaaagcgccacatcaaccccacagattaggtcaacaatgtcacgtcagcgaaaccaccctccaaaaccaccaagggagtcaaattgtaccggtttcaatagttcgagggtcaggatatccggttttgcagtttaggatcatggattagattcgggtcatttttaagggagtaaaagtggacttgttccaaaattcaaaatggacagttttttttaggaataagttcacttggtgaccctcaaaagtgattgaaatttaatccgtaaccctaaaccataaaaccggatatcttaacccccaaactatggaaatcggtgcaatttgactccctcagcggttttggaggtcggtttcgctgacgtggcggtattgaccgggtcttctttacacgtggtgttgacgtggcatttagctggcatttagaattaaaaaatatgtgtgggacccatttgtcaatgacacagaaaatagattgtgggacccacatgtcccttctctctcccctccctcagttccctctctctcctcgtcgttccctctctctctcccgcagcaggcggagacggaggtgcggcgacctgcgagcggcggcggcacccgggctgagctccaccacggcgaagacggaggagaccacagcggcagcggcgggaggcacacgcggcggggtacagcgagctcggcccagcagtgggaggacgaggggagccggcggcggggtgagcggcggctgagggat

SEQ ID NO: 24400 - DNA, 3870 bp, Oryza sativa
atgacaaatgggtcccacgtataactttttaattgaaatgccacctaagcgccacgtcaacgccacgtgtaaaaaagacccggtcaataccgccacgtcagcgccacatcagcgaaaccgccctctaaaaccgccgagggagtcaaattgtaccgatttccatagtttgggggtcaagatatccggttctgtggtttagggtcccggattagattacaatcacttttgagagtcaccaagtgaacttattccttttttttaagggtgaataactaacatggtcactgaagtttcgctttgggctcagtttagttcttgaggtttcaaatcgtccaaacaagtcctccaaattaatcatttgggttaatatagtcctttgaccaaaaaaaaaaagccatgtgagcatgctaagtcatcctcgcatgcagcggtatgaacaaaatgaccattctacccttatataccatataaaaaagaaagaagataaaagaagataaatgtttcacacgtatatgatcgttttataattatcacttacgattgctgcagcgatcatgtaaattaacaatgttgggactgggctggcctgttattttttctgtttgtctttttttttctatatggtatataagggtagaatagtcattttattcataccgctacatacaaggatgacttgatatgctttcgtggctttttttttctaaggactatattaacccaaataataaatttggaggactttttttggacggtttgaaacatcaacaactaaattgagctcgaagcgaaacttcataggctattcacctttttttttattggaaaatggagtcgtacaacgtatactggtaaaaaaaaagtccaagtatatttggtcccgtcagagccccatcaatcgaaattgttcccaaaataaaacaagatcagcccaacctggtctatccgctcaagatactgagcagattcaatgagatgccaagttggaagggcaggtcaatctagaaatacagatgtggacatactgcgtagttactgatgataccatgttggtgcttagtatgtggtatatcatgtcagcgccaggatctcgaaaggattatgacagttttggaccggaatgacacactttgtcaaattatgagacctgaatagcacaagtttagagaccggccgtgcactttactctataattcaaggaacaagccatacataacaaaaaaaagtgggttcaaaaagttaaaacaaaatgatatatatctcatcaccaaaccaatcttttgaaccatatggtggaagttacgactagaattccatcgatgctatagaacaatcatgacgatagtatgattcatatctggactaaccataggcttcagggcatctaaacgaatttcaatattgtctcctaggtggtttcgattctgctactgtaactcggatctgtctgccatccatgtcctgcacaacaaagaaaataggcttgttttagcacacactaaaagaacaatgatgctgaaagacatatgagaataagaaaccagccagacttagtgaaaactcacagcgccatcaagatttgaaactgcattctcaacctcttcagcggaaccatacgtgacaaaaccaaatccccttgacctgccactctccctgtcatagatgaccttggcttccaagacctccccttccccactgaataggtttgcgagagctgcattgtcaacaccccaagaaaggttacctacatagaccctgttggcctcacccctgggtgctctctgcgatgattgctcccttggtggtggtggccctgagttaaccctcaaagatctcccatcaagtatctgttttaagaatgaaatcagcaaattagttaagcacaattcaatgatgttgtataggatataacacaacatatgtccagcaacatgccagaaaagagtaaattaaagtttgttttctagtcatgaataagctaaaagcaaacaaggattaaaacaagcaagcaggttcatatcgagcaacctcagctacagttatcttgaaagaatgcaagccacagcatgcaaaccaaagagatgaaataggagcgcactttatgcaatatatttttagccagcccatataccaacatggagcaaaaataatgacttagaagtatggaagcatatactcacatagccattgaattgctcgacagctgcctcaacttcttcaacactagacattgtcacaaacccaaacccacgactccttccagtcagcttatcatagatgacctgcaacaatgcagtttagcatgatacaatataggaaaaatcaaccaaagccgagtactactcttaaaattgagcaattaaccagaaaaatgcaatcctaaatctttcgccagtcacagaattaatagcatgagcgccagcacaccaaatttaacaaccttaaataatggcaaccttatcgcatccttaatcatctccaaatacaacctcacaatgagcacccgaaataagtttttttttcttaaaagaacgagaatatgcccacactaccatatgcaacccaattgtatcgcggtttaagctaaattaacaacagaatgaatttgtcgtgaactgtaatatgaagcaactagacacaatcattcatcaccacttcaccagcgaccagcggtccatttctggtttcacaaagacagggacacaccagcgagcgactcgacgaaggtggtgtgataggagtacttagtaaggcgagacgaatggggtggtgacctcgaccatctcgacggagccggcctgctcgaagaggccggcgagctgggcgctgtcgacgctgaagggcaggttgccgacgaagaccctcaggtcgtcggagaactcctcgcccccggagccctcctcctcctcctcctcgtcctcctccgtctcgacctcctccgacacggccacggccaccggcacgaaggggctggtcctcctccgcggccatcccgcgacggcgagggcggggagcagcggcttggagaggaaggagagggaggatgaggcggggttggaggaggtggaggggagggggaggaggtgcggggagagggcggtggagaagagcgtggccgccatgggtgaggaggaaaggggatgggatcgatagggttttggggataaggcggagtgaggagaggagagagcacaaactgggaaagaggcaacagtagaggagaggagacgggttttatattgtttgtttatacttgtagctaatttgcccgtgcatgaccaccaaatcttaaaggataattttggcattcatttcaaagccttaagaatctacaattccggctgtcttttgccatcaatttttagatgcttactaaattagccagaccaagaaacacaaagcttatgttgtttcaggatgaaacaccaacaccaccaacagcgtgaaagcctacacgctagtaagagtggtggtgacggaagattcactggcatcaccactgcccacatttaatgtagtatagatattggcttcgtttttttgacatggatgagcaaaaaatactatctctgtttttttcgttggttaactaccgtcaaacatttggggaataagatagtatttttaatagcaggtatatatcttctacttaattttactattgcttccatcacaaggtaattttatttttcacacattccgcatataccgatacaaatataaatttgtatgggcctaggaatcagtaggtagtagctttgtatgtgtgtgtgtgtatatatatatatatatatatatatatatatatatatatatatatatatatatatatatatatatatatgtggcaacatatcgggctgcaggaat

SEQ ID NO: 24401 - DNA, 3205 bp, Oryza sativa
aaagtgatcaagtcaatcttagcttcaacttgacgttattacttttctgacttgtctccagatatacaaatataagaattgtggagatcagcataatttatcttcagtgtgccaattctgaactaactcagcagaccaagctaatttttttatagatagctcgaactggtgaagttgacttgctttgtacctgtaccttctaggtttctaaactagaagttcctactttcaatagataaagccagcggaataaatatatgttctttatatcatttatataacatgtgatatatctaaaccatgatattcctttttacctacagttcctaacaaacaacaatctctaacctgcctaatattataaccaaagaagagtaagattatctgtcgtaagacatggaatctactttctccgcctatatttggccaacttcagaactgaaagtcactgtgatgaaaaccaaaaccctagatttcttagccatatgagatcatatgtagttaaggacttacattgcagtaaagtttcgtgcttgtctagataccagtgcattagccactacaaaagaccctactccgagatccatctgttggacaatgaggcagataccttagtatcatgtcattgaatggggaagaaaacacagaaactttttaagtttcaaacatgatgggaaacacaaataatccaaatcacaagcatgcagaataggtaacagagtggatgcacaatttgcagccagtgtctacttttgcaaaaacaagttcatgattcattaaaaatgctttgagacagtaaagaactaaaatacaaccaatgaaaaagatgaaagatacaacttacgatgccacaaccatatgtttcagccttggcataacgtctagggaagattttgaagtccactgctaatatgcacaggcatgttactagaaccttcaaaacaccccatcaccattaacttcaatagttctgttggatatatagtactgagaagtaattaaatgagtagtatttttccaattaatcaacttttacgtaccacagatactctgtatgatgatatatctgctcggagcaaaggcagctcatttggtccagctttgagatgagatcgagaccttagaatatagggaatgcattagtttctaatcagcatggattttgttgcataaaggaaatagggtggtcgactagaattgtaatagaaattagagagaatgtggcaagaaaaacaggtgtaagaactcagatatggtacctcttaaacatggtgaggatagatatcagcattacaagagaaagtgcacaagcacaagcccattcagctaaaacctgtaacaaaccaaggaataatcaaaagattgctatttaactttttttctctaagaagtgttaaacctcattataacatttgcaataagcaaataacaatagttggttaaaagtttatgcattgtgttccaatgcttggttctctacatattttatgatttctatagttgaacactgctacaatgtaatctccaagtcctatgaaagaatacttactgtgaaaatcagaagaactggcaatacaatactgaggtaatctatagccagtgtagagaagtaatgcacaaaacctttatgaccaggaagggcatcatcatttttcttcaatgaattcttcctagtattatctaaaacaagacaaaaataagggaagaagcaatcactttccagatctactctgaacagtaaaagaagctcgtgttattgatcaatgatgttaaaattcgaaaatccatgaacataacatccataacatcagatgggggcaccacagcataatcaaaaactggagtagagcatggtaaaatttcacataatcgagttaaatttatcaaaactacatgctgagattacgcaaaaaattcaacctgtcaactttctggttcaatctcgcaatggcatatctgaaccaaatgctaaatgtgcaagaatgcagcatactggtaatcttataccacacttctaaatgatatcaacaactcgctcgtctatttcttgtacaaatcgatcagctaaacaatcgcactaatagatcaaacgggtcaaaaattccacaaaatctgtagcgaactgacctccgcagctccatttcctcagaacgaccacagcctgcacaacccaaaaaaaaaggggtcaaaccacagcaccaactaacctacttcagcgggggtaactaagcaactcaccggaaccacggtggagagcgcggcgatctccagcagggaagaccccgtcaagttgctgacgaacctgcgcgaggcgaagaggacggttcttaggaggcgtaccagcgagaggttttcagggggggtttgggggacattttgggactcactgctccttgaggagcttgtgcgcgttgatgggctcgtcgtccattggtggcgcctgctcgaggggcggtggtcgcctcgcggcggcggcggcggagtggaggagaggggaagcagcgcaactgcgccgggggagagggagagggggggggatctgaactgaactggatcgcgcgcgacggcggaaaagaaggcgagaagccgagaagagaaaccgaaggaggagaaggtgtggcgcacgggccaagccggagcagaaaggaagaaaaatggcactctcaaaatataaaaagtaaattgtactagttgttcgtataagcttgtaatgaggttttatctagatctacaaacttgtagaacgtgcatcgatattcttaaaattagtttattgccatgtgaatgatgatgtgacactttttaatttttttcccttttttttcttctttcttcctctctccgataagcagcgacactgacgaccacgacgggtaatggtgatagcgatggcaggccaaaggaatcattaaaggggccgccaccactggtatcatcgttgcccgctgcctccaatggtggcgccgcttgctggagggaggactaaggagaaaaaagaaggaagagagtagataataaaaagagtaaatttcactttggccatgtatatttatcagattggcgcattggaccagggctaaacgtatgttttcacttaacaccacatttctttaccatactttacaggttggaccagagtttagcatctgggccatcaggacagcttcgggctagtccatgtgaagcgtttgcttgtatggaacct

SEQ ID NO: 24402 - DNA, 2724 bp, Oryza sativa
tattcggtcttggaatgtatcatagagaaaaatcaaaacgatgttaaagtctgcaactcaggtgtgttttggggcttgcgggattttattcctgtgtaccttgtgagtaatcaatttgtgttccttactcctgagttcaattggtataacataactttaaaaagaaagtttggttcttaattaatgccaaatggaatagttgggcccttattgcttcacataatctggaagccaatatttaggtctgatatgatttcaaaatctattgacctaatcatgttagcaaaagtttttcaacttctaagtggatcaggggtcatatgcatgaacagaacaccacggcatcggcgattcggcgtggaagtcgtggcccttggccccaacattggttacgctcctgtacaggatgacgttgggatccaccttgccgatgatcaccagtcgacagaaatgcccttggttaaggggcggaagctgtagcctgtaggcagcagcgctatcgaggagatctcacgccgtcgctgctccccaccaagcgtcgacgcatacacacgcctggactcgccccctccacacaaacaagcgcttcacgtggactgggccgaggaggctttcctggtggcccaagggataagccctggtccaacctacaaagcatggtaaagaaagatgttgtcaagtgaaaatataagtttatccctggtccaatgtgccaatcaggtaaatatatatgacccaaagtaaaatttactctaataaaaatataccatgtaagttcacgtggcatgccacgtatgcaagatcattgtcaaacaagactgtgaatcgaagtgatataataaatcaagtttagagacatcgatacgcgtttgcaaatttgtggacataggtgaaacctctttttcaaatttaaggaaatttaagtactaatcgtgcaatttactcaaatataaatataggtaaattgcacttctgactaaagtttcactttatattattcttatagtattttttttcattttgaactagttattgtttccacatgttaccctttagatagggtggcctatataagtgaattatgtacaataaaggtaattagtctcattgatatgtgggtcaaccagtttaaagtgcaacatttggcaataatacgcccaaagtaaaaaaaaacactttgaggatagattaaagtaaaattttgataaaaatatgtggcccaaaatgtaatttactctataaatatcagttgtgtgttttgtttatagagaaattggcacgtcaaattatttggtttagttcaatgtcaaaatgtaattttggcattgaagtccttcccaattcatggagaaaatattaacaatggccaatttggcaaggctaagaattgcaataaaccaaaacaagtcctaaatttgtgtagctctaaaagtttgggggaatactcgtatttctaactggtttgtaaattaagaatgaaaatcaaatcgaagtaaaagaagtcatttctcaagctggtaaaaaaaatactattttaagaaaaatcaaaccaaaatatatgtgaaatgctcatgctgtggctactcgaaatgaattgtatttcaaaagaaaagttatggaattacaaaatcacctttgaagacaaaacctacaaatggttaaaattatattgacatgaaaagtttaagtacatttgcaaaactaaaaatacttgaccaaaccatcgtaaagctaccaatttaagacgtttattaccaaaatatagttttagcacctactttatcatggatgagactacatatttaaagcagagtatcatgaaattacaatagtagtgaagttatcataaaaccaaaatttgcagtttagatcatgacggtattattatttttgagttataaatattctagttgtgttataaaaaatgttactatagtttttcaacagtttgagcaaagtatcaaacgatcaaactgtcagggttatggataccacatacctaatagtagttgactaaatctagacaggacccaccacataccatgtcttatacggaaacaaccttcgaatataggagaagttccgcataaggaaggatgaatagagttctacatggaaacgacaagaactactcggattgtatccatattagtttctctagttctacttggacaaggggatatctgtgggtataaatacaaggccccctaggaggagaggggacacggaacaatagatcaacatacaagccaacatgcatcaaaacaagacgccggatatcgacttcagagataagcatggctagtcccctacggtgtctacggatactgtcaggagagacatagcactatctttgacctcgctggatgcagattcaaggaggaaggctaccctgttgtcgactacgagtcagcacttcagaccgccaagtcgacaacagttagatagactaccccacatattgtactggtgtgattatggtgaataaagagcaacaccggcttcggcaaacaggatgtagggctattacctgtaagataaggggcccgaacctgtataaaaatccttgtccccgtctcttttacctaagtctcgcatatatcctagtaccaacgatccccatactatgcaaataccggaatcgcgacatcaaacgtcgacacaaacagtttttaaaaaattactctaatagttttgtaaaatttactcaaggggtgcaggaat

SEQ ID NO: 24403 - DNA, 1206 bp, Oryza sativa
aaaaagggatctaataatttgtcaacaaaagtgaaccgaaattgtgtgtgttaataaggttgtccaccgatgttggcagaaataccttacaccacttaaaactccgtataaacccaaaaaaacaaattatcagaatggcagttaaactctggatgtaaaaataaaaaataaattgtcaagaatgggattcgaacccatgccctttcggaccagtacctgaaactggcgccttagaccaactcggccatcttgactcttactagcttgcagaacattgacaatataacacctcaaacatcttaggaggattaccattttccaacgattttcttgcatgcttcacaattaggggaggcatgcataacaagtggatctgagacatatcacgtacatgagcaaagctaggttattccatcatcaaataaatagaataagtaaatggcaaaatgctctacaagtcctgtacatacacacatgctatccttgatctctcctctaaggctcccacccagctcttaaaaaggagaaagaatacaaagaattgaactcgtacactatggtacacataacaaacatctattcctgtcgtatatatatgtgattcctctgcacaaaggtcagcgtcagctgatgcgtgtgattatgtaccggcctttctccaagtcgtatatgatcttcgtcttgggcttcctccatcttgccaagcaaagtgctccacctagaagaaacacccccagcagcacagcaagcaatggtctacttctatgggctgatctaccagttgctgatggctctacaattacgccttttatgtttgagatgaaagcccccagggcccattcaacttgagtgtctccaacctgatttgaatactcaatcctgcggatataagaacatttaaatttaaaagtaggtaagcatataagatcgctgaagagtgaatttcagcggaagattgatgtgccatggtattcttgcctcttgtcatccagtggtacaccaagactgtcgtgcagtagagctacaatatatgcggatgagaagcaataacgtgaaaaatcatcatctgaccgattaggatacattttctaagagtagacaagtccttgttgcaaaattgttctccagcaagcacaaaatcagacagtgatgaagattgcttcagtccaaagaactggcacataattatgtgagtaggtgtcctaa

SEQ ID NO: 24404 - DNA, 2093 bp, Oryza sativa
ctgttagcaactaagtaaccaggtaaataaagccttttagggattaacaaaaaacatggcacattcatttcctaccgttgccttttttcagcagtgccaaagaagaagatctgcacactgtaaagtctccatccccactatcagcaaattgattctctaattttgattttgaagcactgcttggtcttgatattacttctttgatgcgagaatatcctttaggagcacatggatcaacaagtgtaccatttttggagtctgcaaccacatgagtcatgataaggcactgctttgaacttcagtacatgcagccaagttcctctaaaagctaattaacgaaaataaaatagaatttgtgtattcatattggtttcattcagagcataaaatgcataaaagaataacaatacaatgatggatgcaagtacataacagctttgatattcaacccagcactcatcaaacttaaaatgtacaactgttgctttgaactatagtcctgacatatttgtgtcactgtagcacatcagaagtagaatagccatagttagtatactaattattgatgttctattggctaacatcagcacatcatatttgttagctgtgaataatattctgatattctcatttctgggaacttagtgttcccttgtcaacctagctaccattgtaagggatgccaaatgtctattttttttgctatcctttacattgaaagaataagtaaaaagataccttttgaccgcagtatttcacggaaggattcttgtgcagcattctgcaaaagaaattgaatcatatggtcagcatatcgtatcatattacaagattgtccataacataagtggtgggtgattcaatgtatacaaatagctcacttgtccaaagtttagaaagctgttgctatagagagtatatgttgttccaccaaaagtgaaatttcttgacagttccggaggaagtacttcatcagaaacaaatgtcagctgaaacaataagcaataattagattggcagaaaatcattaatataaccaaagcattaagcaccgtgttaacattgatattcaaatgtggagcttggttctagataacaccatctcaggtaagtgagtcttttcagattaaataacttaactttattacttattagtaccatcttattagcatggattttaatttaaagaggattcatggctcaaaatcaaaggaaaggaaaggaatcaaagaatttatctgtctttatcagagaacctgtgctgaggcgcccccaagttcaattattccaatggttttgtgtggatcccctccaagtgtgccaagagcatagtttgccgcaacccaagcatagataccctcatcagagcctataagaaatgaaccagccaaaaaatgagcatccatactgacaatatttcagctaatgatgaaaaaccatctgtatccaccatccaatggattttccctttactgattcactacccaaattactttatacaccgctttccctttcgaatagccggattcagtttcttgatgcctctcactaaaccagaatataaaccgaattgaggccgtatttctcaggagtactacacttcaacccgcaacgatacagcctagagaagaaacaacggtaatatccactacacatttttcagaaaatcattcatttcaggaatcaccaatgtgcaaccatcacaacaacgactgaattgacaaccgcggctgtctcagcatgacaccttagcatttccatggaatatgtcagattcatcaccagattcaaattctaacgtctcacctaaatcgaattcccagtcccccatctataaggcaaccagctatatcacttgagcattacgaactgggaagaaatcgacactacctgggatcacctcggcccaagagtcctcgaaccggaatccggaagccctgagcacgtccctgcaggacgacaggatggcctcctggaggcgcccctcctgcagccgcagcccggcggtggccatgagccgcacttccgccgcggcgcccccgaccttctccctggcgaaatcaatcagcggccgcagcgaatcccccgcccgc

SEQ ID NO: 24405 - DNA, 1455 bp, Oryza sativa
cgtttttatagtacaggctggcacttggacggcgggggtggaggcgccctccaactttacgtaaactttaaaccgaaacgtaattacgtaagcttagagtttttcaatacagaaatgagaaatcagaagtgtttctgaattctgagcgactatgaattcagagtataaataaattactactgaactcaacgttccaatcttttgagttgcaaatttataccactgaattggaaattttggaatatatatattgaagaaagagggcgtctccggggtaataagttacccccaaatgctagtacaactgaactttctatgcaaagaacaaagaatctgttcgtttcagtttaaatctcaacaatctgacagcaatgtgcggatccacaaatggttgatttgatcgcgtggttgtctagagcctgagctccaagtccaattctttcccggcgccgtcgccggcagcagcctcctcgtcgtcgtcgtcgtcgacgaggttcacaaacggaataatactctgagatctactcgccgccgcagtcgtctcgccgtgcagctccatctgcggctgcgctcgacggcggcgataatcctgcagctgcatcctgtatagctcctgcatatatatcattagagcagtgtcaattatattatagagtaaatttcagaaaactgcaatttaaaaaaactattcgtttactgcaattttagcgatatgttttagtttgcttcagcaatagtgtgaaaaattattacaaaactgtaacttttacgttatatactgctacagtatatatgtaacaactgtagcagcaaattaactattatattatattgctactatctagtaactaattaactagcagaatttctcgcgcaattgcacaagtacacatatatatacctgatcagatgaaccctgttgctgtcttaggagaggggacgcgttcacgacgcacttgcctgaagcatcctgattgatctgacgttggaaataagcttggctgctgctgctgctgctgtttgatgcaagtaatagcctgctaataacacaattaaacacgcagaattaagaaaatttagtgattagcagagggtaaaatggaggctaggtcaggacgagtaggaagtaagattttgctctgactttgtcagtatcaaaaggcaaaattaagctaggcacgtgcctggtcaaagcatcattaggagtagtagtgtaatgctgctgcttctgcagtggcgatgagccgtaataatacggagtgaaatggtgatctcttgttcgcgctgctgctccatttccaacctgcacatataaataccaatatcatcgtcagctagggttttgattggatgatgtaagaaaaaattccttgattttcacgtacgtattgttgttgttgttgttgttgttggtggccgtagcgcacgccggccacgtgagacggcagcagcggc

SEQ ID NO: 24406 - DNA, 15498 bp, Oryza sativa
cgagccctcgccgcggctccctcctcatcaccgccgcggccggcgccctctcgccgtagccggacccgcctcctcctccgccgccgccgccgccaccaaccgccttcctcttcttcccggcgatccctccacctccacctccgccgccgccgttctccatggatcgccacatcgatcgatcacacaaaccaaacgccgccgagcacgcgcgcgtcgatcgtcaaccgatcgatcggctacttcactgcgcggttaaaaaagaagagggagagcgatcgatctgctcgatggggaaactaattaaccgagctgtatcgatctcggcattgatcggcaaacatgaatgatcagatacgcgtgtggtgagcttgcatttccgtcattaacttcttgttgtctcctgcgaacgaacgaacgggatcccaaattcggcaggggggggcgccgccatggatactgtcgagatatgcatgcggctatagtaaggaaacaaaatcccgtgtccattatattccggggggcaaattaattctctcgatctctgggttggcaatgcagtttttatgtccgtgagatctttttcacttgggtttgttggcatgtgattatgttcgtgatctctctagctatctgtgtgctagctatagcgaattaagagccgagattcataattaattaatttagctagtagagcatccccataggtttggatgtatttttggagcattgcatgcataggttgtgaatttggtggcggttttgttgtcagatggactcctaaacaggatagagtttaatttatgcgttgtggagattttcagattatagcattaatttgtccccatttatcagttttttttatgaggataacaacgttggctcatgaactgtagaggctgtatttgatttacgttggcatgagtagagagttagcacaatgtaaagaaatgatttttcatacaccctcagttttttggcaaggttaaaaagaaccgtctatactacaatggagcaacttggactaccccccacaggtctttcctatccgtccgatccactcgaattaacgcacgggattaagtcttggattttccgaaggaaacacgcaatcctccttcagtcccacgacccctagcccacgtgctccgcctccgcctcacctctcgatcgataacacgcctgccctccgtgcctccgccttcccttgacctcgaccggtaaccgcactccgcctgcacccagcctatctcgccatcgcgatcacttcgcctgaacaccggtgccatcgactgacccctcgccttctctccaccggcaaccgcgggcgctcccgccggggtcgcctctcctcgccattgccctgcctgaacgctgccgccgactgaccccttgccttttcctaggctggcaaccgcgctcctgccgccgactgacccacgctcatgccttccattggacctgcaccatcgtctgcctttgcacagcctggtaagcattatccctgcaaaaaacaccagcgaattgtatacaggccacttcaattcacttcctttcaggtctttttccatctttcaggtctcttccctacacagatcttaccaacaggttaacactgacatatctccatgtcttctgtcttggatcaagttttctttcagaactttaaagtgcagacccgtcagttattgtatccccaaagatgtttcaaattgatatgaacataatgtgagttcaagtagtgggatgtttatgagcttattaccaaactgcagatgtgccaggagcactgatgatgtaccagaaggggatgatactgctgaacaaggaggcgtatcggatgggctacaggggaggccgtccagcctgaaggacccaattcagactcggcgtccggctagacaggccaaggcgaatcctcgtaattatgggcctgattgggccatgtaagtgtgctgttgaaagctgtgtgaattggcgtgtgtgaggggaaagaacgagtgagtgggtgagattcagacataagcaatgtaatgaactgaattaaaactcagaacgggcaacttggtggcgatggcggcggcggctcaatcctgttggattggagcattgtaatctaaattggttgccctatttcttgtgttcttcctgaattatgttgaggtgttcgagttagaagagttgtttacaagatggcctagtcctgtcattctgcacattagtgtttgtagtctaattttctgaaccaaacaagcatcttacattggctgtgtttgagcatccaaagtctcaagatttgctatattatctcctgattttggcatgtgctatgtgaatttcataatatgatctttaacaatcatattttgcttgtcaaatttgaggatatgtattgatcagtaaaggggatatttgttgcttctgaacctgtacatgcaattgttgtcaatctttgagttatgataatttattaaatatttagtcacgtggatttcacgtgcatgcttactagtatgtaaaatgtagaaaaaataggagggggcccaataaaaaacctacctacatggtttattttcgtagtcccgctccctctccttttctctcctcccatgcgttaattccttttccatcctccctattacttcacctatcctcctttcggcctctcctccctttatctcctctcctcgacggttggtaaccggatccgatagcggcgaaggggtgggatgagtggtggtggaggcgtcagatttgcctcgtgcgggaaggggcgatgccgtgatggttgctagggtgaccacgacgacggtggggaggggcgaaacatcggctaagtgggaccacgacaatgacggtagactcgaggtatgtggatccgtcggtagcaacaggagaagcggatccaccggtgacctctcccttccatcgcttctccccatacttagcgcatggatccgccatcgccgggcatatgggagcagcaatgacgactgtagcagcctcaggagaatggatttgtcgccgccaccgggcatatgggagcagcaacgacgactgtagaagccttaggagaatggatttgtcgccaccgggcggcatgggagcagcaatgatgactgcaacggcctcaagagaacggatctaccgccgccgacctcaatagcagatttactgccaccaggcatgggagtggcaacgacgaccgcaatggcctcgggagtgcggacctaccgccgctggccttgggagtggtggatccgccatgcatgggaggatcgactaacgactacggtagccttaggagtgcggatcgaatgctgcctgcctcaggagcggtgagtggtgactaaagattgtggtgaccttaggggcagcggtgacaacgaccctgggcatgggaacgacgaccgctaccaagctagggtttcaaaaattttctttttggctaaaaattctttttacaggcaagcatcgtgatgtgccacatgcaaaaatcctatttttcacttgcagttgtgttgatcgcctaggaaaacctcaatttttacatacacctagcgcaaggagttgctacttccacctataaagatgcatttcagccattttaaccttagccaaaaaaaatgaacttgacatattttcattcaacttgattgataagatgatttatatgtaagtgaagtagtagaatagatcgaggagtccaaggaagaaacggtacatatcatacatgtcatcgctttataggaaaacagatactttacccagttataaatatttaagcaatgtctgatccatttttttcaaatttttgaccattaattttatatatcagtataagtttataaaatccaataagttcatgatatataatattatttttcaatgcaaatgtaggtatactattttgtttgtgttttacactaagcatttgagaaactatttatcaaaatttattctgattgtcaaatatttatgatagaatagagcaggacaattaaattgcacactttatatcgagctggacatttcctttttgttttctccaaatccctgcatatatatgcagtcgcgcgcatgcatcgatgatttacccagcaaaacacacatatgatacggccgagatcagccagcttaattagttaattattgttggaccattagatttggcgcgctgtaaatttaagggcggagctagaacgaaatagagagtaacacttgcttaatttactttagatcaaatttaagcagatgtggatgtataagtttgtattgagagggtgtatatatggtgaaaataagtaagatatggctacaaaattttgtttgaccggattcgtgggcagcccctcgatcggccctcccatactccactccacctccgccctaagctagctagctctcgccacttggattatttggttaatcctgcataggtttcatttaattttaggctggttcttcaagctcgatcatcatctcgttcaaaattcaggcacacgtatgatgattacatgcatgatgcaaattgcaacttgttcttcttcttcttcttctttcgtcccctgctatcaaatctctgtccgctaaagttgtacacctggattttctaggcatggatgagagctcaactgccaccactaacttgttaggatttgcagcttaaattcgacagcatttaatttatccacgtggcgcatagtaccatagataattacacagcaaatcggtcagccggtgtgcaacactctggtaaatagatataatagattgatcgatctgagaagaaggcaagagaaacaagtaaaactttagttaggttgtttctctgaaatattgtaacgttttccatcgtgacctactaattttggctcatagtactatatactagtactatgcaaatgggggcgatctaaactaatctttccgggtgacaggtgttctctctcaggatgtttctcgcaggaaattttaattcttagctcatcatgcaatgggcaagcttcaatctcatatgacacagccacatatgacatttgactggtgactcaccatctttccagcacattgctctctctctccaaatcaccataccacccgaactgatttattttcctttttattatgatatttgcacctgtgcaatgccaaaaaaaaaagagcatggattccctaaaaaaaaagcatggataaaatattatacataaccaacccacactcacacagttatattaaccatcacatttactatcggatcggctctacaatttcgagggcctaggtaaatttgatagttcgacactataggctcgtaaggcttttctttttaactgtaacataaactacacatgtgtcacaaccgccagatcgaggacaaaccgacggacatgatgcccgagatattcaatggctcaatgcctcaactgaaagatctaaaatactcaacacgcttgacaccctagatcatcaaattaaattgcccttctaaacatggctgtccgcacgccttttttggcacgatatcgatttgatttgagggctgaggttccctttggtttgtgccttaggcgatcccacaaccggccttagcctagagccgcgaccctgctctactcacaactagtaacaattggggaaactctattcatttcttaagggaatatccccttattttttttatgtaacttaaaagtcataaaaaatagaaaaaaatagtaagatagatcaatatgtgatatgtcacttcacaaacatgcacgttcaaattcaacttatacaagaaaaaacaaaataacaaatttgactatgaatagaacgcgtaaccgcagtcaaatttattatttttgtttcgaatcttatatttcaaattttaacatgtatgtttgtggaaaggtatttcatatattgatttatcttcataatttattttcaaatttttgatgattttttaaataacagacacaaaacaagaggatatttcctcgagggataaaaatccatctccaacatattgtgcactaaactattgggaacgcaattttgtgtgtttaatcttatggaaatcgatttgaatccttgaaaggacactcataagtgtataatatactcatagatataatttaaactatagtgctttaattctcaacattttgacaaattaagctgaatatgaatctttccttgtccttacccagaatgcaacaaatcaaatgaatccaccagtccatcaccatatcactattatcatcctctctcgtttttttaggacggtttttgatttaataagcaattaacgaaaatggtaaatatccctaaactattaagcgcaaaatattggcattgagacccaatataatggccccgccgtgtcgctgtcccgtccacgtgccccccgagagctgagcgataaaaatccaactgctcagctcagctcagctcagcctccgttgtacatcactctcctctcctctctctctccagaggccacggcagccgccaccgcccggagaaacaatggaggccggcgaggcagccggcgccgtcctcttcctcctcgccgccgccgtctccctcctcgccgccgtctccaccggcgccctcgacttcacctacctcgtcacaggttccaagattttctttccatttttattttcccatccaagttaattagcttcttgctttcagtgagctgagctcttgtcgtggtacgttcccagtcgtcggcgagggatcgtcgacgtcgccggggagcggcggcggcgcgtggtggcgcgaggcgtgggtgggggcgcggtcgcgcgcggtggcgccggcgctgcaggtcggggtgtgggcgtgcatggtgatgtcggtgatgctggtggtggaggccacctacaactccgccgtcagcgtcgccgccaggctcgtcggctggaggccggagcggtggttcaagtgggagcccctcggcggcggcgccggcgccggcgacgaggagaagggggaggctgctgctgctgcttatcccatggtcatggtccagatacccatgtataatgagctcgaggtaataaccaatcaattcaacaagattcaaattagacacaaatacggccgaattcaaatgttttggattcttgggtgtaggtgtacaagttgtcaatcggagcagtttgtgggctcaagtggccaaaggagaggttgataatccaagttttggatgattccacggacgcatttatcaaggtatctctcctttttcttattgttaggcaagtttctggctgaatgatatgattgagatgtccaaactccgggtttttttttcgtcaggagcttagacctctgaaaatctgtaattagtgtagattatcactttttctgtatgttagcttaacgagttagcattgttcctgtgtgaagactgaagagtaatgagttggattagttgtacataaggatgacattgcttttcactttcatatatcactatcagtataaaaaggagcaaaagcaactaagtttcgtcataggaacctaaccttaagtagttaactgtcttaggtcctaggactgaaagctaagtcatgtgcctggaccatatgaaatgcacgtgattacagtaaaagagcatgtagtctagtggttacagtgacctaagtagcatcctaaagtcctgagtttaaatctccataagagcgaatttcagattgggttattcgaggggctaagttctcaatttgtaaggttgcatatatctggttggatgtagaggccaggtaaaaaaaaaaacccttctctaagaaaaatgaaatgcacgtcattgatcattaccttttaaagaaaaggatgacgacataccctgtagctgtaaaaaacatgatcactgtcataaatggttagtttcatgtaaagaagtattagctgattcaagtatccttgtctagacaataagtacttaatcttaaatagtaatttacttgcatgagacatcctatttgacaaactactatttacatcaattacctttgtggcttactttttgtgtaaaaaggcagttgtagttggataaaaggcagttgcggtcgggatatctcagcatttggcatctggtgaactgaatgatgtcacctttgactggcatgtgtaaatattttcttatccaagctgaaaagttataaattacccaactcaacctctagtcgtccttagtacatctgtacatgtcattttagtgtgcatatatttgcagtccctagcactttgttaacacagaagggcaataaattaatcatctaccttgtgaaaatgtaatgaaaatgaacaagaatttacttaatttgcagaatttggttgagctggaatgtgaggattgggcaagcaaaggtctaaacattaagtatgccaccagaagtggccgcaaagggttcaaagcaggagccttgaagaagggaatggagtgggactatgccaagcaatgcgaatatgttgccatatttgatgctgatttccagccagaaccggatttccttctcagaactgtcccgttcctcatgcacaatcagaatgttgcgcttgtacaagctcggtgggtttttggtaagacctcatcttttgatatgtcattgagactaccttttgcagttcttgctagcgggaagtattcagtatatattggtaaggtgaccaaaattttgcatttgaagtggccttctgttagctcttgattcttgtggtgttacaaaagacaaagatcgaaacaaatggttctgtagataatatcacatcattgaactctgatatagcaattttatttattctgatctgtccaatttttagttgaccgaattttacagtgaatgacagagtaagcctactgacaaggatacagaagacattccttgattaccacttcaaagctgagcaggaggcaggatcggctacatttgctttcttcagtttcaatggtgcacacctcgactgttcatgttttatgtagatcacaaaaggaacatggtgatagtctcctaaacactggtaccttgttagggaccgctggtgtatggcgcacagaagctatcaatgacgcaggaggttggaaggatcgaactacagttgaagacatggacttggctgtccgagcaaccttaaagggatggaaattcatctatttaggggacctcagagtaagaagaccgaatccttaatttgttctgttcaatcactcgacgatagcatctgataaagcaaatacgtcacaggtaaagagtgagcttccatccacttataaagcatactgccgacaacagttccggtggtcttgtggcggtgcaaacttgttccgaaagatgatatgggatgtcttggttgccaaggtaccatttcttctccttttttgatgaaccagaacaagtaaatctgcataaaacataacctgccactgttgctccgtcagaaagtgtcatccttgaagaagatctacatactgtatagcttcttcctggtgaggagagttgttgcccctgctgttgcctttattctctacaatgttatcatccctgtgtcggtcatgatcccagagctcttcctgccaatctggggcgttgcctacattcctacagcactcctgattgtcactgccataagaaatccagagtcagttctctcttacaatctttgttacaattctcaaacagtttgttcatcgctttacccttttggatgaatttgatttgccataactgtcttttcactccagaaatctgcacacagtgccactgtggattttattcgagagcgtcatgtccatgcatcggttgagagctgctgtagctggtctgctgcaactgcaagaattcaaccaatggattgtgacgaagaaagtggggaacaatgccttcgacgagaataatgagactccattgcttcaaaaatccaggaaaaggttaataaacaggtaaaatttatttctccaatttgctactgcaatctttagataagctggtagtggtaggtgctggagttctgcatgcatgcttaacctgacattgtcatttgctgcagagtgaatctacctgagatcggattatcggtgttcctcatcttttgtgcatcctacaaccttgtcttccatggaaagaacagcttctacataaatctctatctccaaggattagccttctttcttctggggctgaattgcgttggcactctacctgatcattgctgcttctgacaaatcaagtcaaatctgctgccgtttcatcaatctgatatgtgattcttttctgtgtttaaatttctccagaaagcatttttaaattgtagagtacgtcacagtttatgttgacctgtagtattttgcatagttacaaaaggtcaaaaatgtcaataacaatccagtatatatcaacaaattcacaggtctgcctttttgctgagtttctgcgcacatggctccaccatgagaaatcttccaagaacaccccaaaattgtcaatcatcaaagagatcttccaagaacattccaaaattgtgaatcatcaaaccccttttgcactgggatgtcaagaacagcaacaaccttcctagtcaaaaaaggacatttctggtgtccaaacaaaccaaattcagcctgaatccaagcaaaatcagcatgcatccaaaattgaagtgatggaccttgtgttgctgcaagaagacgaagtgcacatgtggagcccaaatcccaatcgatcgccaccgctttgtcggagctgcaaaattgtgagacaaaaaagaaaaaaaaggctcacctacctcgaaccctttggcgccatgcgcatcatcaacccaatccaccgatcatcgagaaggcgtcttttcctcctctatatcaaatcgagcgagaacgatagcgagagcgaggcagatggtagcaaaagcatcgcgaagaattattaagaggaaattgaagagatcgggtaatgtcgctcaccaatgctccctcgtcgatggtgtcgatcgtgacgccggtgacggacagggacagcgggcggacggtggcgggcgtgccgccggtgctcgtcggggcgtccgtctcgtcggcgccggagctgcgggggcgggcgtacctggtgcaccacgtcttctacgaggacggcagcgccagcgccgacggtggcggcggcgtggccccggcgtccagggcatcgatcgcggcgctgagggaggtcgaggaggaggatgacgacggcgaggaggcgtccgactgcgcgatctgcctcgacgacggggaggagtccagggagacgtgcgggagcgggaggaggaaggagatgccgtgcgggcaccggttccacggcgagtgcgtggagcggtggctggggatccacggcagctgcccgctgtgccggcacgagatgccgccggcgacggcggcggaggcggaggaggaggaggtggtggtggcgatggtgcatggggagagggtggtgatgagggggaggcgcgtggtgctgagcgtgctggtcatgggccgggcccacgatgacggcgagggcccggagcaacgcggcacggatccgattcctcctcttccgcgtgtgctcatagatgatgtggattaattaataactcctctcaaatttaagaaagggtgatctggattaactaggattttgccgtgctatctatgtatatactcgcatgcaaatgtaagtatgcaatgctttccctttgtttaagtataaagtaaatagaaggaatgtcgaggtgcttctttctttaagggctaatttacagatagcatttttttttcataaactaatcttttgatgaaaggttattagtagtattttcttatctccgtcatggaaaatgaaaatggatgttagtctcttttttttcaaaaaccatctgaataatttttttacctgttttatcatcaaaagaaactgtaatctacaatttcttaacttatacttttacatatttatactatattttttatgaaaaaataaaaaataacagtgtcatatattttggggatggagtattaattattactcactttaaaatgagctttttagaaacattttttaagaaaaaatatactattttaatatagtttgaaaagcgtactaactaaaaatggaagttgcagtgtggatttaggctatgttcttcccaatgagttgagaacccatctcacgcgcacataaaacgaaacgatttattagcacatgattaattaagtattaactttttttgaaaaatagattaatgtgatttttttaaacaactttcctatagaaaatttgtgaaaaaacatatcgttcattgaagttggaggaaaaaacacaaccttagatcacagctaacatatactacgaaatactagtaacatggagtatctggacacattcacgctttccagggccaaatttcagggtttacatcctctaccatagtggcactccaattatagacacttatgtgtaggacaataggagaatgagacccacataccaagtgacttataatgatagtgatattatggtagaggatccccaccctaaatttcgatgtgcttcaatgatgagaaacaaatgtaaaatgggtgtggcacatgaattaagcatccagttagaagagattttggatttacagtcagtaatctctggtgcaaacattgcagcagcacaaaagccatcatcactccatggagccgaaagggctacaatcaaagtacccggggcataaaaaattcaaaatttgacgactcttaaaacgccaagcaaattcatgtcgtctaagattggggttcactaatcgtcacacgtgaccaaaaagaaaagaagaaaaggaaaggaaaggaagatgagaagactacagacggggcaagacacctgacggtgatggaagtaagcagtcgtacatccctttgagccgggacagcagaaccagcttgtcttccatgcccacaccaggctttgccagatcaaacatgtcttctctcaagctgcaatcggaaaacgatttttttggttcacaggcaatcaaacctaggtagccaagggaagtatcaaaaagagctatgagtttgagactcaccttgaccactctcctgtttctctcgcctgcgattcaacagctttgtatagtctatcaagggtgtacagtgttaacccgaacttacagcatgcctcttcctcctgtaaaattaggaaattcagccagacatttattagtacgtattgtaatcctaatatttttcaagtttgtaattcgaaagtcgaaagaaaatgactttctcatcaatacgaaagcacttcaatcttggattttcaagacgaaggtggggatgtccaatcttgaaaatggcagtttcttgttttctcatactaggtgaaggaataaggtttttgcagacaaaatacaataggaaagcgttatatactccctctgttttttcaagttgttgacttatgacatgacatttaaccattcatcctattaaaaaaatttatacaaatgtcatttgttttgctgtgacatgttttatcattaaagaaactttaaatatgacttgtactttagtatatttacactagtttttttaattaataagacaaatgatcaaacgtaattctgaaagtcaacggtgttatttattaaaaaacgaaggtagtatttcttagagaagggaatagccaccaacaggaaaccagatcaagtattttgtccctcatccaaataaatgtcaatgtagtctaatttaagatcaagataaggtcatgtagtctaatttaagataatgataaggttaccattccattagccatgcaattctgaaactccataagccttttctctacatcagcaagaagcagccttcgctgacgccgtgcagtcctacctcttccctcagcaccacggccctatttcatagtgaggacaataattaaccatatctgaacctagtattcctattatctttttcatgcacacttgtccatggtgaaaactgcaaaccactgggatataatatatcaagattatatctcctgctagttgcggatagtgttttcacaatttgtccccttttagaaaatattattacaaatagacctttcatgaaactttgctaaaaatagatcagagccatgacattagttgtttacgtacatgacacggtgtatactaccacatgggatgttttgtagaactctagcatatctagggaccatcctatgtggtagtttacacagccccgaatcctgagatcccatgctacgaatatatagtgcttaatatcacggtgtagtgcagaaagttccatttctgcaaaaatgttttgctagggatcaatttgtattttttttcaaaaagaaagtagtgaaaatcttccctatttgtgctagatgcccctgaataagacagcaatgggtctatatggttatacatacatgtgtagcccatgctcgaactgcaaagagcagcagaagtgaaacaccaaatgcaggtagtgctgcaagaatagcaaagtttatctcatttgccctaaggatctggtccagctccagcattgccctgtgtaaaaacaattcaatcatctcttgcagtttaatattagacataaaaaatttatcatcatgcattttaagcagtattgtcagaatacattagtataacttactccagaagagccagtttatgcttctcaatctgaatttttaggatcagaatgttagaaaaaatgcaggttaacttgaactgagtgcatcctaaatagagatagaaggggaagaacctgaatagacaatgcacatgttaattttccactggaaagacctttaaatggatgcattgcttccttctcatatctgtatcaacatattagagaagtgtcattgttcattgcttgagtcagtaaaatgtaaacagctagtttagttttcattttttaacaaaagaagctccatcaatttagtccattgagtgatcgtcaaaagcatagaaatttaggtatcagataaataaggataaaatgtgaagtgcccattaagttatgtaagcaacataagtgcatacaaagcatgtaatacacaaaaagtctcctgcagaagttcagattctattgacataagccatgcaacaagtcactccaaggagtcatagaagcaactatacaaatgattcttaacttcctgaagcttgtgtctaatattagaatttagaaagttattaattcatcgatcatggcagaaactcaaagatactaaacttaggattgttaacaaaaattcatcatttttaatgcaagatgagacatagattagaattctacaacacgaacttaactgttatgcacatcaagatcaaatcattttaaaatttatttttgactaagaaaatattgattcagcccactttggaactgagtcaaacccatcttgaagttttaactctaaatagtaccattatttcaccaacaggttataaacctttactgaaacaaaagagagaaatccttga

SEQ ID NO: 24407 - DNA, 11259 bp, Oryza sativa
tacggtaataacagaataagttgaaaatatttaaccaaaagaattggtttcatatcaccaaaaccgcaccagctcagagttatgctatagaaatctcaccgttaacttctataccactaaaactttgcattgttcacttctatataacaattataatttgtttttacttttttttaggcaaaagacacgtgtactttcgtatttaccctgtgtgagagtagagaagaaggcagcaagcagtgcacatgccagtcagcgagaggcatggcacgcatgataaaggacacggcccaggtcaagctcaagaaggaagaagcataaaggaactgaaccctcattcactcgctggcaagagacagcaacacggcaacaaggggtaacaatcagcaagctctcattacccacatccatatccttgttgcagcaggagcaggtgaatgtcttgctggtatctccttgctaaagctgaaggaacgcatgcctctgtggtatgtccacattgccagtgtcgaagcaaaattgatgcggagtcctggagatggtggtggatgggcatatacaactaaaacaccacacacagattcatgccgagaccaggcagagatggcgttaggtggtggcaccacgtcaacagaggagggtgaagatcaggtcaggagaaaacgagggtagaaaggaaattgagaagaggaaaaggaaggatttaaggtgataatagcagttaatggagtaacatcgcggtgaaaataaaagttaacagcaatatttcagtggtatgaagttaaacatgtgtaatttcagtgaaaagggaactaacttttgcaaaaaagaaaaagaaaagattcactggacaatgctaaactagtactttgagaatatttggtgtttcaacagattaaccttcttatccacacggttattatgataaaagagttgtcagttagaatcaactaccgttgtgtcttgcattatatctatacttctaccactagtttctagactgaaagcattcacattgcatggacagaaattagttgctaagttgtgtaaacacaaatattttctacaggaagcacaaacaggtacagccatagagggtgatctatagaaatgctccctcaatacgccttcaccaactcggttagcattaatgtggaacccgcaaggctgagaagtaacaatatggcatgtgtcttgttgtaaaaaggagagttgattacctgatcagaaataaaatcatcgaacttctggaggttttggtagatcaatgttatagcatttgctgataacacctctgtccactctgaactctcaacatcaacttctggcaatctttcaaagataagttcaggcgacttcccatcatgtgtgcataatagagtttgtccctgaagaaatgaaactatgtgaaatagctagcatgtcatacttgtaacatccaaaacatgcaaaaagaacattgcatacctcaacagcatttctaaatgatacctccaatttggagaagacagaattcagaacaatgaatagagtatgtagcgatttatctgaactttctgttagtccttttctgcacttatcaacttcaaagtaaacctatagaagaggcaaggtagaattcgaattcatgtatgagaaacagtagccatgttctataagtaaatttatccaaagtattaaaaagaagagcttgaataatttggacaccatagtacaccagttgataggggagctgcttcaaagttgatattgaaactattgtaaagaacaatttattctacttgacatcagcatttgatattgataatcgcatttgattaaacaaacctcagcaagaaaagcagccaagcagtgttgcatacttgtcaggacagcaagttttgttgagaccatatcagaagcagagtgcaaaaggtgcgggactggactcccattgctcttgagtctagtcagtgtttgccatgctgcttcgacaaaggcccttggacctctttcaaagatcataaaatacagtttctgtgaacttgttccctggagaaaatagcataggacaacggaagatgagtaagtagtggacttctctacatattaaaagtgtagaagcacttcaatttttatgaatcaactttatacctctgctttggactgccaaaatattaagctcttctggatatcatgcaaattagacagagtgtgttgcgcaacatcttgtaggatgtcaaaagctttgggcatctgaccggcaatcctgcgaataacatatagtcagaaacatatccaagtaactctgtgcacaccaataatcaatggcatgtgaaaaatcagtaatgcattacatgaaccagccacataacaagatgcatcgaatatagtagaagaaaaactgatgcacattagcacatactgcaagcagtgatcaacatcgaaacacattagtacgagttccacatacaccacctgctaaccgagaattcgccccaatttgttttacctgtcatgtccaccaatccacgaatcacaagtacatggtaatggtactagttactacactactccatgaaaagcctgcgaagcataagaagcataggagccgaggggattcctcaccgggcggagtgggcggcggcaggccgaatggggagcgggagagcggcgcgacgccgtcggcggccgcggccgcggcctacggagaggaggcgggagtagtccgagagcgagggaaggcgggcgaggagggagctccatacgcgagcgggagatgctagagcggcggcggcggaggcggccaggtcggcggcctcagccggatcgccggagctagggctccgcggaggcggcgaagcagccatactccagcgagcgggagatgtgctacggcggcggcggctgcggcggcggccggagacgccgcgacggctcgtgctgtgatgctttggactcgcgtgtgttttgggcttattgagtcgtcagcccattaggcatttttttctcattttcacatattgttcccatctgttccattcaaaaacgatgggtaaattcaatatttctttttgaaaatttttactatcaatataatcgtatttgtaggattttttttatggtttgttcatttcaaatttgaatttctccaaaagttttcgaattcgtgatagtatgcttttgatcgggaagtatatttttctcttcctagcttgtttgtttcattgtagtttcccgtacgatgtcctaccattcaaggctttaagagttttaccgttcccccttttttttttttttgaagtggacgagttttaccgttctgggagttgagagactggttattttacctgtttcgaagctgaagaacgagaatttaaacaaagagagaaaaaattcataatattaagtgccgggtccatgaatcaagtttagactagccatttaagtcacgccttgcgtgaccatgagcagacatctatggttacctttttatatatctcagtatgtacattcaattttattttgatatttttatatagctgataacatcatattgattatttaacactcggtatagtttagtcaaaattatactgtactccagctctgacctaccatatagataaaagtgaaaacaactgaaatatatatgatcattatttgcatacagagccaactttaaatgtttttcattagcagaaattctcacaataaaaacaaacacattcttctacaaatatattggcatttattaaatctgaaaccaattcaaatatagaggggccattacacttttagtttttcttccatccagtcaaaacaggttggatgcaaactttaaagcttctatagattgcaagatcagtaactttgcctcatgaaagtatttcccacaaatcaagacattttaaggccatgcattcacgccacctcactaaattgtaaatccacttgaaacgtcactgtatgctaacaatgatttgatatgaatttaactggagcatgaacagaccatctttatccgtttgtaacagtttaatttccagttgagaactggttgtaatgtattaagaggctcagggaataaagctcttgaccaaacgaaagcataattaagaacacattgaagctttccatctgagatgttcttcctgctgctttctgtttcctgttcaataattaccacggaagtggtgaaagagtagaaaatttcaattatgttaaatagaaaacttcaatcagcaaaactaaaaaggacttgatttatgacacagtcagcaaaaataaatttattgttctatgaaacaacattattcctcaacaactcctatccagtttttaccattcaaaatgtactaatgttcatgattcatatagaggccttagatgcacggcagtaaatcgaacaaaaagtgaaaccacaagtttggaaaggccatttaattcattaatgtcacttcaggtgaaaacgaataatgcaaatcaatattgcagtcattttaattgctgctttaaaacttgtaacatcaagagatacttaataataccatatttgattgctttattatttgcttcataaattcacagaaatcattattgaatcagtgaatacacccttcacagcaaaccagaggctagcttagagtcaaatacatctgatcgttaatagtactttatttacagttaagcaaatcaccttgtagaactatcttttctaggtttccactcctctgcttgctacaacttttgctcgttagacacacatatatagatacacacatctagaaatacaccattcatttatataatgttaggggcaaccttttcttttttttctaaatacatgaatagttagtattacttctttttttttttgggggggggggattattagtattagttatctcccggtgagccactgccgtcggcttgattcagcgagtcggacctcgggcatccggagcaaaatactatttcaatccatttgtaaatcatttttctgctagtttgaaatccattagttatcacacatatctttgatagctattgaaacaattgtgtgtgtaaatatttataattataatgaacctgaactatcaatacatacatttgataggatgcattcttttttatagtgctcttaattgaaatttgcacactcaaaaactgaaattacatgagaggcttaattaagaactccattatagaacttattgatcaccctttagtctaaatttactacttacattattattacaaaacttaattgatatgtactgttatttccaatttagcagttagggcatgcatggattcaacttcttaacgctaggtgaagcccgtggtaggacacatcgtacaggcttcaccaacataaacaccgtgagaagctagaggtttttagatacttacataatggtgcagttcctcggaccttttgtatttcccttggccatcgtcattggaggacgatgagaagaggcgctacaaaggaggtcctggggaaccaaaggcgctcaggtggaaaaatgcgcaagatgaggtggcagcgatccaccagtgcgtcgctgtcgggtcgagccatgcctctcgaatccagattatccccacaattgccgaatccagccctgataggaggtggttgtgttggggatagggatgaggaagaggagggggtggcggcagcggcagcggcggtggcgggatgtcacgcctgtgccacacgcgtgacgagctacaatgccaggatgacgtttacagtaacgtgtcgggtgggtgtgtgcgcatgtgtgttgtgtgattcggccaagcggccaggctggcatgtatgatctttataagtaaggaaccctgtaatgaagagaggtgtgaaatgaagaaaggaaaaacgaatctctcctctcaacaactctgctctgcccctttcttcctcgactctgtctcctcctcctctgttcttcacctctcctgctctagttcttcctttgctatgatctagtagtgttacagtggtatcagattcgggttttctgtggttgatgcgttcaaattctctcgatccgactggtaaaatccctgtgctccggtagacggctaccctcgggtgcggctgctgtaagtccagttcaggtttggttggatttggagcgaacgctcaccacgacgcccatcaagctcagcgctccattacgccaatcgctcgagtcgatggaggggaaattgttggagaagttggagttactcactcagaagatggaggctatggacgacaagatgacgaaacacggagggcggctcgatcacgccgtcgtcaaggtggatctcgctctggaggcggtcgggaagctgcagcaagatcagcttcaggcggcgcagttgcaaaagagtttggcgtcttccaatcaagtgagtattttgggctccccatctgcggtttctcttggcagtgcgggtgtttccccaccaccaccaccaccgccgccgccgccgccgccgccaaggttccatactcatcctgtgtttactcgcaacgaagcggagtctagccagggttttgattagggtgttcgtgctaagagttgcttgcctaagatggattttcctcgttttgatggctctgatgtctgtatttggctagatatgtgcgagacctattttgacatgtaccagattccggctatgtttaaggtttctgcagcagtcttgcatatgtctggaaatgcagcatagtggtaccaatcctttaagttagtagaagagatttgtgactggtctcaattttgttatgcggttgctctcgagtttgaaagtactgcacagtgtgaaaaagttcaggcgctgcaaaccttacggcaaactggttcagttgccgattataagtcccagtttgattcactagtgtaccaggtgcgtgtgtttgatccatctgtgggagggatgatgctgctgtatcgttttattctgggtctaaaggaagaaatccgctcagttctgctggtccagttacctgacactgttcagcaggctgctgcaattgctttagtgcaagaaagtgtgttactagacagtggacagaaacctcttaagaaattgacatacaaaggggttggcactaaagtggatacatctgttcctatctctgagccatcggccattaaacctgaaagagctgaattatggaaagctaaacagttgaaggaatatagaagagcgaatggaatctgttttaaatgtggggataaatattcacctgatcatcagtgtgtgatcactggttaattaaaagctatgcaaatcactgaagttattccagatgatcttttgaatgcagtggttgccgaagaagattctgatgctgaggagcagtatcatatttctttgaatgcattatctggtgcatctcgccataatgctattcgtttgagagcattggttcagaataaagtattgttgatgttggtggattccggcagctctcatagtttcattgatctcaattttgctcagctgttgggtttgtagttgtgccctatttccccttccttggttcaggtagctaatggtgactttctctcttgtcaatatgtggttcataatttcacatggtggatccaaggtcagacattctcttatgatctgaaagtggttcagttggggggccatgatgcaatattggggatggattggttggctcaatggggtgatatgtcttgtaactgggcaactaaaactctgaagttttttaccaagatcagtggattgcactgcaaggtgttcaagagtctgattcccagactgaattatgtgctatttcttaccctcaaatattgaaatggcagaagggttgtgatatttgggatgctgttttgcttgaacctactgacaatgcagattctcagtccatttcagaagtagtagctccattactgtctgagtttgctgatgtttttcaagagcccaagtgtttacctcctcatcgcacttttgattatgctatctccttgtaccctgatgctgctcctgtcaacagtaaaccttacaggtattctcctttacaaaaggatgagattgaacgccaagtcaaggacatgattgattctggtcttattactcccagcatgagcccttttgcctccccagtcttgttggtcaaaaagaaagatgggacatggcgtttttgtgtggattatcgcaaactcaactctgtcactgttaagagtaagtttccaatgccagtggttgatgagttattggatgagttagcgggcacacaatacttctctaaactggacttgagagccggttatcatcaaatccgtatggtggaacaggatgagtttaaaaccgctttcaaaactcatcatgggcagtttcaattcagcgttatgccctttggtttaataaatgctccatctacatttcaatgcctgatgaattcagtatttgcatctcttatttgcaaatgtgtattggttttcatggatgacattttagtgtacaaccctaacttggattctcacctacatcatctgagacaagtgtttatgttgttgcgacagaatcagttatatgccaaaatgtctaagtgctcttttgcttgtgctcaattagagtatttgggccacataatttctgctaaaggtgtcagtactgatcctgccaaaactgcagcgatgttagcttggcctgttccacaaactgcaactgagttgagaggttttctgggcctcacaggttactatcgcaaatttgttccgaattacagcattatagccaaacctttgacagtgttattaaaaaagaaagcattcctctggtcagatgctgctcaacaagcttttcaacagctcaaactagccatgagttctaccccggtgctagcattacctaatttcagtcttccctttgttttggagacagatgcctgtgcttatggagttagtgctgtgctcagccagttgaatcaccctattgcttactatagcaaagctttgggaccagctaatcagaaattttctatctatgaaaaagagtttttggctataatgatggctgttgacaaatggagatgttatttgtagcgctgcccttttactattcgcactgatcacaaaagtctatgtcacttgaatgatcaagttcttggaactgatttgcaatagaaggctatgactaaattgatgggttttcaatatacttttcaatacaaaaaaggagttgacaatatagttgctgatgcgctgtccaggatgcctgttatacctcattgtgctgcactgtcagtggcttctcccctctggctccaggaggtgttaaattcttattcagtggatcctgctgctcaaactttgctgactgaattggctgttcaatctactaatacacaaggtttttctctgcatgatagattgatcagacatcatggccgagtatggattggagctaacattggattacaaacgaaattgattactgcttttcattcttctcctgttgggggtcattctggcactactgctacctatcaaaggatgaagaagttattttcttgggtaggtctgaaatcagatgtggctaactttgttaagcagtgtcagatttgtcagcaggccaagtctgaacactgcaagctccctggcttgttaacaccattaccaattcctaaggaagcctgggtggacatatcaatggattttatcgaaggtcttcccaagtctgatggattcactgtcattcttgtggtagtggatagattcactaagtttgcccattttattcccttgcgtcatccatttactgcttcccaagtggccaatgcagttgacaaaacagttttcaagacacatggcatccctcattctatctcagatcgggataaaattttcaccagccgattttggagtgatttgttcaaagtgtgggacactactctgagtatgagcttcgcttatcatcctcaaacggacggctagaccgagcgtgttaatcaatgtcttgaaatgtacttgcgttgtatgactcaagcaacaccaactaagtggaacaaatggctgcacttggcagagtactggtacaatacctcttttcacactgcattgggttgttctcctcataaagctttgtttggagctgatcctcatgtcagtcaagtgctagtacttctctcctcggtccatcagtcagtggttgatcttgtttctgaacgcaatcagctatctgctttcttacaacaacaactgcaacgggctcagttgcgcatgaagcatcaagcagacaaaggccggtctgaacgatcctttgcagttggggatcatgtgtttctgaagttgcagccatatactcaatcttcggtggtgaatcgtccataccccaaactagctttcaagttctttggcccatttgaaattctggagaaaattggtcagtcggcttatcggttacagttaccagactcaagtttgattcatcccgtctttcatgtctctcagttgaaagcacatgttcctgatcatacaccggtctttacttctcttcctcaccctgtggttttggatgccgctgacgtttggcctgaagaaatactcgatcgtcggcttgtgaaaaagggcaatgcaacacatgttcaggtgttgattaagtggtcttctttaccggcgcatcaggctacctgggaggattatgaagtgctcaagacccgctttccatcagcaccagcttggggacaagctgtttctccggcgggcggtactgtcacgcctgtgccacacgcgtgacgagctacaacgccaggatgacgtttacagtaacgtgtcgggtaggtgtgtgcgcatgtgtgttgtgtgattcggccaagcggccaggatggcatgtatgacctttataagtaaggaaccctgtaatgagagaggtgtgaaatgaagaaaggaaaaacgaatctctcctctcaactctgctctgcccctttcttcctcgactctgtctcctcctcctctgttcttcacctctcctactctagttcttcctctgctatgatctagtagtgttacacggagatgagaggagaggagagggagaggaggaggaggcggaggctgtggggcactggggacgaggaggaggcagcgatggcagtgagggccgggaggagaagacagcggtggcggtggaaggagaagaggcggaggtggcgaagcgacgcgtgcgaggagtcgcagcgatacacaggagagggagggggaaaatgaaaatacacaggcataggaggactagaagctgaga

SEQ ID NO: 24408 - DNA, 1307 bp, Oryza sativa
aagcagtcatacgttcccttcagtcgtgaaagtaccgccagcttgtctgtcatactcatcttaggtttcgccagatccaaaatgtcttctcttaatctgcaacacaaacgattttgtggaaaggtcatccagagtaaccaggaatcaaatggtaaagaatatgagttgatactgaccttgaccactcgcctgtttcttctgcatgtgattcaacagctctgtataatctatcaaggttgtacagtgttaatccgaacttacagcatgcctcttcctcctgtaaaggaagaaattcagaggcatcatttgtaaagggtgcccctcattccaatattattaaatttataatccaaaagttaataataataagagggagcactcatcaaagtggctttgtcatcgatacaaaagaagcattctcagtcaacaaatttaggccgaaaagctctttaaagattgagagaatgaatcctaaagagcaactcatatagatgtagataacattaccattccattaatcatgcaatttttaaactccataagttttctctctgcatcaagaagcagcagccttctttggcgccgtgcaatcctgcctcttccctcggcgccttggtcctaatttataattaagacattagtcaccatatttttttgcttttctacacgcatgtccacatactgcaaagatctgtggcacaaataggttacagggaaacacaacaaggccccacagacctacagatacttctgacagatgatgatatttcaaagagagaatgatagaatcacggaactctattaacatacattcataatccatgcttgcaccacagtgaggagcaaaagcgaaacaccaaatgcaggtaaagctgcaagaatagcgaagtttatcgcatttcctttaagaatctgatccagttccagcattgccctgtgtaagaagaatccaattacatctgttgatgaatattagacaagaaaaatatatctttatgcattttagttattattgtcagacagaaatagtataacttactgcttgatatccactgtgcgcttctgaagctgaatgttcaaagttgaaggtgagaataggaaatatcatgaagtggaatattcgatgcatccaaaatagagtcaagtgaactaacctggataagcatggcatatgctaactctccaccgaaaagattcttaacaggatgggtccattccttctcatatctgcgcaaatacatgcatatagttcaatgcacaaataaacaagataaaggatatgtctactgtcaatttagctttccact

SEQ ID NO: 24409 - DNA, 21222 bp, Oryza sativa
taaaaggtagcagagaaagatcaagatgaagaattactttcttcagcataaggaaaatacagtaaaattcttgagaaaaaaatattacaggtgccttttgaacttgcaacatttggcctaacactgtaacgcataaatgcaaacaagtcaacaccacatcagtttatagttttcaaacagacttacctctccatgaaattctccataagtgcttgatctgatatatcttgtggcagcttctcatttgaagtttgctgacaaaattcaagcatcatcctacaaatccaatatgtaaccagtgggcttaaaaaatgcaaaatataatttatgctcctctaatggactcagaaaaaaatggctgcaaagctgaagttttgcatattcaagaaaattaaagtttgtaattttttgttcaagacaaaagaaattgcaaattttttactgaaaaagttacagcactccaggatgaaaaaacattagtcaaaaccaataatatcaacaaaaaagtagataaacgaagaaaatcttggtgctgggttggggaatctttttgtttaggcgtcaccactcttttgtacagtatttactatgtcatcaatggcttcatcaatcatcacacctgtacaatactttcatattgtttactgtgggttaaaacgggaatggaagtagtgggaagttttcaggacatgtccctagacacctactgcatgactgactagctgtagtgtagctgttgcatggcgagggaagcaaggagtgagagatattttaggattttttttccattgattgattcctcaaagcaggtgcagtttgtctgaccctttatacagagaaaggacctaacatatcttatctcagcatagcagctacttacttggtatcttgaggacgaggacagaatcctaacagtagtaaacaaaagataacaaaaaggaaacagaaattctaagctggtaccactgtgctcttgtgccaccacatctacttcatgtcacacaagacaaatactcatagtgactaccccactatttatgcctaaaataattggaaagcacttcaaaatatggtggtgggtatcccaaatcaaaattacaagcatatctgctgcattattgaaacccccatactggcatactcgacttaaaattcttgaaaccacaggtaaatatcatctaaagtattcatatctgagtaaacagatgaacatgatgaaaatgcaatattagatatgcaatatggtactaatttgtcgagtggcagaaaaaactatgtgatatgattaccattaaatttgcatattagagatgtagtatcagggaataacctgcgcaatacttcttcattcagttggacctcttgtgtatccattacatgtttacctctgtttttgaatgtctcaaaaagctcacctctgatggaaatgatctaatgatcatcaaatgagaataaaacaatcatgatgcaatcacaataacataattgatttccaaattttaagaacaatatcaaaattcagccacaacaaaggtgtggaaaaaaattgcagctatattaaatccaactagaagttccccactaaaacttgacacttgatctcctacactaatgctctctgaagttatatcatgttgcattcaatggttccacaaggaatagtatttagactatttcggtgcagatgttggtgcatattactctactatctgttgatttttatataatattgtgtgcgatttgacttggtgtggtctgccaaaatgaatttatgactgtgaatcttttgcaatatagcgtgtgtaactacaaatcatgatcataagttattgcaaacaaaaattcaaaattaccatttttgtatcacacaactatataatgttgcatcttacattacttatttattggtaaaaaattacaatgtccaaaattttgaaactacgtgtgtgccttataattgtcaacaaagatagtagttagttatatgccttatatacacatgtaaacttaaggatgttcatggtaataagtgcaagtgctgcagtaaacaaacacatgaaattgtttctatactctatcatatatgcttatactataagaaaacagtacggctagtatgcacaaggcagcatgcttttctttccctttatctggttttcctttttgttagacaaatatttgcatgaatagattaacaaaatcttatcctcctgtacctcagagaacatctcatatatgtcaatgtcggaataacgagaaaagactttaactagaatgccttgattcaccctcagttaacttacactagcatcatttaaaaatgcataagataaataatagaaggacataaatagaaagtatcctacaggtttctcaacatgcacatcccaaaatccagctattgactctttggcactttgaacccagttgtcgatgtcagaacttcccatcaagctactgtgtcgcaaaagccacagagaacatgccgagagacccaacgctccacatgtgtagggcaaccagtatatggtcatatgtcttggttttttatgccttgagagctataattgcagaaaatatttgcttcaggcaattaagcaacatataatcatctgataagaaatgtaagatttattgttgtacagtgaacaaacccacttatttctacataactgcaacttacatagtttataaaagtaaaaatatgataaatggagaaatcacaaaaaataaaatactacctggagaatgctatacatttacacatttactctgtattgagatacaagtttggcattgaacacattttcactagttcatccacatgattaattctcacatctcaaatctcatggttttgataatcagcatgttgctccattatatgcatgctaatggggcgcctgttcagaactataggtatgacaataccactcatttatagtctgaaacaatgcatatgcatatagctatataaacattttatacagcaagcacaaacaggtagtgggcctgttcagcaagctggcagcggcggctgcggctgcgcgtgtgcatgtggcactgttggtgccggctgtgccacaactgcagaacaggcagccgaacaggcccaatcatagaacctccaatagtataacattgatccaaccataccccatctacaactcaggtaacattaatagaagtagcaaatgcgagacaagttgctgttgttgaaagagaaagttgcttacctgagagcaaacaaggttatctagcttctggaggttttggtagataaaacatatagcatctgttgaggaggcctctgtccactctgagttatcataatcaatttctggtaatctttcaaagagaagttcagatgggcttccatcgagtgcgaacagtagagtatgcccctgaagaaaatatattacataatgccaaacacaaaagtatattatacatataacatccaaatgcaagaaaagcaaacaatgcatacctcacaaacattttggagtgatacctccaatttggagaagacagtattcaaaacagcaaacagtgtgtgaagcgatttatctgaattttcagttaatccttctttgaatttgtcaacttcgcaataaacctatagaacaagcaaggtatgatttggatttataaatgtggaactgtgtcatgtaaaacaaacaatgttatcaaagagttagaaaattgggtttgaatgatctgactagagtagtacagcaatttttggaagcgagcaactacaaagttagctttgaaagaactgctgacacgagttttattctactagacataagcatttgtaatgataaacatctgactaaacaaacctcagcaagaaaagcagccaagcagtgttgcatgtttgtcaggacagcaagttttgttgagaccatatcagatgcagagtgcaaaatgtactgggttggactctcattgctccttagtctagtcaatgtctgatatgttgctttaacaaaggcccttggtcccctttcaaagatcataaaatacattttctgtgaatttgttccctgaataaatataacagaaccaaaaataggtaaatagcatgaagtataagatgcactcttttaattaattgcagcgtaaaaaaaataaaagatttatgaattaacttgagacctcagctttggactgccaaaagagtaagcttttctgaataccatgcaaactacacagcgtgtgttgtacaatatcttctaggatgccaaaagctttgggcgtctcaccggtagccctgaaagtaacaaatgatttaaaaaacaaacttcatgcaattatgtgtcatcagtcatcacggtcatcgacgacgcaaagaaaataccagaacattaggcattagccacacgcttacacaacattcctatcagatattcgcatttgtaatcggtagattttgcctatattgcacctagtcactaattccaaacgcattgtacgaattcctcacataccaccagctaccaacctaaaaccccaaaatttgcccaaatttactcggtctgtccagtcacgaatgcactagcataacactagcaagcgagagcttgcagcacaagcataagaagcacaggaggcacactaaaatccaagcagtggtttctcaccgggcggaatgggcggcggctgtgcggaaggggagcggaagagcagggcgtcggcggcggcgggggcggcggtccgagagcgaagggaggcgggcgaggagggagccccataggcgtgcgggcactgccagggcggccgcggcggcgtgtctcgcggcctcgatcgggtcgccggagctagggctcggcggaggcggagagatcgccatagcgccgccgccgtgggggcctccggctgcggacttcgaatttcccttttttttttctgactgttcggggaaaactctctgctttaccccctcaacctttcacaaaatcacaaaacacccccttctattaccaaaaaccctactgtctgcgccttcaaatttggagtcctttaccctatgtcattaataaagttgctggttacctgtatgccaaaaaaaagtttagagttacatgtataccatgagcccaactttcgttgacccgtgtgctattttggatggatggagacataacagaggtgttaggggttgttaggggctgtgtaaagacggttttgcccttatgtacaataatgggtttaaaaaattagaaaagtgaaaaataatttaggaaaagcgttaaaaatcagaaaaaatgaaaaataatatttaaaaaaggtaaaaatcagaaaaagtgagaataaattttaaaagtgtttaaaaatccgggaaaaaaggaaaatgtgggaaatattagaaaatggtggaaaaaataaggaaaaattggaaataaattttgtaaaaaggaaaaaacaggtgcatgaccattgcataccgacaaataacgggtaatcaaatattatagtttagtgtgagtgacagaaattcatgtgggcaggtattattgtccaatacataaaaacaagcatatgcccttttttttatttaatgcttcgaatcaagcatacacatagagcttccaaagggcaccaatttccaaaagcaatcgcataattccaaattccgtttctcgcaaaagacgagaactccaaaccatatacagatgcatcttgaaaccccacacgagagagcgagagcgagagatcaagagatagcacgagagcagtagccacagctagcacatcgtgattcgaatctcacgtgaccaccgcaaatatctcactcgctcacctgcggtggcggccatcgacggagggcgcgacggcgctgcaccacccggtgaccgacgacgatgccgccctcccggaccaaccaccacccgccgcgcgtgccgcccacgtgccgcgcgacgagggaggacgcgggaacgcgtgggccctggaggaggagaggaggaggcacgacggcctgggcgcacggcgacggctccggctccagcgaggcgaggcggcgacggctccggcgaggcgaggcggcggcggcgtgcggctagggttagggtgcggcggcttgcagcgcaactgggagagagcatgcactcacgggagatagcaggagaggagaatagagctgaaaatccttaggggcaaattagtcattttcatacatgggtcccacatgtcagagctatggaaccgttaagttctaacagaaggtggacggaatgtcacacgggtcaacgaaagtttttctcatggcatacaggtgactccaaacttttttgtggcacacaggtaagctgcaacttttttaatggcataggggtaaaagacgatttttacaccacctatttttaccatcctttgcaagttgaaccatgtttactgattgggtcacttggtatgcatttactagcggtcggcagtccccttctccaggctccggcgagggatccctcgacggcggttccgcctgcctctctggtacgagtacttccctcccaacctaaaaaagtctcccttcacacgcaactgctatgcagcagcatgatcaaactcaacagtcaacacacaaacgctaccatctaggtccaccggccaccggctgaagacccttgttgcatacggctggaggtcgtcggtgccaaggtggagaaagtctcgtcatccggccatgtcgctagcgtcagggcgaagggcctctgcctggtggacgcccatgccacctcgatcgatggcttcctgaagatggaatcattggggtcgtcggctggctcgttgctatcatgcttgttttgggtttatgaggtacacaggtatgcgtctgctattcgatcatggagcaatccatggaggaaagttgaccctgagatctgggagagtgaaacaaagcaatgtattcagtaattcctaggagatttgggttttgtggggcaatcaatattcctcttatgctcttcaaaaaactagagtaattaatccgtgttcctcgcttggtaatcggaaacatgttgaattttctcatgaaaagagaagatcggatcttgattactgctaaatgtaatagttggccttttttgcttctcatgcatgatctgaatgggatagttctggtatagtcttagatcctgtcaacataatcagatgtgtcgtagtattgttttgagtgcgatagggccgagcatgatcaccacagggtccgtgtcaggcgtccactggacgacgacatgctagccctcactgatgaccaccccgacgcgtcgcgcacgctcctggtatcgcgcaccatcgccaccatgagcaaacaccagctgctcgtgtggattaggccgaagcacaacccatgccataaacctggtccaacctgaaaaagatggtaaaattaggtggtaaatccgattaaaaaataaggataaaatgttgcaaacttctttaactccctgaatatactctatgtttttgtagtgacattatctatcttcgccatttcgatgagatttgatggtaggaacgatacagataacaatctgttcactttagttatttgcggcagcagctgcttagcaccaataatatctatcaacattctagctgtagctgccactgttgctgcaaagaagctgcaactacaacaatctctcctgaacacaccaaacaattgtaattggagtgcgatgagaaaaaagaagagtatcccgggctcataaagctaacggacagggtggaccctgtgatgggtggtgaaaaatagggacgttgatgttgcggcaacaacagtgaagcaattgggttggtagttagtgttgggcgagattagtaataggagtataatgaaatttgaaggatgggagatggaggatagaggatcaaagatcaagctaggtagaggggtagtcaacgagaacaatgggaagggctaggtttaacaagtctaattggaattggaagcatattggcaacacgaagtggtagtattgctcagtagaagaatgttgtaagttttattataacactatatttaaacatgtcttctcgatatgtcttgcgaaatccatatatagtacctaacaagcacagaaaatagcgcaccaccaaaaacatatgagcagtacaccaacaacatgcaactgacacatggatcaattctcctattacatactaccttcatcctacaatatttatcgttctaggttatttagcataaattaaggtttagtaaggaaggaaaaattatagtgcccttatttgtattgtagtgagaaggtggttggggtaaaatggaaagaaatttatatggggtcattgatgagataagtagtactttaataataattattttgaaacaaaatttaaaatccagtaagacaactaatttaagacggggaatatattacattagtgttgtctggattacgtcagtttcacatattacatccatcgcactactaacaacatactattgcaatacagtggaattcctacgtgtcaatcgaacctaatgattgatcgatcgatggagatccacttaataagtggcaaggggtatgcaataagtggcaaggggtatgcgatttcaatctgaagtttaagggatgtctcttcctcgaaatcttgttttttttatccgacctatcaatggacaacatacatcatcgttctaggcgcgctactatacgtacgagtcatctcatcgatcttctcaggtgaactggcgtccggtgaaggtctggccgaacgcccatcccgccggcgcgacgttgtacgacacgacggatcggcggtcgccggtggtcaccgtgaacgacagcgcctgcccgtcgagcagcgcgccgctctgccagttctggccccagttcctcgccatggcctgccaccgcgccttccttcccccgccggccttcaccgccaccgcgtgcacgtcgccggcgccgcccacgttgctcaccagcaccaggttgaagtaggagtgcccgttgatggtgaacctcatccctcccttcctccggcacgccaccctacacacacatttagaccttgtttagtcagcgaaaaattttgttttaacatgtcacatagaatatacggacacacatttgaagtataataacaaaataaattacagattccgctacgaatctgcgagacgaatttattaattaagcctaattaatctatcattagtaaatgtttattatagcaccatattgttaaatcatgacgtaattaggcttaaaaaattcatctcgtcatttacacataattgtttttttctatatttaattttttattttgggagctaaacaagacgggtaaatcaatggcggattaattatcagctagtacgacgagttgatcaatcgatggcggcggcggcggttgctgaccggcggtaggagacggggacgatgccggactggaagcgggcgatgccgaggaaggcgggctgggagaggtcgaagtggtggagcggcggttgcaccagccgccgcggtcgccggggagcgcgtggttggccgggcacaggtcggtggccggcaccacgatggacttgccggccgccggcggcaggcacccccgccggtcgccgccgccgccgccgccgcaccgcagctcgaagcaggcgccgcagctcagcccgtccccgaacatcaccgcgctcagcgccgccgtgtccgtgccgtacccctgcccgtacgtgttcccgtacccgcacgcgccacctgcacacaaccggcggcgccattgccgccacttcgatcaattctgagctgagatagatgtatatgtatcggcgtgcattggttacgtacccatggtgccggaggcgtcggcgccgccgtagaaggtggcgtgggcgtcggtccagcggccggccgccgccgccgaggaggaggacagcgacgacgacagcgagagcaagacgaggagaatcggtagcgacggcggcgccattgtcgtatcgtacgtacgtgcgcaagcgaaagggaaagctgattagttaagcagcttgtccacttcgacacatcgatcgttttgttcgttcgtgtgggggatttatataggcgccatagctggctagctaaaacatagaagaaaacacatatgactacgagcaggttttcaatttcgaaattaggtgttatgccggaggtgaacgaaatattggaaatttcgggaatctctgaccgaaattatttgaaaatttgaccaaatttataaaaaaatgcaaaaaaccaaaaatttcgggcaagatttgagcatgccggcgagggtgaaattaccgaaattttagaaatttcgaatcaaaatttcaaaccgtgcgtatgagtttgtaatttactcattcggcttcatattataagttactttaacttttttttcttagttaaacatttttaagtttgactaaatttgtgaaaaaatatatagtaatattgttaacccaaaataaacatattatcaaaatatatttaatattacaacttacaaaactaatatatttacaggttttcttgttagtatgaacgagctttttgaagatgtcgatgatgaacaagtactccgcccatggaggatggggtgtactaagttgccagttgtctcttcggcaatttgaacatatagatcttgtacaacgaatttggatggagggttgtccaaattagttatactatccctctcggttgtctttttgttttttttaacggagggagtacgtcttttaaagaaatactccctccgtttcataatgtaagactttctagcattgttcatattcatgtaaatgttaatgaatctaaacacacacacacatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtcctatatatatatatatatatatatatatatatatatatatatatatatatatatatatatatatatatatatatgtatatgtatattaacatctatgtaaatatggataatcctataaagacttacgttataaaacgaaggaagtacgtcacatttgttgtccccaagaccgcagaggcccggggacccgtccttgttcctccgacagcacgaatgcatgccttttctctcatacgtaagtgtgtatcgaaaatcgggcaaatttcatccattttgatttcagtgagaacctacacaacattagggcacccgcaatggttatctataggctctctacaagatatctatattagcatatttttctacttggaagagattaaatgaagagagagagcaaagctatctactaacctgaagatagtatatagagaaaaacgaggcaatgtattaaagagctatagatacccatgtagacatactattgagatggtttactattaatctagtctattgctgagatgtacatattttatagagagcatcttacttaccattgcgggtgctcttatatcctatttagtttgaatttgacatccgaaatttccgaacttcattcattgtggtggagcccgaaatttttatacaattgaatcgtcccagaacctcgtcgatctcaccgtcattcagagtttaggcttcaggctgtccatgaacaaggttgttcatgggcatcgatcctgtgacttggggcagaggcaggcttccaaaatcttgtttaaattgtattaaatatactacgtaaattttatagaaaaccaatactttattagttgtgccttaccttacctctagtctttaaaaatttatggcatcgtcactgctctatgactaacaactttcaatatctctactattataaaaattgaagatgtttttgctggtactttaacacgtcatccgtgtatgagtcggtttttaagttcattctcttttggaaaccgtatttgggtcgtgttttaagtttgtccgtttttagaaatacagaaggagtcgtataagaaatcttttcaaaaaaaactcgcatgctaacttgagatgatcggactcctaattgtagctaatgattttctagaaaattatatatccaaacgaattctcatagtgaatttcaccttaactaaaccgtataacaataataagattaaaatagttttcacccgttgcaacgcacgggcattttttctaagtatattaggccctgtttcttttagcttgggattattataatccagattattgggagtaagttgaaagaaacagataacttattaaagtagcttattataatctggagcccagcttattataatatgataagctcattttggtgagctttttccagattattaggtgaaaaattacccaccatgccaccccactccctctttagacttgcaaacccaataatctaggctctaataatctagaaaagaaacaactaaccgcttattctactacagattataacaatctagcttatagtaatctgactcaataatctagattataataatcccaagctaaaagaaacagggctatcggagatataggcccgggggaatgcaaagtgaggggaagtcaccttcccatccagccacgtggctctacagcctggccctccccccgcgtctcgcgagtcgcagaagcagccagggggcctcggggttccacgtcacacccctcgggccctcgcgctgcctcgccccgaggccctcgcccaactgccatgtggcgggggaagcgagcggggaggagacccaggctgaacagccatcagtgcgcgcggcgtcccaactgtccctcaccgcgtttaatgcggtaagggcagacgtgcggtgccgcccgatggacccacgtcaatcgggtgtgaccaatctgtgaccggcctattgccgattggacgggcggtcgtgcccccacgtcgcctctgtatccggcggagtggaggtaggtatgtcctgtcccatcggagcgttatccggagttccctccacgtgaggaggaccgccacaagccttcgctcatttaagagggaatgacagggctgtcccccgtgtcaggcggggggcggcgccgggtcccactcaaggacggactgctgcttagcttccgggcgaaggcacggatcgtggtccgatcaaggtaaggagggttcctctcccgtgagagaagaggtagaagcagcacatgtggtatccccttgaactataaaaggaggaccttccccgccgaaaaagaggacgacactcagtaggcctaaactccaggaagcgaagagcaagaacgttctccggagttgaggaacccttgtaacattcaaccataaatcccacacacaggagtagggtattacgctccatagcggcccgaacctgtataatcttgtcgcccatacgcggttaggaaacacttagggcggatacacgatttcgagaggtgaacccttttcccctggccgaactcataaaaggggatctcacgatctcccgctagagaggatcactcctcgacaagggccttaataaatactccctccgtttcatattattagactttatagcattacacatatttatatagatgttaataaatctaaacatatatatatgtttagattcattaacatatatacgaacgtgagcaatactagaaagtcttataatataaaacggaggaagtagtactctacaacttttctccaaaatgcaaggagttcaaatagtttttgggtgataagaatataaagctaggtagcatgcatattttcatgtggttaattgctacagtacagacactgtacagttctgatctgccgataaaaaggtcagggctggcctgctacgagaattaaatttgaaaacataatgatttgcttttttctcagaaattttgggatgtaattttttagcagaaatatatcatcgatcttgcacaactgttgtgtgaaaatgatgttggcgtgacgacacgcgcggaatggtcttgcataaggaatcagcgagaccgaacgtcttgtccaacggtgccgcttaattagtgagtaattaccctaattaataattaattaatcataattagtaattattaattgattaattaatggctaaaagtcccaccaaccgttgaggctgagttgcttaacgatatgcttgttattctccttttaatcgtaataggaattttaaaaatcaaatataatattttttaaggttttatttatagttttatatatcccatcaaccaatgtcacccaagagcaagttgctcctacccactttattttcatttactactatttgtgttttatactgatagaactttcaacattcaacatttttcattctcattttttatttataaattatattactacttgaacttttatttcatttttccaattttcagaaatcattttagtttctgttctaaattttacctcatattgtacactacatgtattgtttctttaattaattaatggataattagggtacttaatcactaattaacaattttcaatcggcatgtcagtcggtatcgctggctggttcagcgagactgctcggtctcgcggtttggccgcacggtctcgcgtcgccaccgcgcatgtccttgttttcgccgttcggtctcgttgtttcgtcgggcgagactgctcgcgtcgttattttcgtgtaacggttgtgcgagattgacgatatatttctgctaaaaagtttacatcccgaatatttatgagaaaaaagcaagtcaaatgtatcgtttcaaatttaggccgcctgctattcagccttcagttatgtaatcagagatggcttgcaaagccaaaaccacatgcaaaatattaatgcagaaccatgaaatgggtctacattttgcttcaaagtgtgtttcacacctttaattcttatatgaagtagtaaatgactagatgcgacaaccatgttgtgcatttcccttcgagggaccaaatctacagcagaacagcacatccatggccccttttgtagtctgtatccgctcatcagtttcatgtacggtgcatgcttgtggtttgcatgcctgaggctaaattgaatgctacctgcattgcataagccaagcaggaccagcagcaaccatgacatatcccatgatgtcaagatccctagaccatctccaacaagattgcaaagagtggctgcaatctgcatacatgtgggggcactaaatgtgcaggcaagacaagcctttaagcctccacaaccaattggggaactgcctctgtgtgttcttctcaaactacatccccttttctttaccttctccttccaattgcattgtgcatacaagtataaaaccattcttggctcttttgccattgccagtgccagaggtaggtaggtgatgatatggatgctaatagatctctccagcctgcaagttgctcctgtttggttgtaagttgtaaccagtaaccaactagtatttggtacgtacggtggagatgaaaccaacaagatctgtgcgtgagactgaagactgtgtaggcatatttatgaacagagataggccatggatatcagttatggaagtctcccaatttcagatcatgatgtcctgctgcctgttggcatcaaactatgcagatccaggaaagataggaaagaacagcatctcagggctgggtacattgcactgatgcacacagcatcttcagtaaaagagcctctgtgcactgcgagatcttagaattctccacggagattttacgatgctaattatggtggctcagtaattgggacgctgtttcagtgttgacatcttcgctgtcatgtcagaacaaacagaaaactgaggcccatatttttcagacattttttttcttgtcggtagcacactcatatgtcagagaagttcaaccaaacagatttaccgttagaggaaccaaaattacaagctagcctgtaaaaattgccgtatgcagataacaaatctttatcatttccatgtgtcttagatgcatctatcgaagaagtatctttcagtaaagcaattcctttttgttaagaattttctcaatactactataagagtttaggcctcctttgattcatgggaaaaaactggaggaaaaacataggaacaagaataccaggggattggtactattcatccctttgattaataggaactgaacaaaggaaaagcatgtaaaattttcctacgaccatgatttcaagaaaaaatcataggaaaattaacatccaccgtgagctcatttttcttttgctacacgtaggatcaaggcaaagcactattgaaagatatggtttatcctagcaaaatcattcaaactctgattactattaacttattaatacttaactttactatgtttttcctatgcaccaatcaaacgatcatttctatagttttcctatgtttttaatcctctgttttgcatatgattttctttactatttctatgtgtttcttatttctacgttttttcaatcctgtgattttcaaggaaccatcagtagttataaccctagtaattcagcaggtaaacactggacagttaacagtttctagagcacggcacaggtgcaaccgtaggtgaccgacattttcactttattgttactttagatgccaatgcctaaccacctcagctttgagtcctttccagtcctttgaccttttatttcatctaatgtctattaaagaagccggccattgttccaaatcatggtgtgtgttttttcagatttcctttcattgatcacctgtttctttggtacgacgtaagacaagtaggagcgaaatttaaagctctgtttgcgagagccggagattccgagaaaggagagcacattgtattgtacagtaattcgctgcaaaatgttctccgtgagagagcttattcttttcactgatgaaaaatctctctactgacaaaggcatatccaaagtgacaagaaagatttgcttacaacctttcctaggagtagctctcacgctgagattttattgggcttgtccatatcatgactccaaccctggcaatccgagtgcagagaacagagataagaacaagaaacactgcattgtcactaagctctggtcattaactgaatctaagtttggtgacaagtagagcgtccacatcaatttggttgatccatatggttagtgtcacaagattttgtccagtgtaactacgcggcactagtgctaagtagtggcttgctactccatggcagtaggctggttgttgtctcccaatcccaagtgcggtttccaggggatttcacaagaaaaaaaacaaaaataaaataaataaataatgtggtgagtataattcacactttcacagtgaatacataatggagatgtcttgtaaaaccttggctcgtgcattgtcattgctgggtactccgtactgaaaaatcaaagagagatgcgtggacaggttgacaagtgcacagtcacttgagctttttctttgcagcgtggcatatgccatgtgattaattgctcctgacatatacagggcatgttcactttgatgtcaaaaaaaaccttaccaaattttgtcattatattaccaaaattttgctggatttcctatatagttaccaaaatttagcagcaaactaaatgtagccacttttttttggcaactttatcaaaatttggtaaggttaaaaattgcatcaaagtgaacatgcccataatcgttcataatgacatccgatcgaatccaaggaaagtatatattagtaaccggctgactgttgttgctggtactgccaagatcgctgcagcagtgctggcaccacaatggcctcccaaacgcgttgccctgcctcctccaaattgatgtttttactttgagatgtgggccgtaagacaacagacaagaaaattatgcgttgctcagcagaagcaaaggggggcaggacagacgaatgtggcactgcctccatttccaattacatgtcgctaacactattcatgttcaatcttttaccactcttattttaataacaagttattaaatctctactattataaaattaaaaatatttttgccggatagtttggtccgttgccttcgaatcctaatcacttccctcgtcatcgttttttttttctcggcgctcgcatgtgtttccttttttttttctcagcccgtagcgcatcacatcgcctcctccgattcagttctcctttttttccgcgatccagcaatcaagagatgggcttggcaacgtagcgatgagagaggtgcacaatgcgcctgggaaggtcagatggagatggcctgcgcgcgtgtgtgcatctttctatttttggcccagtcaaataattgacccatcctaatggtcaaatataaatatgcatgctctcctattatcaggaaaaagaaataaaaacaaagggaaaagaaaatgggtaactttccgatcgtcaccgcgttttcgtccgtcgattccgcggtaatctttcgttcgtatatacaagctttcatccgtcgattccgcggtaatctttcgttcgtatacgagcacatccgattacgccatggactcgcccccaatcccctagctcatatataaggaaacttaatctttgttcgtttgtcactacctaaaccttaagtcctaccgatcctaaaagtacaataagagattgttacgaggaggcgaatcagatcggtataagagtaagaatatcccccaaattcgaaacccttattttgatttttccgaaaaatacgaaccctaacctaagaaattcccaaaattaagaacagttaaccccgaacaggcaaatcaccagctcaatggaaaaccctaagactcaccgggattagggttagttcgtcggacttcgtggcgcacggcatgagctccgcctgtgtgcgcacctccgaactctcaaccatcttcgtgcgactggtgtacagctacacgcaccgccgtgcatcccttagccgtcatgttgaggaggagaactcgaacttgagcgccgcctcagtttgccgctcgaggtcgaggctcgccttgttgtagtcttgcgccgtgtcgaggaggagaactgaggtgggagagagggatcgacgcatggtatcagctcgcagcacgccgtttaccaccatcgccgccatttcgctcgatgccgacggcctcagctcacatgaaccgtcgccttggccatggcatcccactgcgcgccgccgccctggcctcgccggagccatgctcgacatcaggttcgccacacactggcgcctcaacatcgccgccgctccgtcggcgtcgccgtgaccactacccctcgcctagcaccagaaaatagggccagggagagagggtaatagggttagggtttcggctggtggcaattttatccgggttgatcaatctaaaccgtccgatcagcattagaggacccacgactctcccacactgcatcagccacccatcagagattgtagccatccatcaggatcggacagctcacgctaacgggccgcgcttgggcttcgcgtgcctcatgggccgcacgatcacgtgccagctctagcctccgagccgttgccggtcttcgggccaaattgattttccgttattatcggaccgaattaatgatttcctctttacataagagcattttaatccgtttaagcaattatttgatgacataaagttgcattataaactttcttgtgcaattaagatcatatatgtagctaaatggaaccaacaataaatttggcaacaaaatttaatttatttccattattcatatataatgttaatttagcttcattttggccaaaccattatatgttttttatgacattttgacacttagctttatttatagccccaaagtgagatacaattaaaatcctatgaaattatgcgtgttaattgtcacgttatgttttaatattttattgttccatatatgtctacgatattaaggaatagatttttatttatgtgcacaattaatatattttatttcaatcatgccatttcactctattttggcccaacggtattatggaaatcttacaaccgggctgcggctaaaaagaaaggaaagaatgggctttcgacccaaagccaagtatggattttaattaacttattcaatataatgtatagcggtaccaatgttttaatttatcgctcagctcctaatgattgttgtgccattggagaaaatggctttggcttttgttgtaccactggaacaaacgactttaccgttgcaacgcacgggcattattcctagtacttaaaaaatgagtaaagtgcatgggtgatacttaaacttgtaagggtgtatcatctagattcccaaactctcaaatacaaatccaatttccaaaacttgtcaaaatatctcatctaggtctcatttgccggtcaagatgatgtcacgtcatgttcgtgtggcatgccacatcaacgtcacacgtcacgtaagatcctaaagaggttgtgacgttttaagacctaaatgacactttgacaagttctaaaacttggatctatattttaagagtttaggaacctaaatgacataaccttataagtttaataaccgcttgtgcactttacttgtaaaaaaatagtaccatattaatcaaagtgcgtctgatataaatgtaaccatgtggatttgttcaacttaaaaaaatgattggtgatcaaagttaaagcagtgattttttttgtcacaacagtgacaagtaaaaaacgagggaatactaaattccaagatacagaccaacgagctgacgataaacatattaggaatatacaaagttacctttgggagaaaactatgatgagtttcgatgaaaacccttcattttgtgccgcggggctgcaggaat

SEQ ID NO: 24410 - DNA, 1058 bp, Oryza sativa
tggtaatgtaatgaagtcagatcatgaaaaaatgtctgaatttaaagcacatgaaatcataaacagaacaagcacatgtttgttacgatgtaaaggaaagcatgtttacattggttagttctgcacaacttctgcacattcacttcaattacaaaaataggaaaataatttctgtaaacgaaataacaatatcaagctttgttggaggtgtggtctgctaggtcaaatgttgaaaatgaaagcactaattcaacacaaaacataattattctgtaattctactaagatgatatgttccaaggttcataccagggtactgaatcaaagcttgtgttccaccgttcttctcaaaaatagctattttctggactgtaccaaatgcagagaacacctggaattgattaatcttagtcagcatatagtaactacaaaacaacaaaatctttgaataagtgctttccaatttaacttacagtatggagaacatccaccgtgactgcatattgcatattttcaattgatgcgagaagaacattgccttcagcttccactttccttccatcggcaccaacagcaggctgtgaaggaacatcaaaaggcagtttatatgaaaggcaggttcatataaatggaaaaaaaaagacaattaaattattcaaatgttggtgatatccaatagtagtacctgtaacgtatctattgcagatgaattaaccggaaggtaagggttggtgtaatccctgcaaaataaaaaagaaaacatgtttaacaagatacatagtaagaagcattttgatctataataacacaaggcaaataagataaggaacaaagatggagaagacgaatccactgacaaataaagattttgcagtaatatactcatacaaatatggaagttccatacaaaaagcaagaggctaaaaaaatggaagccaagtgctactatggatgaatatgcccttaacccatgaaaaaagctactttgttttacccaacgattaggttgcaaattcaaatctggaatccagtggttgatagtctattttaccaggttt

SEQ ID NO: 24411 - DNA, 11636 bp, Oryza sativa
  unsure (1)..(11636): unsure at all n locations
aggcaaaaaagatataagtgatacctgctgcgatgtgactggaacttgtattcagatccttatgcgcagagaacgaaatacgcaaacaacaagatgttacatgctctggaagcaagtacctacataaattaaagtctcagaggaattcagtttataggaggagcaaagtgtgaacaatattaaaagatgcaatgtacagagaacaaagatgtcaccttgggatgcttcttccatctaaggcttctcttgctgcagaagctgtggctgcatctgtgtattgaatcagtgcctgcgggggaagaaaataaggtgggaagatcgcctttgtaaacaatcaagtatattaacagaatttgaaatttcaagtaacctgaaaacctgcagccttctcaaaagtggctattttgtgaacaaatccaaaagctgagaaaacctgaaatataatagaagggtcatatataggagtaaaagagaaaattaatccaggaactggcagcacatataaaaatcttgtagttgtagtacataaaatcaattattaaatattctatctggcaggaaactcttaaaggttatccttttgtccaccaaaaagacaaagaggacagaagatcttagacagatgaaccagggacgaatggaactatattgtattgctaatagatggataaaagaaccacaaaatgatcacaaaagaagcaccatagatgtactaattttctaaaggttgggaatttaacctttcatcaataacttggataaacagggaggtgccctacaccgtggaaaagcgtgatgatgaaagataattagaaaatggcatccccaagagttcataaaaacttcagatgtaatagttagaagacagaggcagcaaaacaaacatgatatctctccaattgcagatgttgataacgacattttctccgtgttaacatgggcctgctgattcatgcagaatacgttactacgagatgaagagctatgtaaaatctttgatttacaaggatcaggtcaggtagactcccttggatcccttcagtcaatggcaaccgatatagcaacagtcacacttaaatttttcatgatcttactaattcacccattgaaatactttcatgttggaaaagaaactaaaatttagaactcaccagatggatcacatcgatggtgacatcgtttgcttgaacaccttctatagtaactagcaacacatttccagcagtctctccagggctcttgttgttaactatttcttgtctgtttgaatactgaatgtaaacagttttgcctcggatttgcgctggttccgaagatgatgcaaagtaagaaaccatcgaaatagcttgattaatgtcagtctgcaaagaaggaatggctttgcataagtaatgcgcagcatttattacaaataaaacataagtataaacaataatagaatttgtaggaagataaagtttctgaaagcctttcctagaagtctaaagatacaccacattttattagataatcaatctcacaaatagaatcatactctaaagttactaatgacacagaatacagctttgctgtcatttcaaagctcccagctcccgccaccatatatccaagagccacaaatcacatccctgtaactgtatcctatcacaaaccaaacagtgacatgtggaacttttaaaaccacaaaaccacataggcccagccatccatatagatagcggttaccgagtatgctacagatcgattcctgacagacagattgatacaacatatagcattccagtatcataaactaacctcggtcaactccaatcacaaacccaacaatccacctgaaaacccatccaaaatactaacattgttaaacaactttactactagtatcaaatatccagtcccgcgtgtatcctgcagccgcatcttatcaaatcctttacgatgaccgaagctcatatcaattccatcttcgcgatgtgttggcatagcaaaaaaaaaaaaaaaaaaagctaaaaccaagcagatgtgaggacggcatgtgagccagtgacccccactgtcccctaattacggactgcgctatactatccgagacaaaatcccctaattacaggactgcgctatacctatacggccgaatcgatagatcgtggattgaacatggcagatcatccggtggccgattcatccgaacggatctcgaatgagatcgagcgacgagaggggggagatggaggcgggccaggcgggtggggaaggggagggagaacggggggagggcttacgaactcgacgaaggcctggttgcggttggcgccgacgccgcacttggtgttgacgatgcggccgaaggggttgcagagctcgacgagctcctcctccgcgcactcccacggcaggttccgcaggtgcagcaccttggacggcgtctgcgtgtaccggaactgctgcccgccgccgccgccgaccgacgacgacatctcgccgggaggggaggagaggggaagggatctcgcgcgtgtggaggccggagggagcagcaaaaggctagggttcgagttcgaggagaccagcgtgtggctgcctaaaggttgtgcctgtgcgcagcatagatctctctacaaactgacccttccagaaaactttttgcaacgaccgtgctaaaaacttatttgcataaataaatcgtcagctcaacgctattaagattagtggtgatatataatgctttagtgtcaagaatattgacactcacatcctattcgagaagacaaaaatttaactagtcatatagaattagcttcatggtgtttggtactaagttataagaaaatatataaatgcatgcttgtatatgtaatgcacatgtgagttgctactggatctggtgctcggtactaagttataagaaaatatataaatacatgcttgtatatgtaatacacacgtgagttgctactgggtctggtgctctcatcctgaagaccctggtttgagtccttccttctactccttttaaggatctttaccttttttaccaattctacacttgttaattatttttcgtattttattgggaaatgacacattttgtttaaataaatcatacacgaagaaaataatgaaatattttaggaattttaaaactaagaattatgtagaataagtgttttaattaaagtattaattatgaagtcaataattttaataaaaacattttcaccaaaatatatatcacaatttcttagtttagccaataatataaggattttaggaatttaaaagaaataaaaagctcccgaggacaccagcatttgctttagttcgagcttagtgttctcttaagaattatatatatttagtgttttagttaaagattaactataaaatagatattgtcgatgggtgataccgcgactacggtattttgcatagtatggggatcgttggtaccaaggtatatgcgagattgaagtaaaagatatggagacaagaaattttatacaggctcaggccccttatctgacaggtaatagccctactcatgttgggcgaagccgatgttgctcttattcattataattagaccagtacaatatttgggatatacctatctagccgttatcgacttggcgcccgaaaataccatcacgtagccaacaacggggtagtcttcctcctcgaattcgcactcgacgagatcagagatagcgctagatctctcttattggcctccgcatacatcatattgggtttgtctaggcttatctctgatgtcgatatctagcggcttgtcttggcgtgtgttgatctgttgttgtgtcgtgtattgatctttttttccctcctcctatgggatatatttataccataggtgtcccattgtccatgtaaaactagagagatcaatatggatacaatccaagtagtccttatagtttacatatagaactctattcgtcattccttatccggaattccttctatatacgaggtatgattccgtataacacttggtacatggtgtgccctaccgagcttagtcaaccactttttggtatgtggtatccataatatatttgtattttaaattttatattaaaaaataatttcaccaaaaaatatgtcactatttcttaatttcgccaaagaaaataaggggtagaaagaaattccttcaaatgggaggcatccctagtatttgaaccagggtttcaagcttgacagacatagcctcatacctactatttttatatataatctggtaaattcttgccgcttccgatggaatattcaatatctttagcgttaatgtgatatttatatataacctggcaaattcatgtcatcttcgatgaaacgccaacgtcaaagatgttaaaaaggatatactccctccgctcctaaatatttgacaccgctgactttttaaaacatgttttaccgttcgtcttattaaaaaaacaagtaattattaattcttttcatatcatttgatttattgttaaatatatttttatgtatacatatagttttacatatttcacaaaagttttaaacaagacaaacggtcaaacatgttaaaaaaaaaatcaacggcgtcattgttaacctcgatggctctaagcgcatgattagtttttagcacgatttattttttagataagttttctgaaagggttaatttgtcaaattttcgggctttagtgaaaagcttgagataaaaggcggtgtacacgggtgtctcccccttggccgcttccctaggcttggcgtaaaagaaaatctccccgtctcgtcgtctcctccgctccttgcgccatctcgcggctgaacaggggaggggcggcgatctccatccggcgagcggagcaggggaggggaggggatcttggtgagcatccatctgcattctctttctgattcatctatctctctcttccaccgggattgcacctccgtggaatttgcttgcgttaaccctagcttctcttatagatctggaagaggttcttctatttgatttcagagccttaaccttaatacaagtaacagtttgtttgttccccccaatagtttgggggttcaactgaacccccacgtcccaagttggatccgcccctgattcgcgtggttggagtgttttggttagaattttttttttgtcgggatatctttgttagttcttcaacttaataataattgaactgtaaaaaaagagtcggagaggttatcatgaatagaccaaacaatttttattttttctcgttagatcttttatagtaatctagttggtaggatcgaaagatgacttttgttcattgtggtatgggattgatttgttcatgtggattcgtttaacgcttggccatgataaacatgccatcatgcagccatacaagtgtaaggattattaatatgtgctgtcattacgaatttgacagggtgattcgtgtgattatagttgattttatttggtaaatgagaatttcaggagggtttgatgtgaataatcttagaatagcttccttcttgcgcgttattttagtttccatttatttgacccaatattctctactgtgttgaccgttctttctccgattgtagacaatggttggacctgggcataggaacagtcacgggaagcgtcactctgattatgctgaaaatggaggtggcaagagaaggaatcctggtgatgatacatatgctcctggtccagatgatactgtctaccgctatctttgcccttctagaaaaatagggagcatcattgggaggggtggagaaattgctaagcagatgagggccgacactcaagctaagataaggattggtgagagtgtatctggttgtgatgagagagttatcacaatatttagctcaagcagggaaactaataccctagtagatgctgaagataaggtttgccctgcccaagacgctctctttagagttcatgaaaagctatccatagatgatgatattgggaatgaagaaagtgatgaaggtttagctcaagttaccgttcggttgcttgtgccatcagaccagattggatgcattattggaaaaggtgggcatattatacagggaatccgcagtgacactggtgctcatatacgtgttcttagcaatgaaaatctccctgcgtgtgccatcagtggtgatgaacttcttcaggtttgtggaggatctctgtttccatctttttcccgcgttacacatgtcgtacatgcgttactactataggcatttatggctctgtttggtaacatgggttatttgtgacacgtccgcaacattctcttttacggagtaccctttttaaggtgcagtgacttagatttaatagtagctgttttcactttccagtcaaccagcaaaataacttttactagtttaatttatcatttacagtacttgattttttttgctatgccatctgtggaatagtcaataatgctaatgaaccctttattcttttggcactagatatctggggactcaacagttgtcagaaaagctcttcttcaagtgtcatctcgtctccatgacaacccatctaggtcacagcatcttcttgcatccagcatgacacagccttatccagtgggctcccaccttggtagttcctcaactgcaccagttgtggggattacgcctttaattagttcttatggaggatacaaaggtgatgtggctggagattggccttctatatatcacccacggagggaggagagctctgcaaaggaatttagcttgcgccttctttgtgctgcatcaaatgtgggaggtgtaattggaaagggtggtggaattatcaaacagattaggcaggagtctggagcctttatcaaagttgatagttcaaatactgaagatgactgcataattactgtttctgcaaaggaggtgcttttctcctacggtcctctgctgatttagcatccatgcggatatttaattctagtcctgatcaattccgctttctctttctcatgcagttctttgaagatcctgtctccccaacaataaatgctgcagttcatttacaaccaagatgcagtgagaaaactgatccggaatcagcgatcccgtcttacacaacacgcttgttggtgtcgacatcacgtattgggtgcttgattggaaaaggtggttcaatcattactgagataaggagaacatcaagagcaaacatacgtatcctttctaaggagaatgtaccaaaagtagcagcagaagacgaagagatggttcaggtacaatttaaacttatgttttaatttttttttactggtcttttgtactgcgatgagttcaccaatgtaatttgcttgcacaacagatcagtggagaccttgatgttgtaagacatgctcttctgcaaataactactaggctgaaagccaatttctttgaaagagaaggtgctttatcaggtttcccacctgtaatcccttaccatcctcttccagttggtgtttctgaagggccaaagtatctaggcagagatactaagcctcttgggcatgattatccatattcaagtggatatcgtggctcagatgatattggccctattgacagctatgcaagttatggcagctcccaggtatagcttccctttcacttcccttcctttcctcttcatgctaacagactcttatcaaaacttcgactggaatttctccaggtctctggaggaggttatggggcttatggtggatatagtggtcgttctggcagcagtgggtaagcatacctgtactttatgagtcagcagtatagacagtacctgtcataataccaaatatttatgtttctctatgtatggaaattcactcttaagtgtgcactaattttttttaggcctagtctacttaatatttcattaatctttatatcatatgttttgctcacttagcacatttcatttttcatcaggttatctggccctagttcattttcctatggaaagcgacatggttattaggacttagattgacaaatgcaacaggtatggttcatccaccttgtcttgaaatgaacagaatgatcatgcgatcaagacttgctccttattgcatttctgccttttaaacacatttaacccagctcagctatcttctgatggacctgttcttttcacctttgccccatgcccacctcccttactaaaaacagccaagacaaaagaatgccaagaccaatgaagtatggagcctgcttattggagccccttcccaaaccagatgaccaagagtatggccccaacctggaagctttgcctaagagggacctgcctggatgccatagaccatcttatttccctagtatacagcatttacttatattttcctctgggactatgttgattccccgtcttacatgttctaaacctatgtattgaaagttcacagttgagacttcctgtatgtgttctcgtgcaacctgcttcatcttagtagttcgtgtggaagaacttggttccctgtttgccaaccaaaagcctagaagttacttgcccttgctttaaggatgtggatcgtgtcatccttcacattcgttcctatctgcacatagttccccagagaaaattgtacctcctcagtgagctcaaaataggctaacataaaacttaagtttacctataaaccaatctcagcatggtcttctagtatcaacctgtctggtaagctatatgactactatggcgatttacagttagctggaagttttcgcttttgctgatttatagatcataaaagccctaacatgcaattgtgcaagccatgctatacatgggatcttgacttgatgtgcacgtgtgctctgatgctcaatctgagtgtgggtaagtttcagagaacctctcaaagttaataactgggttgagattttatcgagttaagagtttcctttgtgttttggagtcttttcctcttctttacccttctcatggaggtgcaggagcatacgccgtgtgctgctactgcagacttgtccactgctatatggaaccactgctggagttgcagaacgttggtgccatgccatgcagggcatttgttagtgtattgctgtagactatgatacattttcgatgtaggcggtaacatggcaaacagtattgtgctgctttcagtatatttcttttttttggccaaatttgtttatgcatgtaaaagcaattctctcaacattgtatttgaacagtntggtcgaattagccgatcattcttatgtactgattgatgtccactgttgttggtgatggactactgagcactttgtagtacgtgattttcatagaccggtgctgttgtgattttcctagacaaatgtagtgttgtggcaattgtatttaaatgaataaagggaactaccaatattagtaggataaagttcaaatgcacagcaaggcctattagctcagctggttagagcgtcgtgctaataacgcgaaggtcgcaggttcgagacctgcatgggccacttttttttgccactttttttcccttccatgttccatctccattttgccacttttttctctcgctgtgcgcgctgtgcatatttcggtggggaaaatagattcatcggcagctgccatatattatacctagcgaaaccccgtgaattgctacggaaatttagtatgataacaataaaaaaaataacgtgtaagatagctagataatatcagattaagtaaaataatgtggtttatgataatttaaatttaaatagtatgtagaatggtgattcaaacgtaaaaagtaaggtggtatgactttatggaagaagaaaagtagggagatagtttggaccgtagattaattatctaaaggcggaaaataattgatgtgatatgacttaattagaggaaaaaatgagaaagataatttggaccatagattaatcatttaagcaccaactaagtgaggataaactatataagtatataggatatcataaaacataataaagatatacattgaaacattatgtgaattatattggatgataatttaacatgtttgtatttgaaaagctcttaaattataaaaactataaagatataacatgtttgcatgatgtttaaatgtgatgattgttagtggatgatgatgtggcatcttgttaattagtggattagtggatgataatgtgacatcttgttagtggatgatatgatgtggcatctttgcatgttaagcttaacgagttagtgggagataactttatagtaagatatgatatgtacattactacgaacatgatccctctattgtataagggcatgtgcaatgggtctggatcccctggagtcactccaactccatcggtggatttgatagaatctctacggtctcttttttatcgacggttgggatgaagccattagttcccacttcccactagtctcttttgaaaaaaaaagaatttatcctaatcttgtaacaataacaaatcaccgtctacaatatatttagacaatttgagaatatacaagctaattttacttgcataacccagaaattctttgattaatccatggtgtaaacaccgtactgagcacgtgcctctagttttgcatgtatatggtttatgtgtgtttgcatgtactatgcggttaacacttttttttttacatgaatgtagcttcttgtgtttgggaaagaagagaacatgtatactttgttaatttggtaggcagaaacttaaccattactaacataataaaaaaataaagtaattcccattcaaaccataggaagcaatagatggcttcatctcagccataggaagcaatagatgccatggatttgataaaattcacccggtggagttgtactcaactctaggggatctgtaccccaatatatataagcctatgatggagaaaacaaggtggctccatgcacaaaaggtacatttgttacgcttgtgactgaactacaattcattttttatttgtttgttgccggtagcaacgtgatgattgggtaacagctaataccaactttcacatcacagtgtatataaccaggttggaaggaagcattcaatgcctattacctgcttttctcccacattgtggatgtcctaatgtaagggattttagagggatgtgacgtatcctagtactacgaatctagacagatgctaggggattgtttggctggaggagtcaacccatcggggagggatggtaacttatttatagtccacctttcatcatcttgcatgtcccagttttagagtttataaaagtgagggacaaatatattagggtttgttaaagtgtaactactatcagtaataagcaaattaactatattatttgtacaataaacagtgtgggggtatggagaggtcttcttttctcttgtgggccttaccttcaccttttgcattcacacattggcatatataaatactagagttagggaataaaagagggtttggggatagagggacttgaaccctgacttagaaagtcgacggattttccttttaccagaaatttcattgttgtcagtattgacatgtagaatgggactctctctttatcctcgtccgattaatccgcttttaaaaagatttcaaaaccggggtgcaggaat

SEQ ID NO: 24412 - DNA, 758 bp, Oryza sativa
cctgcagcccgggaggccaggccaagaacaaaaaaatagaaccttgtcttttgaaccatgaaaacaacatactttgcaagcaaggaaacaaaaattggtgtcgtctttgcattttacatctatttaagttggtctaggaaactgaaaagaaatgttcctcaactatgctaacatctgtcccttgcaggaaatttacgcctggtaagcataaaaagagaaatcacacaattttatgcctaaatgttctgagtcagaattatagaagcttctttctctcaaagaagttcttcagatgccacaactgcaaccccgccactgacaggcagatagctagtgagaagaaaccaagccaagccatccttgagtttgttctcctgttcagttcctgcatctcctcctccctagagaaatgaaacacggataataatgatttaagagatcatattgaatttcacaaagaaatgttttatcattgcaagccataccttgcgcgaagataaaacatttcttcatggatagagttgatagtatcctccagcttcttgagctcaacctccatcatctgccacatatcaaaagataaatgtgtgaacaaaagatatatttctgcaaatactacaatatggaggtgattttgcatgtccacattaacatattagtttacaatgtgtaatactgctgataatgagttgcatgataagacccattgtgatgctacagtcaccagttagagagagaagggaggggatatgattgaa

SEQ ID NO: 24413 - DNA, 512 bp, Oryza sativa
taataaattgttctatcgtcatttctttaccggtcaccaacggctcgatctcctggtttggttgctctccaagctgagggactggtttggactttccagaagatgctttcttcagcgttcgctcatagtccgatagcttaatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaggcggtggagttgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagac

SEQ ID NO: 24414 - DNA, 2311 bp, Oryza sativa
  unsure (1)..(2311): unsure at all n locations
nnnnnnnnnnnnnnnnnnnnnnnnnnnnnnnnnnnnnnnnnnnnnnnnnnnnnnnccttagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatggataaaattagagctatcaatcatttcttaaagataaagaaaagctttttgttgaaatcaagacaattacatcaaaatgatacaaaagatcttgaaatcagttatgacctctacataactaatatacacaaaagaaaaagttttaagttgataaagacacgctaacatctatcatacttagactacatcatcacccatggtccagagtaaactactccttaaccacctgcttcaaatgttgaaacgtacatatatctgcaaataaaagttgtcaagccacagctagtgcataattaagtacataacctacaaagatatcaaccacacttgagcgatattttaagtactcgagaggtataaggtggtaccaaaattttttaatgtaaattttcgtacctcctactaacggaggtactatgagagctattaaattttatagtagaaaacgtggtatctcccggtaccttctcagagactgtaaaatcactcatcacttcaagtatattatgtgctcgtccatgaattcatggaaccgaggaaaatttatcttcaagtatattatatgctcgttcacgaattcatggaaccgaggaaaatttatcacctgtacttgggaagaaaaataaaaatgtcggtattaattgcttgtgtttcctgagtattattctttcatcttccgattcatatttgtaataagctcccaactatatatgaattacctacctagttcaaaattccttattcatccttgagttcccgttagattaattaattcctttcatacccggcgccccgagttaatttcactgtctgtgcctagctagtcttgcattttctggtggaataatctaagctaaattccaaagactacttgactatccggagactaattaattggctgatcactctcatgaaggagatgcgctgctggtgccttactactccagctaccgttctctatttatggcgtccaaaatcaattaaacagctcaccatcagcaactaattaaaacccatgagcctgccaattcgttcagattaacccagcatcacatatcccatcgatcgttgagtcatcacatatcgttgagcttcggtcgtcgatcaatcggccggcatcaatggcagtgctcaggaacgtcatcaccggcgttggccggcgtctggtgctcctcgtcctgacgctgttggtgttggcggcgctggatgatcaggcgccgcccatgatcatggcctccgctgccagggttttgctacaacaatatccaccgacttatgggcctccgcgctgttatccgccgtactgtgcaccgcgtcacgctcgccgatgatgtagttagttatatctgtcttaaaaaaattaacttccctgaatgaatctggataaaatatttgtctgatccattcctttttcttggacggaaggattatgcgtaagagttgtgatgagtactcctatttatttgattagtaatgtttgtgttaatttcttccataaactacaatatattgtacacctagagaaggcttctgctcctgttgctcctcctgcctggacagagctgtataatattgcttgccatttggatgcatgccttgcgatctactccgagctagagccgcgtatgaactgtctctactagctgtgtacgttgtcctactatacggccagtccatgaatatatcctgctttcagatttgatagatacttccccgcaaaaaaaaaaagatactgtatagctatgcatgtcatgaccggattgtgaatattgaacatatatcatgcaatacgttttattattttgatctatcactcgaagagctttcgtacgtgttatcgtgtctgaaagtctctgcggcaacatttaattaa

SEQ ID NO: 24415 - DNA, 686 bp, Oryza sativa
gctcgtgtaccccgtctgtatatatagggcgagcgatgcaagtggccgaggcattcggtctctatttcgtcttcctatattacaccagtagaacgtcgtcaaagccggagctctttggacttttcaaacttagcgaactgaaacattgagtagctagaaaggaaggaaaatcaaccgagagcccgttagtagcggcaagcgagagcggaacaagggtttttatcaaaagaaatccataaaaaagaaaggaacataagaaatgtcatctatctatcttctattatatactaaaattccatcaaacctcctataaacactctcaaaccgtcgtgtggcttcctacaaacgctcataggttgacacgtggcattctataatctcaccatcgattttcttttaaatcgctggacccgttaattttaaggacgcgactacacagctagtggtagctgatttgtctaaatcagctatcactccatatatgagagacactatccacctatagttcaaatacaattttctcttaaactactcatccgatctacgatccgattacaccgttgtgttcgtaacaattaaatctttataacaaaatctcatatgattatattttgatgaaaaattataaattacttttataatatatctaaattacttttagatatcactaagttacttgttacaca

SEQ ID NO: 24416 - DNA, 1471 bp, Oryza sativa
  unsure (1)..(1471): unsure at all n locations
nnnnnnnnnnnnnnnnnnnnnnnnnnnnnnnnnnnnnnnnnnnnnnnnnnnnnnntgtgcaccacacagcccttggtgtatttctttcgccatttcttctccttcggcaaaggagatgcatcgaagcaagggttggagcaccccggagcgatacagctgccctgagaccagcttgtattttgtggctctgagctgtaaacgcttcgcttctgcttcatcttgtgggagctagcaattcttgaggtacttgatgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctaacaatcaaaaataaacagcagcggactagcgggcctacggctccatcttcacaggcgctcaactggggtataagccaggactcaacctaagacttcttctccaaagcttctcttactgaagggggaaaagattgagcaagaatgagtacaaccacagtactcagcaagccacaccggcagatgcatgattaatgcaagggggtacaaggggtaataatataggggttaagctttgcagaaaacagcatttaaaagtcacttagttgcccaaagccattttataagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaattaagccttacccactagacatgtggaagtacggtagtgctttgcaacagaggcccgagcttaatccttatagtacccgaggtacgactaaccaaacccaaccacgcacctcgagcccagcctaaaaccattatgggggttttgaatagagggggaggtgtgtgtccaattccaacataagccaaccatt

SEQ ID NO: 24417 - DNA, 705 bp, Oryza sativa
gtcccacacggggacacttccttcttccacacagtttaagatctttgaccagttgtcttagaaacacatcgatgtcgttaccagggtgcttggggccttgaataataatcggtatcattatgtacttcctcttcatgcatagccaagggggaaggttgtagatacacatcgtaacgggccaagtgctatggccgttgctcatctctccaaaaggattcatgccatccgtacttaaaccaaccgtatgtttcgtgcgtcctttccaaagtctttaaattttctgtcgatgtttcgccactgcgaaccatctgcggggtgtctcagcatcccgtcctgttgacgttcttcagcgtgccaacacatcattctagcattccccttgttcctgaacaaacgccttagccgtggtattatagggaaataccacatcaccttagcaggaattctcttcttcgttagctgcctgtcaacctcacctagatcatctcgtctaatcttgtatcgtagtgctttacaaacagggcatgcttctaggttctcgtactcctcaccgtgatataggatacaatcattcggacatgcgtgaatcttctgaacttccagtcctagaggacagactatcttcttagcctcatacgttgtctcgggcaatttgtttccctccggaagaatgttctgggtaccgagctcgaattcgccctatag

SEQ ID NO: 24418 - DNA, 966 bp, Oryza sativa
atgaatttatcaggacgtgacacttgtcgaatggggttcgccaatcttctgggtcttcgcccagctttgcctggtcgattgccatgatgtccaggctttctgtgggcacacttggtgcgtacaagacttcaaaaaagatgcctgatgaatgcgggcctccacagactgcagattttgccagggtatctgcttcctcattctggcctctaggtaagtgttcgaccgttatgccggtgaagcacttttccatagaccgaactgcttccagatatctcttcattccttcttcttttgcctcgaaggacttgtcaacatgacttgccaccagcttggagtccgttcggatgagcaagcgccgaaccccaaatgctttcgcctttcttaggcctaatagtacagcttcgtattctgccatgttgttggtcgtgtcgaactacagccttgcggcataccgaatcagcacaccccctggcgaagtgagtactgccgcggcgcctgccccgttgtgcgaccatgagccgtcggagtacatttacccaaggctattcgacgggctcgggttcaggggcgaatgccagtgtccattcggccacgaagtcagctaggacttgggactttatggcggtgcgggcgacaaaatgtaggtcgaagggggataattccgccgcccacttgctgagtcggccagtgatttctttgccccgtagcacttcgcccaaaggatactgcgatggcacagtaactttgcgggcctgaaagtagtgcttaagctttcgcgaagccatcactagggcgtaggcaatcttctccatttcgatgtatcttgtcttcgccccttgtaacgcttcggagatgaaatacactggtttctggcctggctccgtctcttgaacgagagctgcactgaccgccaccggcgaagctgctagataaagcagcagttcgcttctcggcgctggactgacc

SEQ ID NO: 24419 - DNA, 668 bp, Oryza sativa
agtatccagacggtacctttatgctctccaagcattcaaacatactttccttctctgccttgctaagagtgtagttggctggactcaagtaatggcttcctttctcctttggttccgggtgaaggtcgccgcgttgttccatatgcttcagatcattacgtgcttccagtgtatctttcgactttccgtatacacttaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttggaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaac

SEQ ID NO: 24420 - DNA, 3616 bp, Oryza sativa
ggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcgtgaagatactctgccacagtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaaatgatcccaccattctgatgcaggtccttgcaactgatgtgaagcgaacacgactttctcctgatccgtacactggagcagttccaacttcttctcaacagcgtgtagccaatcacctgcttctactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctgttgcttattagagaggatagaaggagaggggttacactaaagacaagaccttaaccaggttaacactgatctgatgtgtgtagaccattatattgttcaagttgattaagcaagcaacctagtatagttacacactcatcattgaatcacaccaatgacgggaatgcaaccatacctacacacaagcaagcaacaagcgttctaccctactaactattctccaaggacactttggcggcataggttctaaggtaggatccaaacttcattccatcttgacatctgggcacttcagatcgaccatcaccttcttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcggtcttcaattaatcttcttgaatacttccggcgcactcgcgaaccttcacaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttaaactgattttaattgaattatgacgcaataatgaattatttttgaaaaggaaaagaaagattattgcgtcagcggctagggtttcggtggacctggcgcacgggcggcggttcacgcgaacggacggccgagatcgatccaatccaaaacggacggccgagatcgatcggtccacgaccggctcatgacggacgaccccgatgacgtcggcgatgacgtcacctaccagcggcggcggctcggcggagcggacggctcgggcggcgcacgctcgccggcgaacgacggcgcggcggtgcaaacggagagcaccaagacgtagatcacggcgcgacgaactcaccgatgaccaaaacgacggcggaggagcaaaggacggcgccggcgacgaggagaaagcggcgaagctcttcgggtcgacgacggcgacggcgctccggcggtcttcggcggcggcgaagcggtgggtaccgagctcgaattcgccctatagt

SEQ ID NO: 24421 - DNA, 1788 bp, Oryza sativa
  unsure (1)..(1788): unsure at all n locations
nnnnnnnnnnnnnnnnnnnnnnnnnnnnnnnnnnnnnnnnnnnnnnnnnnnnnnnnnnnnnnnnctaaggcaaaggtggtggcggatagaggagagctcgggggtccttttaaaggggctagcgagcggcgacggaggcccacggcgaccggcggcgagaaggaaaggtcggggattcggaggagagaagtcgatccgattcgagatcgaatccacgagtttccaaaccgaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggtcggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttggtaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcttggaatacagtcattttccttttacggttatctatcctgttcttcttgtcttcaagtcgaattgctttgtcaaccactgctgaaaatcaacatagtcatgagagatcaatgtaactgacagttcatccttcaagccttccaagaacttctcctgcctttcctcgtcagtacgcacatcttctggagcata

SEQ ID NO: 24422 - DNA, 1001 bp, Oryza sativa
ggtgatcaagatgcaagtcgatgacgccgatcccacgaatttttccagctagggggtgatctaggcgaagaggaagccaagaatatcctggaggtgctcaagaagaacattgacatcttcacctggagccccgacgaagtgggaggtgtttcgacgaacttcatcatgcatcatctggcggtcaagccggatgccaagccaagggaacagaagctgcacaaaatgtccaccgatcaccaagaggcagcaaagcccgaagtgtagaagctgctcaaggctggggtgatctaagagatcgaccacccagagtggttggcgaacccatttttggtgaggaagtcaaatggcaagtggcgcatgtgcattgacttcacagacctcaacaaggtgtgcccgaaagatgatttccccctgccgcggatcgaccagcttgtcgactcgacagctgactgcgaactcatgagctttttggatgcgtactccggctatcaccggatccacatgaatccggccgacatcccaagacagccttcatcacgctgttcgacacgttctgccacctcagaatgcctttcagcctgaggaacgctggagcaacattcgccaggttggtgtataaggtcgtttacaaacagttggggcgaaatgtggaggcctatgttgacgatatcatcgtaacaagccgcaaggctttcgaccatgcgtctgacttgtaggagaccttcgacaacttgcgtgcggctggtatgaaacaaaaccctgagaagtgtgttttcggtgttcgcgcgggcaagctgttgggctttcttgtttctgaaaggggtatcgaggcgaaccccgagaaaatcgatgccattcagcaaatgaagcctctgtcgagcgtacgcgaagtacaaaagctcacaggctgaattgcggcgcttagtcgatttctctcgaaggcagccgaaagaggtttgcccttcttcgagacgggtaccgagctcgaattcgccctatag

SEQ ID NO: 24423 - DNA, 578 bp, Oryza sativa
  unsure (1)..(578): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnaatgtacatcgcggttagcagcaatgacggaagatggtgagcaactctcttggtggacgatgacatgttgatgattcaagattggctgtgtttgtctgccttgaattgtgtggataaatacaggagtactactatttcaatatatcagttgcacgttgttggtatccagtagcttttgattgtctgtgagtcaaacaaatggttcggaaaatcagacagttcaaggaaagcgtgtgctcttatgaataatagtacagtccttaacccgtgcgattgtgcgaacccgtggattcacatatgggcttttcttgatctactagttcataacccgtgcgattgtgcgaacccgtggattcacatatgggcttttcttgatctactttgcatctgaatctattttatactaaaagtccattaaactttttataaacactcctaagctgccacgtggnnnnnnnnnnnnnnnnnnnnnnnnnnnnnnnnnnnnnnnnnnnn

SEQ ID NO: 24424 - DNA, 1772 bp, Oryza sativa
tagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccgtccgaagccgccaagaactatgtacgtcacagcggttgggttgtgcgggataacgtgcctgtcagtacggtgtactggcgaagaacaagggcacgctgagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaaaaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtgctatgctcacggtggaacgctcaacccagctgatggctcactggtcttcggcgatcagatacgagaggctgcgcgacgactaacagatgcagtggaagcctcctctcaaggcacgttccgaccagacagagatagggacgagctgacactcgccctgcagactccagagcattcaagacgaacacgagggaaaggggtgattccttggaagattgtttcaaggaggacatcaacacatacaggagtcggatgaagagcaagagagataccgaggcgaagattgcagacctagagttccgggtatcgagctacgaactcaacatgcaaaaggaagtggcaaggaaggttgatgaacgcatggccgcacatcggtcccatgatccccagctgaccattccttctgcaatggtgagcccgtcaggaaacagtagcagctgcgcctcaacggggcaggtaggatcacagagcatggacgccatgcaaacacaggacaaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagtaggatactcgaaggtcgaagttgagttggtcgaaggcgcgtacgaggacctcgagctggattaccctggaggagacggggagacgcatctacgagacacatgccatgccattattctatggcgcaggcggtacatcatcctccctgggcgacaagcggcgtctcgtgcaccatctcctctggctccg

SEQ ID NO: 24425 - DNA, 543 bp, Oryza sativa
cttcgataaattctatgcaaaattcaatgacctcctctgtgccataacccttggcgatgcttgcctctggacgagcacggttacgaacatacttcttcagaacgcccatgtacctctcgaaaggaaacatgttgtgtaggtacatacgcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgatattgttgcccggacattgtctggaaggataccccttattacaactggtagcagttgtgtcatcaacacgtgacagtcatgagactttaggtttgtgaacttcttctcctttgtgcttattattcgcttgatattcgtggagtatccagacggtacctttatgctctccaagcattcaaacatactttccttctctgccttgctaagagtgt

SEQ ID NO: 24426 - DNA, 2286 bp, Oryza sativa
ctcccggtgatcaccggattcgagcagctcaccgaactggtttatcttgatctctccgacaccaacatagcgggcgaggtgccaggtagcatcggccgccttacgaacctggtctacctcgacctctccaccagtttctatatcgtcgaatacaacgatgacgagcaggtgacattcgactcagactcagtttggcagctctcagcgccaaacatggagaccttgattgaaaaccacagcaacctggaggagctccatatgggaatggtggatctgtccggcaatggagaacgatggtgtgacaacatagccaaatatacaccaaagcttcaggttctaagtttaccttattgctcactgtcaggtcccatctgtgcatcattctctgccttgcaagcactcactatgatcgagcttcactataatcacttgtcaggttcagtgccagagttcttggctggcttctccaatctcactgttcttcagctatccaaaaacaagtttcaaggatcgtttcctcccatcatcttccagcacaagaagttgagaacgatcaacctctccaagaatcctggcatatctggtaatctgccaaatttctcacaggacactagcttggagaatctgttcctcaataacacaaacttcacaggtacgattcctggttccatcatcaatctcatatctgttaagaagttagaccttggtgcaagtggcttctctggatcactgccctcttcgttaggcagtctcaaatacttggatatgctacaactgtctggattacagctagtaggaaccattccgtcgtggatctcaaatctaacttctctcaccgttctccggatctctaactgtggattgtctggaccagtgccttcttcaataggaaacttaagggaattgaccacattagcattgtacaactgcaacttttcagggacggttcatccacagatcttaaatttgacgcggctacaaactctcctgctccattcgaacaattttgctggcacggtggatctcacctcattctcaaaactgaaaaacctaactttcctgaatctctcaaacaataaactacttgtggtagaaggaaaaaatagttcatcactggtattgttccccaaactacaattactaagtttagcatcttgcagcatgacaaccttcccaaatatcttgagagaccttcctgacatcactagccttgacctttccaataaccaaatccagggagctatacctcagtgggcatggaaaacatggaaaggcttgcagtttatcgtcctgaacatatctcacaataactttacgagcctcggatctgatccttttctgcctctttatgtggaatacttcgatctcagtttcaacagcattgaagggcccatacctataccacaagaaggtagtagcacgttagattactcaagcaaccagttctcatccatgcctcttcgttactcgacttaccttggtgaaactgtgactttcaaggcgtccaaaaacaaactttctgggaatgttccaccgttgatctgcacccctgctaggaaactgcaactcatcgatctatcttataataacttgagtggctcaatcccatcttgtttattggagagtttcagcgaactacaagtattaagtctgaaagcaaataaatttgttggaaaattacctgatattatcaaggaaggttgtgcacttgaggcattggacttaagtgacaattcgattgaagggaagataccccgatctctagtttcctgcagaaacttggagatcctcgacattggaagcaatcagatcagtgactctttcccatgttggcttagtcaacttcctaaacttcaggtccttgtcctcaaatctaataagttgactggtcaagtaatggacccttcatacacaggacgtcaaatcagctgtgaatttccagcactcagaattgctgatatggcatcaaataacttaaatggaatgctgatggaaggatggtttaagatgctcaagtccatgatggccaggtctgataatgacacgttagtcatggaaaatcaatattaccatgggcagacataccagtttaccgctacagttacatacaaagggaatgacaggacaatttccaagatcttgagaagccttgtgctaatcgatgtctccggtaacgcattccatggtgccatcccagataccattggtgaacttgttctgcttcgtgggcttaacctgtcacacaatgcccttacagggccaattccatcacagttttgcaggtta

SEQ ID NO: 24427 - DNA, 897 bp, Oryza sativa
cacgtactttctcctcactattgttccctccttgtgatcgctgcatgagtaaggggtgtcttcatttgataggaggatgctagggtcaatcgtcaccgtgaaagggggttgcccatcaaactgatcgtaatcctcgtcagtcttgtcctctactccgacaatttttcttttgcctgggagaaccacatggcgcttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctccttgatgacaccgtaatacgtgccagttgtaccatcgtgtcccatggcatcgatacgaacagcactattctggttcgtgctcttcatgtcttgggctcttgtgtagaatgtgtacccattgatctaatatccctggaatgtcgcgatcgagccagatggacccttcgccaggaaggccagttgttggttaatcgtctcgttacccatgagatgttgtcgcagccacgcggggaaagtatcaatgtgatgccgtgtaatccatgcatcggagttaccgatgtttctggcgcgaactagagccaagtgctcctcgatgtaaggagccaccaatgaagattattgtaaaaccgtgaaatgggctttacggaataaattgttgtctaccgtcataattgctttccttccgagagtcccctttccccgtagtctcccttcatggcgtgattcaggtaccccgattgtgcgaaggtc

SEQ ID NO: 24428 - DNA, 2066 bp, Oryza sativa
  unsure (1)..(2066): unsure at all n locations
gcttcagatcataagtgcttttccagtgtatctttcgacttttccatatacacctaggaagccaagaaggtttacacaaaggttcttagtgaggtgcatcacgtcgattgcgtggcggacgtccaagaattcccaatagggtaactcccaaaatatggagttttttttccacatcgccgcgtgaccatcttcgctctctataggctggctgctaggtccctttccaaacactactttaagatctttaaccatagcaaacactgttttcccgctgcgatgtttaggctttgtacggtggtccgctgtatgttcaaagtgcttgcctttcttccgtaccgagtggtttgctgtaaggaatcgacgatgacctatgtacacaaccttcctacagtgcttaagatacatactttctgtttcatccatacagcgagtgcaagccttgtaccccttgttggactgcccggataggttgctaagtgtaggccaatcgttgatggttacgaacagcagcgctcataggttaaactcctcctgtttgtcctcgtcccacacggggacaccttccttcttccacaacagtttaagatctttgaccagttgtcttagaaacacatcgatgtcgttaccaggttgcttggggccttgaataataatcggtatcattatgtacttcctcttcatgcatagccagggggggaggttgtagatacacatcgtaacgggccaagtgctatgaccgctgctcatctctccaaaaggattcatgccatccgtactcaaaccaaaccgtatgtttcgtgtgtcctttccaaattctttaaattttctgtcgatgtttcgccactgcgaaccatcgggggggtgtctcagcatcccgtcctgttgacgctcttcagcgtgccatcgcaacattctagcattccccttgttcctgaacaaacgccttagccgtggtattatagggaaataccacatcaacttagcaggaattctcttctttgttagctgcccgtcaacttctcctggatcatcctgtctaatcttgtatcgtagtgctttacaaacagggcatgcttctaggttctcgtactcctcaccgcgatataggatacaatcattcggacatgcgtgaatcttatgaacttccagtcctaacgggcagactatcttcttagcctcatacgttgtctcgggcaatttgtttccccccggaagaatgttcttgacgagtttcaataaatcgccaaatgccttgtcactaacaccattttttgccttccattgcaagaactccagagtggtatccaactttttgtgcccctgctcgtaacctgggtacaacgacgttctgtggtcctctaacatcttgtccaatttatgggcccccttttcactttcgcagtcctccttggcatcctgcatcatctgaccaagatcatccgcaacatcgttataatctgcatctatgtcctcctcgcccgtttgatttccttcaaatctagcgtactaagcaaagtctgaaatattgtcgtcttccacttcatcttcttccatttcaaccccttgctctccgtgggatgtccaacaattatagcttggcatgaaccccgactcaaacaagtagaaatgaatagtcctgaatgcagaatactccttctgattcttacacttgttgcatggacaacaaataaaacccctttgcttgttagcttcggccactctcaaaaaatagtgcacgccatcaataaactctttggaccgccggtcagcgtacatccattgccgatccatctacatgagtcaaaaaaaccgtacacaaataattattcttacaataatgacagtcagacaataattataagatatctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgagctcgaattcgccctatag

SEQ ID NO: 24429 - DNA, 526 bp, Oryza sativa
aaattcagtgatgctagttccttggggatctctccagaaagctcattgaaagagaggtccaatgactcaagttgatctaacctgcaaaactgtgatggaattggccctgtaagggcattgtgtgacaggttaagcccacgaagcagaacaagttctccaatggtatctgggatggcaccatggaatgcgttaccggagacatcgattagcacaaggcttctcaagatcttggaaattgtcctgtcattccctttgtatgtaactgtagcggtaaactggtatgtctgcccatggtaatattgattttccatgactaacgtgtcattatcagacctggccatcatggacttgagcatcttaaaccatccttccatcagcattccatttaagttatttgatgccatatcagcaattctgagtgctggaaattcacagctgatttgacgtcctgtgtatgaagggtccattacttgaccagtcaacttattagatttgaggacaaggacctgggggatcctctagagtc

SEQ ID NO: 24430 - DNA, 896 bp, Oryza sativa
cctaacaggcaagtctatctacaaaaaactccctattgtcatccaccattaattttttccgtgtctccaatttatctacacttcctgtacgattgttttactgccatttacatcatttttttttcagatcaagatcctgctatggcagtcgctgtcgggcggtgcttccctgggataatacactgactctgtaggtggcatatcctcaaccgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaagga

SEQ ID NO: 24431 - DNA, 4581 bp, Oryza sativa
tttttgatgcaaaatgtagggtgcctcgtttgaccagacattatagtggtattgtccatatgcatgctaagctctatcagattttcagagctcaggtcagaaagaagtagaaggccagtgtaacagtgttatagcagctagcagcactgcggcagtatcacccaatcaattttctgtggccaatttggccattgctgccattatgaattgccaatctgtattgtatagcattgcatgggagagggaacaaattgctacaccgaattgcttgctgcccagcccggacatgtaacgaggcagtaataacttgtgcaccagccctgaatttatacacctgtttgtctgtacatagtagtacatactactagtacaaaatacaacgaataatgctacacgcaccatggcgctgctaaaattacccccggtaaacggtggccgacatatgagccccctggtcccatgtgtcggccgccgaacgtcggggaggcgtagcgatttgtgaatttggagggatgactgtttggtaagtacatggtgcaaaattgaatgcagaggcagatgggatgggatggaggtggcgcagctgtatagaggtagagaggagtatctaacaattgccaatggtaggggaccggagacctctgaacaatttagtcccttgttgttgtagttgttgttcctaggatcggtttggagttattgccacggccatccagttcaccaaaggcactgggaattgtcttgctttcctcctccattgtctccttgcaatttgaggcctctctgcaaaactgcgaaagatacacctacatttaaccacaacacatgctgttggtgagcaaagaacatttaagtgcttttcatttcaatcatgtgttgttggactaatccaaaaggacaagtgaagatgactttttggttcatcctggattggtctctcttttttttccctgttaggtattgcattgtggtcttagaccaggccggccaatgataggagaagaaacggagcagaatgagttcaagagcgatcctgatagatagcttgtgttgtgtgcactgctgcaattcaaagcagtgttgttttgtcatcttggacgcatattgcctcaaaagactagaaaaaacgtcagtagcaaagatttgcagatgctaccatatcgagaggacggcagatgatctcatcttgatcatatcatgcaatggtccaaaattccaggccagaaaaggagttcagatggtcggtcactgtggcactgcctggccatgaaactggagcaaacagctcgagaacgcagcccattaaattccaagaaagggttaaatatgaaaagttttgcccgtacaggacaaaaaatacatgcacacatgattcagtgacaccatgcatgaaattgctggtcttatgatctttccactccagttcatgcattcagtattcagtacatgggacacgctggtgatgatcatgagtcatgacaacaactcagtaggaatggttaacaataagaatggggcatggtatgtttaaagttcgacattatcagctcggcgtgtcaatacacccaggccacaaccaagaatcgacaaaatgtcttgtgtatgttaaactgagaaagctggtgttattttgtgacattacagccaagattggtcctgaacatgataacttgtttgaacctattaccacattgggacttggcaaacagctaccaaatgcaagcacatagggagatgaagttactgggctgctgtaccaactcgggtacattgtcaccaagctccaaaaatttgcatggattcctctactcaactggtttcgaggccaagatcttgcagacaggcatggtctcgtttttactcagtaacctcaacgacggatggacggggatgtcattcattgataccctatctccaatgtcaagatttgccaggtccacctcaatttttggagggatgtgctcagcagggcagagatacaccaagctggtccttattttctgcaaaaagccgcctgtttttttcaattgaattaaatagtcaggtcaagcatagaaagacaacaattcagcaattagacacaaattacttcaaagaatagcaaagcaagagttagataatccacataaagaggtaaacactgccacagatattgaaaatgtgacatgccatagtatatactgcatccgtcccaaaatataacctaggaccggatgggacatttcctagtattacgaatcttccggtcctaggttcttatattttgagatgaaggcagtacttcagtatgactagttatatatattatccacatgtttgtgtggtgccataggcacaaaatcatggtatctagttaaaagaaaatgacgaagcaaagagcagatgtcctagttccacatgtaaaggcagaatcacaccagcaaatcagatacatcacgattgtgtcttgagaaaactagactgagagagcaccaaatatgactaagtaaagcaggtagatgagttgtcactcccatctaaagtgcaacgtgtgcactcttatcaggcagtcattaaaatgtgtcactgctcagcgtgaaatcaaatagtacaattatgatcaagaatatattagcaactcttcagattggccatatgaaattgatatatgtatgtttcacatgaaaacaaatatcaaaatcttaaataaacaggtttcaggaatgtataatttatagcaaatggtatatgtcacattgcaaagactgcgaaatgaaaacgactccttttcgtgactggtagcagtaaagatcatgatttgccaggtgtacacgaaaacactggtaaagcctttaccaatatcataaaccccagaattagatgcataacatagcatagcaccataaccataactcagataccaacaaatatgtaaatgcaaggacaggggtacatgttaaattttgaactcctgtgccaaccacttgtcctcccttggctaagagtgactacttgtgctttctcacatgttctcttcagctaccgtcagtttggcgctaacttgattacctgaaaactactcaaacaatttagggcattcttggaagatcccccaactcccaagcataatcttaaacctgctacaagcttaagatatcatgctccacaaacgaggagcgccattgtaacagagtttttgaaagattaaactacattttgttgaagttttaaattccatttccatttttgtttttgagaggctagcttaggtggcccagaagagatgataagctcattgaagccggcattgaggccagtggaaattgaatgtcggaagttgtccccctcataaatcgacccggccttacaaatggtaagcatattcgggacctattgattgcgatttatcattgcagaagtaccaaagtcacggctcgttccttacacgaggacttcgatataaacaatgggaggtggcagaaaaggaccacaaacccagtcgatgcggtagtaaataatagagaagatgtgtgccacctgcccacttgcattaaacaaactaacttccagaatgcagcagacttggtgtacagatacttagaatgcgtataggatagtaatacatcataatggaaatttcgtactgttcatcatttattttgccaaatcatggagctatccagaattattaaggcaagagtcctatatcttaaataagaaaattgatgcccctctgcaaaacttaggccagcaatacagtacaaataatatttgccaatttcactggaaagggtaattaattttccacttgatagaattatattttttttttatagaacagttactaggaacgtgcattcgagacaaaataaatatcttaaaagaaatctacctacacacaacaccaagagtaatttggtccctacaagtccaacatcttaacagaacttcagattaggaaacaaaaagaaataaagtaaattgcaccatgttattcactaatctgaattgaggaattcacaatagaatgcacatcttcagacaataagaaagtcatttttttattctgttaaatagaggaatctgagctttgcctggtaatggagggctcaacaaagcccattaaactcctgatttggatattggctttcaaaaatgttagctacttttgtggtactaaaccttgatataagacaaatagatgtgggaatctcactgcttacgcttagaacctccaacaaacaagctattttccaagtgaccacttacacaaggtcagcaactcagcacatctgcttggcaaaaatcccatgtttgctaccactcaattatgggctcatgtgcaagagcacctcattatttttttgtccccatccaggctccaatatcaactttgagcacaatgtgcttacatgcatccaaccaatgcgcccatactacaaacttgccaatcccatgggttgacacgataagcaaaccatgccgacaaccaagggcaggcccaggcctcaggcctcctgggccatggcccgaggcctaggattcaatgttcatcatgatgtgcatttttcaccatgcgagacacacagaacaaggtataat

SEQ ID NO: 24432 - DNA, 1002 bp, Oryza sativa
tttttcaatctgtggtataacttttcatgtcactgttgagttctgacacaatttcaaacaaatgtgcatacatagactcgtagaataaagctattcaaattcgatagtttacatggaatcacaaaaaatagggtaacctggatctattgatccttagccgtggcatttgggtatctactatctggcctgtacttttcagcttattcactggattattgaaacagattatttgttccacgcttcaaaaaatatgttttctttaaaaaaaaactttcttcaactgcattgcttagagccttagaccgcttactttaaactatttgttaagtttatttcgtaaaatatttaaattatccctataatcaaggagataatccgtggcaataatccactcaatgatctaaataaaactgggcctagttacagaagggcagagttttgtgccaagtgttaagcatcatgcaatgcacatttctatgttgagattccataaaaacataagctatcatcttgtatatagcacagggattttgccaaataaaaagaaaacctatacctttcttcaacccagggcagacgtcctcccccttgaactctacaggcaagttcaccttcagcattgttccttcatctgcctccaccagcaccaagttcaatatatttcctgttgtttcgtctctatgcacctgcaaaacacaagagcatccacatcaaccacaatccattttatgcaagatagtgcagacccggtcctgacgcacaacatatctgaccaatttcttctagcactctcgcatatatagttgcgaaaccacaccagtggttcccccagctttctcaggataaaactgctcaagaacagtaaacaatcatataaaaagaaggattggttctctgcactcctaaactataaggactgctacgtatctgagcaatttctccaaagtaagcactacaaaatactagaaagtcgcttacactagtaacaaataacctaacagc

SEQ ID NO: 24433 - DNA, 4382 bp, Oryza sativa
gcgagggcgagtagcacggccgggacgcggccgctgcggcgctcccgcgccgccgcgcgcgggccggccgtctcccgcggcaacgcctggatcgtgtggtggtacgacgccgaggccgcccgcctccacggcgccgtcgaagcgccgcggcggagcgcctctccgacggcggcggcggcggcgcggcggaggcaaagcgccatgtgtgggggtttagggggacgaagagagttgggcttggctgctggttgctacttgctgggccgtcttttgtatcctacagaaaatgggttgggaaatcttatcccaccttctaaaaggataacttttaatcttagccattcattcttcatatctcatttcatctcaaccctccactcatatctttgtcccaatcccatccctcctaacccattatctaaaccgagccttagggctttcttgatttgggaggctattttatcccattagacggcagacgcacacgcccacacaccactacacaacatataagaccattctcaacccaatgactagaattgtgtccatagtattaaataaactatcatctacgatgaaaaatgatgtggcaagtgaataaatgagaaaagagaaggaaaccatgtcttccacgagacttggtttctacccaacatccaagacatcatgtaagataagtagcattaaatttaagtatggagtagtggtgtttgcattggaagagtagtgtctagtactagtttcttgacgatgtggagtttatgaaaactatgtgcagtgtcttaggttggtaatggcctaacaccacactctcacatatccgtaaatgcccccccccctccaaccaacacatgtctagtggcatattcctgatttcactaaaattttattgaaaatttacgaatgtgtgcataatattagtggatgttaagatttgaaccatgtcactaatgaaaaaaattggaagtatcaaattggtactaaattgtttgggctaggctagtgctaaccttaatgaagccactgaaaaatttggcatttgccaaatttgtagctacaaaatcaaatgagcgacaataaatttggatgtgtcaattattaataggattaaaaatggtataaaactaaataaccgcttgaggagaattgttagatggaacgtgagtttgaggggtggattgttaagtaagatatttggatggtctacgtagaagttttaggagagattggaaagaggagtttaagagcaaacatccatcttttcaaaataatggcctacatatatttatctgatagtttaagatggactttccataagaatggcttgttctcggtgaggtctatgtacctagctttaattaataatggctatattgagagaaataaatgtatttggaagcttaagttgccacttaagattaaaattttcatgtggtacttgtttaaaaggggttgtgttaactaaggataatttggcaaggctgttggcgggtgttaaatgtcgattctataccgccaacatccgcataaagatagataataaaacatccaacatagtgataggtgcttaatctcatatattccacaagtgttggtgtatatttgtatgcagatgataaaccccggtgttgggaggaaaatcagactaaagtgaggagaattatgcatccatacaaggaggggttgtgaacttcatcaaaacatcagtgaatcaacccaaaactccgagaaatagacagaggagagcccaaggagtccaccgactgaaggccaggccaggagggcccagcccaggttcggccgaacccccccgatcaccgttgatcctggggtttggcgtggatgctctagatgctcttccaatgacggttgcggggcagttcggacatttccccttcgccaaccatcatacctacccctatataaggacatcatctcactcacttcaacacacacttccaagcttgagctaaactataagaggctctattttactatattgtatactagaataggaagagagtagagtagaaagagttggaagaattccggagttgtcggtaatcttctcctatttcttttattctgtttattactctgaattcaatataatatttttcttgagtaatttagatttatcttgtgagaattatctcttggttagttcgtaaatagcatacgggattattgttcactataatcaactaaaatatagtgattgatttggtgagttataaacattaaagtagatagtatttgcttagacgtggtgtttaggtaattgttatccagtaattgctgcgtgtcccacagtacgttgaggtgggtgtagaggtggtgacaaccctcgatatcactgaagtcctccctgtccgggtacgtagtagagcgacatctgggaacaacgggttgccagtgcctgaagtactgtgttaggattaaagttaagctttccctagacactgtttctcactagtaaatcctctctatcctggcctatcatttgcttggtgtccttggatgaaccggaggaagcgctgatcacacacgttcccttggattcgatacccttggaatactccataggggaagtgctacatcagtatatccgtgcgcttgcggattttatctgtaaccgtatcaaataccaacaagcatttctagcgtcgttgccggggaacggttactaatcatttccgaacccagttcatcctcgtatcctttttcatttttttattctaccttcacccctgctatcttagagaagtattcctgtcaactcttctcgaccatggagcaacctttgtttgagctgtctgctcctcggggtgaattctatgagccacctccttcatcggagcccatttatacaactggctatgaaattcgtcccgagctaattagtatggttagggaaaatcctttttctggccttgatctagaaaatccctaccatcatatgcgagactttgaacaagtctgctcatgccttaagattcgtggcatgagacaagaaactgtgcggtggaaattgttcccgttctctcttcaagagagagcaaagcaatggtacacctctaccgttggatatgtaaacggtagatgggaaaagcttcaagacagattctatcttgacttcttcccagttacccatattactgcccttcgagtagaaattctcagtttcaagcagatcgaaaatgaatcaattggtgcagcttggtccagattcactaatttagtgcagtccggaccaaccctgtccttacccgagtatgtgcttctccaacatttccatacggatttgggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagtcagcggaagaggttaccgcagttcctcctcatgagtctaccaaggcccttctagaagatgaggtccccgacttcatcaaggaagaagcagatcccagtgagactctcgacctgccaatcatggaaccaccacctcgacctccgctagagcttaaacctctacctccaggcctacgatatgcctt

SEQ ID NO: 24434 - DNA, 806 bp, Oryza sativa
cggactgtgcaacgctcctgcatctttccaacggtgtatgatgtctattttctcggacatgatcgaagatatcatggaagtcttcatggatgacttctcagtttatggaaagactttcggtcattgtctgtagaatctagacaaagtcttacaacgatgccaagaaaatgacctagtgtttaattgggaaaagtgccattttatggtccgtgaagggatagttcttgggcatcgagtatccgaatgaggaatcgaagttgatcgtgctaaaatcgatgttatagatcaaattcgtcctcctgtgaatatcaaaggaatccgcagcttcttgggacatgccggcttttatagaaggttcatcaaggacttctctacaatcgccagacccctgaccaatctgctagccaaggatgcgccctttgagtctgatgacgcatgcctaaaatcttttgaagttctcaaaaaggcactcgtctccgctccaatcattcaacctcctgattggactttgtccttcgagattatgtgtgatgcaagcgatttcgctgttggtgcggtcttgggccaaaccaaggataaaaagcatcatgcaatttgttacgctagcaaaactctaaccggagcctagttgaattatgcaactactgaaaaagagctgctcgcggttgtttttgctatcgacaagtttagatcttacttagtaagagccaaggtgataatttatactgatcatgctgctttgaaatacccgctcactaagaaagatgctaaacctcgtctcttaagatggattttgctgctccaag

SEQ ID NO: 24435 - DNA, 5473 bp, Oryza sativa
aaccgcaagagcaagagcaaggcggagatcgatgataaagagatgactctcttcgtcaagaaattcggcaagttcatgaggcgaagcggcctcttcaagggaggttcttccaagcactacaacaagtcaagtggaagacactccacaagagtgtgctacgtgtgcaaagagcccaggcacttcattgcggattgcccccacctcaaggatggttcccacatcaaggaagataagaagaagggtgagaagaaggagaagcacaagcatagcaagcaggaacattatgaccaagctcaccttggtatgatctttggctccgactctgagtcaagctcaagtgataaagaaggagtcgccacgttcgctgtcaagccttcatcaccaccgagactcttcgactactcaagtgatgaggatgctcccatttgcctcatggcaaaggagcctaaggtaccttctcctctcaagtcatttaatgttgatcttgttagtgatgaggaggatgaggttgaggatgaggttatggatgacgaattgttcaaatccataactaaggaatccctatgacacttgagtgagttgcttgggagaattgagaaccaatatgctactcttgagaggcaagaggctttgctcattcgtgagaaagagcggtctcatgaactcaagagtgagcttactaaggagagagagaaaaatgaggctttggtacggctttacaagcaaaccaaagagtctcatgctaatcttgaggtggcgaacgctcaacttcaagagagagtggatggcttggacaaagcttacctctctcttgaagagaagttcgaaactttaaaaaatagtgtctctctccctagcgagccatcttgttccaaaattgtcccaagtaatgaaccatgtgtgagatgcaaagatgttgatattcaaggttgtactaccaactctatttcattgagtgctttgcaaaagcaaaatgagaagcttatgggactccttcacaatggcctacttaagtgtcatatgggtagtaagaccctaaaggagtacttaggctattaaaggaacaacttcaaccatgagggtcttgggtatgttcctccaccaaaaggaaaggtggacaagagtgtgatgatcaagaggccccaaggtcttagcaactttgttaaggccaaaagtatcattcctaatgattatgcttcacattgttcttttaatgcatcttatgttcttaggaagaatgctagtggtcgtgttgttgctaagtatgtaggcccaaggagcaagaatatttctatcaagagagtgctttgggtgcctaaggcacttgttactaacatgagaggacccaagcaagtatgggtacctaaaactagaaattgatctcttgtaggaatatgtctccggtggaagaagttgagtaattgatagcagatgcaccaatcacatgaccggagaagaatcaatattttcaactcttgatccaaatggcacttcacaagataacatagtcttcagggacgatggaaagggaaaggttatgggattgggtaagattgcaatctctaatgatctttctattgccaacgttctcttggtaaaatctttaaactacaatattttgtctgtttctcaattatgtttcatgggttagaattgtctttttaccgatgttgatgtgaccgtctatagaagaaatgattcatcggtagtctttaagggtgttctcaagggaaagctttaccttgtggatttttcctgaagtaaagccaaacatgagacatgcttagtggcgaaatccaacacggggtggctttggcatcgaaggctagcccatattggtatgaagaatcttcacaagcttctaaagcacgatcacatccttggactaacaaatgttcaatttgagaaagatagggtgtgtagcgcgtgtcaagtcgggaaacaaattggagcgcatcacccggtcaagaatgtgatgaccactacgagaccattggagcttcttcacatggacctctttgggccaattgcttatctaagcattagaggtaacaaatatggtcttgttattgttgatgacttttcacgcttcacgtgggtgttcttcttgcatgacaagagtgagacacaagccatcttcaagaagtttgcaagaagagcacaaaacgagttcaacctcaagatcaagaacattcgaagcgacaacagcaaggagttcaagaacacgtgcatatagagtttccttgatgaagaaggcatcaagcatgagttctcggccccatactcacctcaacaaaatggagtagccgagaggaagaataggactctcatcgagatggcgaggacaatgttggatgaatacaagacatcggaccgcttttgggccgaagccgtcaacaccgcatgccacgccatcaaccgactatatcttcaccatcttcttaagaagactccctatgagcttcttaccagtaacaaaccaaatgtctcttactttcgtgttttcggtagtaagtgttacattcttaataagaaggctagatcctctaagtttgcccctaaagtggatgaggggttcttgcttgggtatgggtcaaatgaatgcgcataccccgttttcaacaaaacctccggcattgttgagatcgcgcgtgatgtgacatttgacgaaactaatggctctcaagtagagcaagttgactcacatgtgttaggtgaagaggaggacccgagtgaagcaatcaagaggttggctcttggggacgtacgtcctagggagccacaacaaggggcctcttcctccacacaagtggagccaactacatcaacccaagccgacgatccctctacttcaaacgtggatcaaggtgaagatggcgagcaagtgccaccctcaccgatcaatctagctcacccaagaatccaccaaagtatccaaagagatcaccccaccgacaacatcttaggagccatcaacaagggagtatccactcgttctcgtattgcaaatttttgtgagcattactcgtttttgtcttctcttgagcctctaagggtggaagaaactcttaatcatccggattgggtgatggcgcagcaagaggagttgaacaatttcacccagaatgaagtgtggactttgatggagcgacctcggcaaaatgtgattggaacgaagtggatcttccgcaacaagcaagacgagaccggggtcataataaggaacaaggcaaggttagtggcgcaagggttcacccaaatcgaaggattagatttcggtgaaacttttgcgccggtagctagacttgagttgattcgcatattgcttgcttttgctactaacctcatttttaagccttcctcaacgggccgggcctatcaacgagttggtatacgtggagcaaccaccgggcttcgagaatccgaagtatcccaaccacgtgtacaagctccacaaggcactctacgggcttaagcaagcccctagagcttggtatgagtgtcttcaaaattttcttgtgaaaaacggctttgaaatcgggaaagccgattcaactctttttactaaaagacatgataatgatatttttgtgtgccaaatatatgtcgatgacattatatttggttgtactaacaagtcttttagtgaagagtttagtaggatgatgaccaaacgttttgagatgtccatgataggtgaattgaagttcttccttggccttcaaatcaagcaactcaaggaaggaaccttcatttgccaaacaaagtatttgaaggacatgctcaagaaatttgggatggagaatgccaagctaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgccagatttcaagccgctccgaaagagtgttaccttgtggccgtgaagagaattcttagatatttggtgcacacacctaatcttggtctttggtatactaagggagcgaggtttgatctcattggctatgccgatgcggattatgccgggtgcaaagtggataggaaaagcacatcgggtacttgccaattcttgggtaggtctcttgtttcttggtcttccaagaagcaaaaatctgtcgccctatccaccgccgaagcggaatacatttcggcggggagttgttgtgttcaacttctttggatgaagcaaaccttgagagactatggcctaaatgtgtccaaaatcacactcctatgtgacaatgagagcgccattaagatagccaataaccccgtccaacattcccgaaccaaacacatagatattcgccatcatttcttgagaaaccattcaacaagagacgacatagacatccaacatgtgagaaccgacaaacaattggcggatatctttaccaagcttttagatgaagctaggttttgtgagttgagaattgaactaaatatcttggattctcggaatgtggcttgatctattgcatgcatgtttgtttgctagaataggtttgcataccactttgtgacaaaatggacattcaactcatggatggacactagtcatatttgtggagatcttgaatctatgtgtatggggatctcatttttcaatgaattttgttcctaacacaatttgaaatagattcacacattccctctctcgagggtgaattatcttatctcatggtaattccctctcttttgatccctcggatagatcatttgatttgtggctattgttttgtatgcttgtgtgtgctagccgcaacttcaaatggagcctttagtgctcgaccatccctccattcctttaatcctttcaaaactccttgtgaaaagtgtttttgacaaaaaaaattcccggtgctagtcccctgcaaaattcctttagaaagtttgcaaaactgtttcttcaaaattcccagcgaaatccctttgaaaaactgttttccaggaattttcggactttccgaaaaattttcggacattccgaaaatctcctgtcctgtcgctcttcattcaaagctatcccaggatttttcggacattccaaaaaatcttcggatatatccgaaaatctacagaagcgtgcgcaacctactggatcctttcggacttatccgaaaattttcggaaatatctgaaaatatcggggtctttatatttcaccccgtggactcctttctccctcctttcaactctttttcaccacgggcttgactccctcctccgctccccaccggtgaccacctcctctccgacgacctcccgcggctcccctcctctccatcctcgtgggagcgcatttggggcactacttgggacctacattgttgatcttcaccgcgttcttcaagtgttcttcgcgttcttgaggtatccaccctaaaa

SEQ ID NO: 24436 - DNA, 5300 bp, Oryza sativa
agctcaggggtaaagttggaagattagaaagtgaggtcaagagcaagtacacagcaaagccttcacaagtacagagcaatgaatatttaggtagcacacatcttaaagcacaccaacgttccagatttaaggtgaagtgaaccttggttcacatatataggtaaattatgtggtgctccatgaagtatgggctccaattgtatccaccatttatctgctttaggatccgtgctactcaaaacagcatattatagatatattagcgggttaagatccagctttccatttgtactatacgtgcatggttcgcgcacagctagctgtttccatataagcttgcatgcgtcaactttccaaatgaatatgatcgtgattgcatgaacacaatttatttccaaattatatgtacataatcaaacccactaatttcgatgtaattgctttattttcatccatactattaatacttttctatttctagtgtatatatatatacgggcagagatgtcattccatcttttacacactccaatttcatatctccacgccgttacaccgccggacgtcgacaatcttcttcgatgcaaccgttggttgtccacgagcatcgttgctgacgacgttcgaccgtgaccttcgtcgttgcaactagtcctcggcaacattcgtcgcgaagctattgcaccaccggatatgcaatagcttcttcgtcgcaggctgctgatcgtcgtccgcgagatttgtcgttgacatcgtacgtccgcgagcttcttcttcccaaccaggcctccacaatcttcgttgtcaagctgttacgctgccagatatccgtgagcttcttcgttgccgccgctggtcgtctgcgagctttgccgcagccactggttgtccgcgcctttcgtccgcaagctcgttcgtcggcccaatacgtcgttggttttgttcatggataaggattttttttttccaaatccaatatttgggtatatatactgtttcaaattttggttcgaattttaggatctaatgcacttccaaaattatttttcatgctacggtatttatttctgtgttctcatacccaatatttgggtatgtgtacttccagaattatttttcatgctccgggatttttttttggttcatacccaatatttgggtatatgtacatgtttacgtgcaaattgggtacgtacccaatatttgggtatatatattcaatatttgggtatatgttcaatatttggatacatacacgtaaaattggatatatacaaaatatttgggtatataccctgatgagaagtatatatacacaagtctttaaatgggttatatacccaataataagagtcatggtgcgtcacacatactctataccagtataatattatggagatggtcccacatactcgacgtgcatatatagcaaaagaaataaggtacggtatagaatttaaacaaacatttttttttttggaaaacacatgggtgtacctaaaatataggtacatgattcctggaatatatgtcacgtaaaattaatttgttcaccaaacacaaccgatttgttttagatatgttgacacgattatactctggaatacatgcgtatgtcgtgtacccaaagtcacgaagaaaattattatttcagatacgttcacacgaattgcctgagtatatttaccttcctttcattaaaaaaaaatactataaaaaagtttcatttataaccttttcacactatatacggaaataaatgacatactcaatcgtgtgcatgtgattaaacatcattaccatccataattaattacgcctatgaatccggtaccttttcatctaagtatatctgattccatatatcataagctactaatgggcagacccgttaatatcatacccacatcaactagtttgatcaggatcaaatctaacggtgattagaattggagcccatacaccatggtgccccaaatgggctatatatatactccctccgtttcgaaatgtttgacaccgttgactttttagtacgtgtttgaccattcgtcttattaaaaaaatttaagtaattatttattcttttcatatcatttgattcattgttaaatatactttcatgtacacatatagttttacatatttcacaattttttttgaataagacgaacggtcaaatatgtgctaaaaagtcaacggtgtcaaacattttgaaacggagggagtaggaaaattagaaactactaccaggagtagctactccctccctatcctccctcaattcgatcgctagcactagataatgctaatgaccgttaacgggtctaatgaattgaatactcccacccgtttttatttttctcggtggttaacttatcttctacagcagattcaaaaattgaacgtagcctccctagtttgttgtatatatgagatttgatcggagacgagctaacaagagatatatccgggtggttttttcgcacttatgtttgtttatccacagcgagaaagcaggatatttctcccatcatgaaggaagagcagaacattatctatctaaaatcgttctctgcgtttggatggttcataactgaactgagctcagattagtagcctcaccggtggctgtgttgtagataacgatgaaagctctagcatatggagaattccagttctaagatttgctgcttattttccatcctttggattcttttcttgatcgtttctattcctaattcgttttctttatactccctccgtttcgttttatttgacgtcgctaagtcaatccgaaatcattctttttatttgacgctgtagttcagtcatactgctggtttccatctttgccctcctcctcgccctgattcctcaaatccggccgccgccgccgccgcgagggatgccggcctcgcctgcgcgatatccgctgaggccagcgccgtgctggccgtcatgcgccgcagcctccgccacccgcgcgccgtagccgacgacgccgcggcggaccacccgctcgtctcctccctcaaggcgctgcgccgcctcgtcttctcccccgccgccgtgctgcggcccttcctctacgcggtccgctccgaggacgccggcgccgcggtcacctcggcgtcgctggccgctctccacgaggtgatggcgctcatgggtccgtccctcacgagcgccgcgctgcgtgaatgggcctgtcgccagctgccggttcgaggccggggctgatgccgccgccgaggaggccgtgctgatgcggatgctgcagtcgctgctcgcctgcctgcgcgcacccgccgccaccgccctcgggaaccagcacgtctgcactgccgtcaacacgtgcatccgtgtcgtccaccacgccggcgccaagggcgagctcctgcagcgattctcgcggcacgccatgcacgagctcatccgatgtgtctttgcccgcaaccggcgaggaggagaacatacgctcctggtgccctggtgtggtttctgttctttgtttgttgttcgtcgacaaattatcaacttcacctaaatccttttcagacgattttttctcttctttttccaggaacatgttcttgatttctgattgcagttcattttgggttacctggataactgcaactgcaattcagtgctatgaagtcacaataatcccaacctcccttcagaacagagcaagtcctgagactgaaaatgtgttcaacgatgccttttgggagagcctggatgctgttgtcaatgcgttggacaatgttggacaatggaatctggaactcttggtgctaaatgtaacacacagatggtgatacctcacctaacacagaacttttggtagaaatttgagatgtgagcatgcctatttgagcatttgtgtagtgccaaattgtttggtagaaattttggagtagttttcaatagaatcctgtgagcttgaaaattttgtattgtgtaagtaagacaatttggaattgtgtctgtaatatcaattggaataatggcaatatgaatggctgaataatgtcaattggaagaaatcatatactgtatctgtagtctgtctgtattgtcagttacaaattacaaattggaatactgaatgttgaatgcaaatgaactaagattttttacacaatccaactttttttctccaaatataacaaggtcagaaataagcatcagtagtcaccgatccggaatcaagaatcaagaatcccagctcacacagcaagcaggagtatatggaacaagagacagtggagaatcatgcagaacaagagacagtagtgaacaagagacagtgacatgttcatatcaacaacagcaccagcaattgctaatctggatagtgtttcagattagcaatttcaattaccaaaaagcaatctgaagcacaattttggcaacgaataaatgatcagcacatgagtaaaattgggtagtcactgagctcaacattcactgagtaccagggagtacaatgtagagtagcacaatatgttaagctagaatacttaggtataatccaagaataaattaatcttagaataaattacacatgaaggagacttgaacacatgtttatttttcctctatcattcttctcccactgattctccctctccttgcctgtagagaaaagacaccgataatatgtgatcaatacacatcaagcatttggtcagaagactttacagtctaagttttaacaaacaatgctagggagcataaagtgtaacattgctgatttcatatgctcaggattgttacagcaggtggatttagggaactccaaatagcagagagaactcaaatttgccgcattctgtaccttcctgatcacaagaacacagtccaaaatacaagctctgaaactttgaagcaaggcatatgaacaaacagcaaccaaataatactagtcctatgaacttcataatacacactgaataaatgaacaaagatggcattaatgagcaagccacggagcacagaaaactctgcataaaaaaaagagtaaagtccattaccggtccctaaacttgtaccgttgtgtcatcccagtccataaactcgcaaatcgactgttcaggtcctcaaacttgttcgactgtgtcatcccggtccctaaacttgcagatcactcgtttaggttctccaacttgttcagttgtgtcaccccggtccctaaacaggacggtctaaaaactttatataaaaaataattcataacattttcatgtaaactctaatgaagacaaactttatatcaaaattgtaatcct

SEQ ID NO: 24437 - DNA, 3828 bp, Oryza sativa
tgtctctcaaagatgtatattttcttttggatcctcaccaaggcaaagtgtgccagaatttacccctattctaaggctgatatgtggagcttggtagggataaactggtgacatacttgcatcatatatattgcaaagccaaaaatatggactcaagaagatcatcaatcatactcctagatcaaggatctttatttgtggttgaaaatggaaaagtgaaatatgttgtggaatgatggaataaagaaatgattctcctttttcctatactttctctccaaattggttttcttggcatgattgtggagggggcatggctatattttctttgctcaatgttttgagagcaaattttatttccttcttttttttcttttctcttttttttcatagccatgcctttcccccttttgtcattctttttttgccaagaacttttccaggagaagaaagcatagtccaatgtaggagtttatttgaatggatatttttgtggaaagccaacttccagtgtagaagcttagccaattttttttatatgtggaactggaaagtggaaatgatagtgaccccttgatcatgagagtatgaaagatatttaacacaagtcacacaattttgacaaagctcaatataatgtcaagcagtcatatgcatgataaggttgatcattaatgtacttgcatatggccttggtaggtataaggtaaagtcaattggaggattgagccttcttaaaataattttatttttgaaaataaattcccaagagtcataaccatgttgcaaggattcctttcatctttaatcatctcacataaagcaattacttagatgtataaggttcccaaaacatggatggttgttcacaagcaaagttcagctgagaataatgaatatacaagatcaatcacatgaagaatttcattagttggaaattttatctcttacttatgcttgaaccaattgtttctcaattttcagctctagtactataccatggtggagatatacagatacaagacatgctcacctgcttacctgtgaaaactaggaggtattggggccaacactagttcggccgaacctggtggttcagccgaaccactatggtgcccaatacctttgcaattttctgtagagttcaatgccttccaggtgttcagatattcagcaattttcagtgtatacacgtcagaagctgggatatctcccccacacttattaaaaacctaaactttattaaatataaaacaaaaaaaaaccttggcaaacattggggttaacaccaatgagccacattatttgtagcaagtgcttacatgattggaaaaataaaaccaagcacctactgctattttattcatgggaaaggaaacatctaattagcataatacttattttccttttccatcactatgaatgcacgcttgatcttagcgcacaaaccgcgactacgggtatcaaaattatttctaattttagcgagttctacccctagctccgcattgcgatccctaagctctatgttctccttgcagagtttcttcacttgagcggcgagcttgtggattgagggctccggcgatttcacctcatcctcttggaattggccaggagccctcacaattggagggggcgtcaaatgaagcttcaccttgataggtggagggctacgggactccgctgccccctccttctccgatgccattaaaggccggagtaaacccttaccatacccaccgccgggagttcgtactccctgaatgcggaaacgctccccctttggggtggatggagtagcggtgggtgtggtgtacttgtggagcacctcatcccctgccttggtgaagagggtgcccacaaagcgctcggcgggaggcggtgcggccttcccgtcatcttggaaaaggcatcgtgcctttaacaagccgagctctcccgtagtcggccgttgtgcaggcgaatccccctggatttttgttcttgtaacatggcaaggggagagggatcgcgctgctgaacgggggccgattggggccgagaagggttcggccgaacccctggttcggccgaacccctggttcggccgaaccagggagctcgatgatcggctccaaattcgcaagggagcctgacacagctgcaaggggttgagcccatacaacgtttaccccttccatggtgtagtgttccatcgggatcaattgattcgccggtttcggctctccggtgaggtcgtaaatggaattggaggaagagccaatgaatgggattaggaatttgctagccattggtggatatgagtggaaattcaaggaattggattgaataggagaggagagtgtgcaaaggtggaggaaaggaggaagaaggagtgttttggtgtgatccgaacgttgtaccttcaaacgcgcatctaaacggactaaggacgagcgggggagaccatcattcgaaattgggaccgattgggaaccgccatggctcggccgaaccaccctggtgggtccggctggccgctaatttttccctaggtcctctaaaacctattctaagcacaaaaatgacaactatacagggttttgagcatgcgttagatgagatcatcatggttcataattaattaattcaataacgtccacttctttatctaaagttttatttggctcaaggaaaatccttaaacgttgaccgtttaccttaaatatgttacctaagtcgtcgcagagtgtgattgccccgtgtgaagaggtgttgatgacatcgaacggtccttcccatttgctgcgcaattttccgtggccgaaaagcttaaccctggagttgaacatcagtactttgtctcctggcttaaatttcttgatctttatccttttttcatgccagcgcttcgtcctttctttgtatatctttgcgttgtggtaagccttttctctccattcctcaagttcagcgatctgcatttttctccattctcctgctccctcaaaatccatgttccaattcctgatggcccagtatgctctgtgctcaagttctacgggtagtcggcatggcttcctgtaaactatctgatatggggacattctaatgggtgtcttgtatgctatccagtatgcacacaatgcgtccggcaatctatccttccatcctgttcccattttattgaccgtcttttgcagaatattcttgatttgtttgtttgatgtttctgcttgtccactggtctgtggatggtaaggagtggccacattgtgtttggctcccatttctcgtaggaggtctcggaaggttttgtcaatgaagtgagaacctccgtcacttatgaccattctgggggtatcaaatttagggaagatgatttctatgaacatcttcttggcatgcctcgcatccgtagcgctgcacggcatagccttaacccacttggagacatagtcgactgccaccagaatgtactcgcagttgcgagacttagggaaaggtcccatgaagtctataccccaaacatcgaatatctcgacttgcaaattgtatgtgaggggcattgcatcgcgagcagtgattcctccttgcctctggcagctggtgcatcttctgacgaattcttttgagtcttcgtacattgttggccagaagaaaccactttgccaaatcttggcctgggtgcggaatacaccgtaatgaccaccataaggtgaggcatggcatcgttctatgatcttcagtccttcttcagttggcacacatcttcgtagtaggccatcggagcagacccgatataggtatggctcatcccatatgtgacgacgactttcatacttc

SEQ ID NO: 24438 - DNA, 8727 bp, Oryza sativa
aagtgagaacctccgtcacttatgaccattctaggggtaccaaatcttgggaagatgaattctgtgaacatcttcttggcatgcctcgcttccgcggcgctgcacggcatagcctcaacccacttggagacatagtcgactgccaccagaatgtactcgcagttgcgagacttagggaaaggtcccatgaagtctataccccaaacatcgaatatctcgacttgtaaattgtatgtaaggggcattgcatcgcgagtagtgattcctccttgcctctggcagcttgtgcaccttctgatgaattcttttgaatcttcgtacattgttggctagaagaaaccattttgccaaatcttggcctgggtgcggaatgcaccgtaatggccaccatagggtgaggcatggcatcgttctatgatcttaagtccttcttcagttggcacacatcttcgtagtaggccatcggagaacacccgatataggtatggctcatcccatatgtgacggcgactttcatactttagttttcgttgattttcccctggtggtatgtacttagataccatgtagttcactatattggcataccacgggttggagtcgcgaaccgtcatcagcatatcatttcttaagaaatcattgattggctgttcctacatgttagtgatctgcagcttggacaaatgatctgctacagaattttctactccctttttatctttaatttctaagtcaaattcttggagcagcaaaatccttcttaagagacgaggtttagcatctttcttagtgagcaggtatttcaaagcagcatgatcagtataaattatcaccttggctcctactaagtaagatctaaacttgtcgatagcaaaaacaaccgtgagcagctctttttctgtagttgcgtaattcaactgggctctggttagaattttgctagcataacagattgcatgtgtccttttatccttggtttagcccaagaccgcagcaacagcaaagtcacttgcatcacacataatctcgaagggtagggtccaatcaggaggttgaatgattggagcaaaaacaagtgcctttttgagaatttcaaaagattttaggcacgcgtcatcgaactcaaaaggcgcatccttggctagcaaatttgtcagaggtctggcaattatagaaaagtccttaatgaaccttctataaaagccggcatgacccaagaagctgtggattcctttgatgttcacgagaggaggaagctgatctatcacatcgattttagcacgatcaacttcgcttcctcgttcggacactcgatgcccaagaattatcccttcacgtaccataaaatggcacttttcccaattaagtactaggtccttttcttggcatcgttgtaagactttgtctagattctgcagacaatgaccgaaagtctttccataaactgagaagtcatccatgaagacttccatgatatcctcgatcatgtccgagaaaatagacatcatacacctttggaaaggtgcaggagcgttgcatagtccaaaggacatcctacgatacgcataggtgccatacggacatgtgaatatagtctcactctagtcctccggatggatgggaatttgatgatatccggaatacccatcgaggaaacagaagaaggaatgatttgccagccattccaacatttcatcattgaagggtagcaggaaatgatccttttttgtagccttgttgagtttcctgtaatcgatacacatcctccatccggttacggttcgttgcggaattagttcattttgagaatttgcaacgaccgtcattcctcccttctttggcataacctgaactttgctaacccactcactgtatggtacgggatagataatcccggcatgcaggagtttcaagacctctttctttacaacctctcgcattgcattattgagccgtcgttgaggttccctagagggagtactctcgaggtcaataggaatacgatgggtgcaaagcgcgggattaatccccctaaggtcctgaagcgagtagccaagaatagaacgatgcttttctaacacggtgagaagacgttgagtctcgtcttccgagagcttgtcactgattatgacaggagcctctctgtcattgtgtaggaaggcatatcgtaggcctggaggtagaggtttaagctcaagcggaggtcgaggtgatggttccatgattggcaggtcgagagtctcaccgggatctgcttcttccttgatgaagtcggggacatcatcttctagaagggcctcgggagactcatgaggaggaactgcagtaacctcttccgctgactcaatttctgggagagggtcggtcaaggtgatccttgcccgcgaaaatagaattgagaattcattctctcccagtgttattttgaggctacctaatcggggtgtgttgatgagaagtttctcaatggacagcccgattaggatatcaaagtcttggacttcaaagacgtggaaatccaagatcgcctccctgtcttcaaagcagacaagcacatcttgcacaatcccaaatccttcgatcatatttccattcggatgcttgaagaatttgtttgtcgaggtcactgccttatcacttaaataagcgaatgcaaaagactcagagacgaggttggccccgacagttggactgtagagaataccgacatcgttcccttccagatggcaaggaatgattcgggagcggtatttatccgaattacttcggatgaaagctctgcctccctttgccattcgtcgctcattatggatgtcaactcccggacagtttctcgtaggaacccgagttccataggatcgggaggtgacaaaggaacgggtggtttcctcttgctaaaatagttcagggtattgccgtagtctacgtcaaaaccgtccctgaacataattgtggcacaatccggagtctgaatttcttcattcttgacggatggctgctcaggaaccttctcatcaatcgagctagcagaagtggacggttcagcaaatggctcgatcgttagaggttcctctatcttggacacggatgcctccagctggggttcattggactgcgtcatgaaggaagtattttctagaatgcgatccaagatcgtttttccttctgacggcgttttatgcatgaatgatcctctagcggttatgtccagatagaatgcagactccttatccaaacccgtatggaaatgttggagaagcacatactcaggtaaggacagggttggtccggactgtactaaattagtgaatctggaccaagctgcaccaattgactcgttttcgatctgcttgaaattgagaatttctactcgaagggcagtaatacgagtaactgggaagaaggcaagacagaatctatctcgcagcttttcctagctaccgtttacacatccaacggtagaggtgtactatttctttgctctctcttgaagagagaacggaaacaatttccaccgcacagtttcttgtctcatgccacgaatcttatggcatgagcagacttgttcaaagtctcgcagatgatggtagggattttttagatcaaaaccagaaaaaggattttccctaaccatactaattagctcgggacgaatttcatagccagttgtataaatgggctccgatgaaggaggtggctcatagaattcgccccgaggagcagacagctcaaacagaggttgcacgatggtcgagaagagtttgataggaatacttctctaggatagcaggggtgaaggtagaataaaaaaaatgaaaaaggatatgaggatgaactgggtttggaaatgatcagcaaccgttccctggcaacggtgccagaaatgcttgttggtaattgatacggttacagataaaatccgcaagcgcacggatataccgatgtagcacttcccttacggagtattccaagggtatcgaatccaagggaacgtgtgtgatcagacttcctccggttcatccaaggacaccaagcaattgataggccaggatagagaggatttactagtgagaaactgtttctagggaaagcttatttttaatcctaatgcagtacttcaggcactggcaacccgctgttcccagatgtcgctctactacgtacccggacaaggaagactttagtgatctcgagggctgtcaccacctctacacccacctcaacgtactgtgggatacgcatcaattactggataacaattacctaaacaaaacgtctaagcaattactatctactttagtgtttataactcaccaaagcaatcactatattttagttgattatagtgaacaataatcccgtatgctatttaggaactaaccaagagataattctcacaagataaatctaaattactcaagaagaatattataatgaattcagagtaataaacagaataaaagaaataggagaagattaccgacaactccggaattcttccgactccttctactctactctcttcctattctagtatacaatatagtacaataaagcctcttataattcagctcaagcttggaagtgtgtgtgagagtgaatgaagtgaggtcctatcgtagggcagttatgatggttgtgagaaggggaaatgtccgaactgccccgcaaccgccatcagggagtgatctgggatgtccatgccaaaacctgggatcaacggcgatcaccagggttcggccgaaccagggggttcagccgaacctgggctgggccctcctggcctgaccttcggtcggtggactccctggaccttcctctatctatttcttggagtttttggttgatttactgatgtttcgatgatgttcataacccctccttgtatggatacataattctcctcactttagtctgattttcctcccaacttcagggtttatcatctgcatacatatatacaccaacacttatggaatatgtgagattaagcacctatctctatgtacacttatggtatagaatcggcatttaacagccgccaacagggatggcgagttattatgtaactacttgtcccatagcattggacggtttgttgtacggatgctccctgctcaagcaataagtaattttttaactcatcgtagggtttcggatgatctcggttattagtatggttttactgtgtaaatttttaacttagattctgctagtccattgatgtatgctacacccttttggatgggtaactacttaactcttcgcataataaccttgcaaatgtgtatagacaagaggtgtgctggacgactgagttaatttttaactctagtcacgtaggatatcgaattttgatcctgtcccagtctgtctacttgttaactgttcagttaaaaagtaacttatgtgtccggactctggtgaaaacaatgaacgttgctgccgacaaacagacccatgtttgttgtgctgagcgagttaaaaaaactccaaaatgagtaaaccctaaaaattatgttgtttgctttatcaggattattgaaagaagtaggcagttagaaatatacatgacagcatattgcacaaaagacatgccaggagataatatatatgggggttgtcattctaaccagtaggatcgaactgtacaatgaccaatgacaaaatgatgtcttgtatcctgaaaatgaactggtaccacactagttgtaaactgtggtgaagcctgaagacatgagattatagcatatgacacatcctgtatcccaatgaagaaagtttttccaaaatggtaaaaagcacaactatttttttaggcgacaggatcgacaacatcggatcggcggaacatctcgatgtcaggatgaagaggcgcggcttggttgtactcgctgaacatcagctggtggaggatgcttgaccggacaagcgacgagttggtctgcgaaaagaatgttgttcgtgaattggtatataataatgtgaaattgagcgatgaatgtgtcactacaccgatgctagggtgtgattgctgtagttaccgggatggaaagagtctcgatagactcccggttgccgtcgtaagcctccatgaaccgcaccatgtaaaatgcacagtcgttggagcatatttgcatttttgggcacttcatcatgttcctcctgaagtcgccgaacctgcagaaactcttaggcgctacctcctgcagcgcatcgctcagacccttgacgatgcgtttggacaacgcacgatggtggtcgctctccagtgttccaatcaaaaggtagttgttcgaatccataatgtccacccgcctgtgtgcaatgttgatggcgtacagagaccagtggtcgtggtggagcacaggtaacattatctatccattcagggattgaaaagtaaaaaggcacgaaaaattgccaaatatatttgctgggttcaagagatgctcaatgaaacggcaaaaaatatacatggcattaggcttgatgcgaacactaaaccctaactaatgaagaagaggggggttaccatctgagtcttcgtcatcggaacgttctggatatagtcgcgcaagtttccggccaaagcatcggcggagaaatcatgtgtctcaccattttgtttgataaagtcgttgttcaggagatactgaaaaaaaaaagtgaggccatttgttgtagtgacacaaaaagggcaaaatcttgtgaaaaaggagaggcaaacaataatgttgctgcaccgtatggaataaagaaggaaaacaattgagcttgacgtaaatcacgttaccgagacagaagtcggtatgaaaatcctttttccaaaagtatctggcctgttcctcatgtcttccttgaacagaatcgagctgaacgggtctatgaatagcccctctgtcagattcccattggagaacgatttgagtacatcgtatccatacgcaacggagctgtcaatctctagcaatttcacgctgcaagcataccatgaaaaaataacacgaaaacccgtaaaaatgaaagcaagccaaaaaaaggaggggggaacggatgaaaacatgatgcaccataaggacataatcaatagtgtgatgtacaccgacctgtccatacgaccaccattggtcaataagaagtccctgagctgaacgctcagcgacacgtcagatggcatgatacttgggccaacaaccaccggcgacaaaaatcttggaggctttcgaataaaccgctttggctgagaccatggtgttgaatttacgacatcggtgtcctcattggtctcggccaatagctggcagaaaaaaaaagtgtttaaggtggaaaaaaaaggttaacccaacgtagttgtcgatcgaactaagtgaaatgttaacttccatctttacgtgagtcactgtatgactccacatgcatatcacactataattgttgactgctccttttatatgtgacaaaaaaagacagatagttgaaaacatgtgtggaaaaagggtatttcagtaataagttaacaatcggttttgtcattgggataagtctagaacagagttttttaagttggagttaattatttactctacagttttgcttaaatgtacactagcaaaattaccgttgtgttgatcctaaaaaagatgaactaaatgaattataacttaactcacaatgaaaacttgttgagtactcatccatatgtaataagattatttgtttgaaccacttgctgacttattgcttggtcagtggagttaagacatgactgcctaactataatttattactctactatttgttatattgtacactagcatatatacctctgttatattgtgcactagcaaatataccctaagtgtacatgctccagccggtgcaaaaaaaatgtgtgcagggaaaaacccaactatgtgaataggaatttatgctatgaagcacaagtgaactcattaaaaatggatggttgggagtacaacctctgacagtgtaggagccccctcgaccctgcaaatctcctcgattttatcgtacacttgtgtgtcggttgtcacgtcccaaaacgaccctaaaatatatcccttaaattatgcttagaataattaaaatcctagtgaaagcctccaaaaattaaaatgtgcaaagctaaaagtcaaataaggcttggaggatttttgtatatttcctaaaagcctaaaatgtgtaaataaaatttagtggaattttcagagcacaaataataattatcaagaaataaacaaagttaaaaaggttttataaaaagaaaaacaaccctaaaaccctcgcccctctctcttgggccgaattcggcccaactccctccccctctctctctcctctccccgcggcccactcggcttctccccgcgcgcgcgccgctgacgggcgggcccgcccaccaccctcactgacgggtagggcccacccgtcatccccctcctcccgccgctcccgctgctccctccgcccgcgcctagcgccactgccgccgccaaatccgccgcatctagccgccctcgttcaaaatcaagtggggggaaatgtttcccccgattccctctccctttccccccaattttccctccctctctcccttggattcgtttggaaaccccttccctaatctcgccggcgccattgatggagctcaagaatgccgcgccggtttccttcccctccggccgccctctctcgccccggccc

SEQ ID NO: 24439 - DNA, 10171 bp, Oryza sativa
ctcaattccatggttcccctagtatgaatttaggtagatgcttcgctgattaattaggcaacattaggtggttttataatttttagactttgggaattctcatatcacctggacactatggaatgattagattatgtggaaatggacacacacctccccctcctttcaaaacccccaaaatggttttaggctgggctcgaggtacatggttttgatagcagcacctcggccactataaggaccggtcttcggggctctgttacaaagcactaccgtacttccacatgtctagtgggtaaggcctagtttgtagctcagtctggtcataaacaaaagtacacggatagggatggacgaagtcggggctcgatggacatctctaggacaaatgaaggctacataagctgcggcctagtagtcgagatgtcataacacagggttggtgtcctgctgctaggggctcaatcttggttacctgtctcgggaatcccggccgtagccagggttgggtcggtactcttgtttacggctaggatgggttgggaactatgtcatgtcctccgtccgtatgccgtggtggtatgtggcacgtggttacacgtgaggaagatgtgtcttgtgggtaaagatgtacacctctgatcagagtataatctattcgaatagtcgcgccctcggttatgggcaagcctagcaatgtacccaagttagtgttttaattcctaaaacctgcttaacaactaaaatgtggaatggttagcctgggttggcttgggacgagctgggacccagggtcgggttgccagttctgtctgaatcatcgtaggccttgggttaaggcaggttcgtgtgggttcacggccttgattaacaacattgtgtagcttcaggatcgcctttacaaaatggccctgagcaactaaaagtcttggaaatgctatttactgcaaaccctaacccctttattataactcccttgtactcctttgcatttattctgcattcgtgggtgtttcttgttgagtacggtggttgtactcaatcttgctcaatttttccccaacccagaagtggagttcctggaggatgaaggctttggtgtctagctcgtgcctgccgtcaagtgcctgtggtcgtcgccctagtcttccgctgttttccgtttgtcttcgtgtgtgctgggccttcgccgcccatgtaataatttatctatttacacttctgcttgttaaactctgaattgtatcaacttttggtgtaccttgcctcctgggacaaggaataatacacgcacgtatggaatgcatgttgggttaattccagtcgtgataagttggtatcagagcctccttgaccctaggacgaaccctagaacccaagccttagcagtattttgaaataaaaatcatctcttatttgtgaaaatcctttagtctctctctgtcttgctgcttcatttctcatcaaaagctgatctctaaaatttttacttttgtctttatttatagatggccgccaacctcaaccgtcgtggtctggatctgactggctttgctttggagctgcggggcatgtgcgttgtcctgggatatccgcatggagtggactaccagggcaagaggcttccggagcaggatggtgacgatgcggagccccgcgccgcttgggaggtcactgcgatgatcctcaccggctcccctaagaggacttcgctggccgtcaccgcgggtagggactccttccccgccacctgccagaacgctgcactcctcgccatcggcactcttcaccagcgctacccggacgagttgcagcactcgccctaccgctactaccctcgtcgtggaggagcccgcgactacgccaccttccaggatgctagctcggaggatgacgctaccatcatgcatctggcgcgcatggtagaggcgtacgacgcggcccgtatcgacttctaccgcatggcgcgccgtggcctggtcgagaacaacatgaagatcctggagctgcgtcaagagaatctgcagttgaaggacttggacgctatggaggcgcagctgtgtcagctcaagattgctcagggggagatctgccgccccaagcgccgccgcgtttgccgcagctagaagattaccgcccgcaagagtacctccaggcctgagctggttcgtcagtccttggcatggacctgcttcgtggagactccttgcgctgagcctgcgcctgtggttcctcaggagttgggagcctctggcgttggcagcacggaggatgtgctattgctcaccttccgccccgacccatcgcagaagtagacgagcagctagtaggcccgcgcgtgtgttcttttcgtttgttctcttgctgagttgtgtggggcatggttataccggtgtgtggtataactgtgtcggagcctgtctttattttatttgcgtaagcaacttgaaccttaatgaaccaatttaatagcagaaataaatttaagaattatggtagtcgtgggtggttagttttaatcgtcagctctttctgtttgctggttctgtgtggaatcttcatatggtgacaaccaggagaagcactgctaccggttagggcagtcaccccgaaggcagccacaacaacaaccatggcagtccacctccacctccacctccccctccgccgccaccaccgccacatggcaccagccccatcctcacccaaatcctcgcccagcaggccaacatgatggctgctctcctccaccatatctagaatccgccgcaacacaatgctccaccaccgccaccaccacccccacagcactccaagcttgccgagttcctccgcattcgcccacctaccttctctagctccaataaccacgtggatgccttggattggttgcatgccgttgggaaaaagttggacaccgtccagtgcaatgataaggagaaagttatcttcgtaacccatcagctgcaggggcccgcatcgctatggtgggaccatttccaggctacgcagccagaaggacagccaatcacctgggcccgcttcaccgccgctttccagaggacccatgtgccagctggggtcgtagcccttaagaagagggaatttcgggagttgaagcaaggcaaccgctctgttatggagtatttgcatgagttcaacaacttggcccggtatgccccggaggatgttcgtaaagatgaagaaaaacaggagaagtttctggcagggatggaccctgaactttctgtgcgtctggtctctggggactatcccgatttccagcgcctggtggacaagagcattcgcctggaagccaagcacaaggaactggagtcgcacaagcgtcgcttggcgaatttccgtaatcaacagggggctaaccaaaggatccgctacaccaatccctatctagggggatcctcctcacagcagcagcagcagcagcctcgccccgtgccacgccctcagtatgtggttcgtgtcccacagccgcagcagcaacggcagaatcaacaagggaaccgtgcaccccgacctcctgcaccggctatgcagcctggtcaaggtcgcaaggatgctcaaggccagcagcgtctgtgcttcaactgtttcgagcctgggcatttcgccgataaatgcccaaagccgaggcgtcagcaaggcccagcgccaaagccgaggcgtcagccgaggcgtcagcaaggcccagcgccacccggccccaacaacggtggtaaggatgccacccggggtcgtgtgaatcacgttactgcggaggatgtcctgacaactccagatgtcatcctcgatacgttcttcattcattccatccccgctaccattttgttggactctggagcttcccactcatttatatctgtgcaattcgtggggagaaatcaactaagggtagcaaagcttaggagctctctgctcatcaccacccctggaggggctatgacagcaaagtattatagcccgaccatacctatagagatccagggaatttcttttccctcggatctgatccttcttgacaccaaggacttggatgtgatcctcgggaagaattggttaactaaattctaaggagtagtggattgcgcaagacgtactgtcactatgtaccggaggcctgatcaaccggttgtcttctttgcgcacccaactcccaccggcaactcagtacttcatcagctgggactgtcagaaatacccgttgccagcaagttcagtgatgtgtttccggaagagctacccggtatgccaccaaagcgggagattgagttcaggatagatcttgctccaggaaccactcccatgtacaagcgaccctaccgtatggcagcgaatgaactggccgaagtaaagaagcagttggaagggttgaaagagaaggggtacatacggccgagcacttctccctggggtgctcccgtgatttttgtagaaaagaaagacaagacaaagaggatgtgcgttgactaccgagctctcaatgaagtcactatcaaaaacaagtaccctcttccccggatcgatgatctattcgatcaactcaaaggtgcctctgtcttttccaagattgaccttcgttccgggtatcatcaattgcgtatccgtgaagaagatatccctaagactgccttcaccacgcggtatggattgtatgaattcacggtgatgtcattcggcttgaccaacgctcctgccttcttcatgaatctaatgaacaaggtgtttatggagtatttggataagttcgttgtggtctttattgatgacatactggtgtactcacagtccgagaaagaacatcagcagcatctccgtctggtattgggaaagcttcgagaacatcagttgtatgccaagctcagcaagtgtgaattctggttgtccgaagtcaagttcttagggcatgtaatatctgctaaaggagtcgctgtggctcccgagacagtaacagctgtcaccgattggaagcaacccaagacggtcacccaggtccacagtttcttgggtttagcagggtactatcggaggttcatcgagaattctccaaaattgccaggcccatgacgcagttgcggaaggaagaaaaatttgtgtggagtccgcagtgtgagagagcatttcaaactctcaaggaaaagttggtttcctcaccagtgttaatcttacctgatacccgcaaggatttcctggtgtactgtgaagcttcacgccaaggattggggtgtgtgttaatgcaagaaggtcatgtggtagcttatgcttcacgccagctacgaccccatgaaggcaactatcctacccatgattggaattggccgcggtggtccatgctctgaaaatctagcggcattatctcattggaaatcgctgcgaaatatacaccgatcataagagtttgaaatacatcttcacccagtcggatctgaatcttcggcagagaagatggttagagctcatcaaagactatgatgtgggaatccattatcaccctggcaaggccaacgtggtggccgacgcgctgagtcggaaaggccactgcaacgctctttgtgtccgcggcattccaccggaacttaatcaacagttggaagccctgaacctaagtgtcgttagccatggattcctggctgcactagaagcaaagcccaccttgcttgatcacatacgcaaggctcagaagaatgatccggatatacaggagatcctcaagaatatgaagcagggtaaagccactggcttcacggaagatgaacacggaaccttatggaatggaaatcgtgtatgcgttccggacaacaaggaacttaaacagttgatacttcaggaagctcttatgctccgtgcctgtgttctggattttgggaggacctgggacaagagtctcccctatgctgaattctcctacaataacagctaccaggccagcatacaaatggcaccctatgaagcgttgtatggacgcaaatgccggactccgctgttgtgggaccaagttggagaaagccaagtgttcgggactgatatcctgagagaagctgaggctaaagtcagaaccattcgggataacttaaaagtggcccagtctcggcagaaaagttatgcagataactgatgccgcaatctggaattcgcagtggatgattttgtgtatcttcgggtcacgccacagcggggagtgcacaggtttcagacaaaagggaagcttgcacctaggtatgtgggacctttccgcatcatcgctcgacgcggagaagtcgcttaccagttggagctgcctacatccttgggcaatgtgcacgatgtgttccacgtgtcgcagctcaagaaatgccttcgagtgccatccgagcaagccgattcagagcagattgatgttcgagaagcctgtgaagattctggacacaatggagcgtaggacccggaatcgagtaatccgcttttgcaaggtccagtggagcaaccatgccgaggaagaagctacttgggagcgtgaagacgagctaaaggcagcccatcccgtcctcttcgccagttcttccgaatctcggggttgagattccgtttaagggggtaggtttgtcacgtcccaaaatgaccctaaaatatatcccttaaattatgcttagaataattaaaatcctagtgaaagcctccaaaaattaaatgtgcaaagctaaaagtcaaataaggcttggaggatttttgtatatttcctaaaagcctaaaatgtgtaaataaattttagtggaattttcatagcacaaataataattatcaagaaataaaccctaaaaccctctcccctctctcttgggccgaattcggcccaactccctcccctctctctctctcctctccccgcggcccactcggcctctccccgcgcgtgcgccgctgacgggcgggcccgcccgccaccctcgctgacgggtggggcccacccgtcatccccctcctccctcgttcaaaatcaagtggggcgaaatgtttcccccgattccctctccctttccccccaattttccctccctctctcccttggattcgtttggaaaccccttccctaatctcgccggcgccattgatggagctcaagaacgccgcgccggttttcttcccctccggccgcactctctcgccccggccctatataaaccctccccgcacctcccccgtccgtttccggcacttccccgtcctctctctccgccgtcgccgtcgacctccggccaagcctagccgctcgccgggactgtcccccgccacggcgtcgtctcctccggcttcgccgcaccgccgccgatctcgtccacccctccgttttggtcgccgaccgccggaacaccgccgtccccatcaacccgagccgcaccaccgcctccctccgctccggccgcatcctccatcgccgccgtcgcttcggggtgagccgtggaccgccgcttctttcccccttcccttcccctctctcggccgccgctccgccgcgcctatggccaccgccggcgaccataggggcgcgggcgccgcctcccgccgaccgcgccgacgtggccatgtggccgccgagtggggcccggccgtcagccgcccgtgccctcgggtgcggctgacgcgtggcgcccacggtgccagctggtgagccgcgggtgcacccggtccatcgtggaccgaggggctgccgcgtggggcccaccacgcccgtggacccggcccgtgcgccccctcccctcggctgacgcaataaaccctatttttaattaaaattgaaatgaagaaattcgcaaatattcacattaagagcatataaacttcaaatggccatatcttggccgtttgaactcagaattggaccgttcaagtctctgatttttccttaagaagttaagaacccatttttgtgctttgtttctacttgttatatggagtttatgagagtaaaagcctttttctttccgttggtcgtgtagacgctgcagcttcgtaagatccgctcttcgtggaggttgaagccgacgtttgggaaagcgagcaaggcaaggcacatctcctttgaacatattgttgtcctatgtttaaaattattttgttttaaattaatgcattatcgctttatttaaattcccgcgttatcactgttttacttagccatgcctatttacccttgttatgaccttattattattgctatttttattaataccttgttcaccctaggaaaatgaaaccccaactagtgggtactctattcatggttccactagtatgaatttaggtagatgcttcgctgattaattaggcaacattaggtggttttataatttttagactttgggaattctcatatcacctggacactatggaatgattagattatgtggaaatggacacacacctccccctcctttcaaaacccccaaaatggttttaggctgggctcgaggtacatggttttgatagcagcacctcggccactataaggaccggtcttcgggcctctgttgcaaagcactaccgtacttccacatgtcttgtgggtaaggcctagtttgtggctcagtctggtcataaataaaagtacacggatagggatggtgtggaccgagaatagtagacatattggggaaggtgtacgccgctgccctgatatcttcaaccatcggcccctttcccctgtcggcaggcttgttggcgtagcaagtactctccaacggtcgcagctgcgagggacaaatcatggggttagcggcgaacaaaaaaaaagtactgtcgagattgtcaacgataaatgggtgtgtgtggaacattggcatttacagaacaacgaatatttcaaattaagacatgcaaaatagtagaatggtggcccttgttctcgtgttttagatgatgttgtactacacaatgtagttatactgcatactattgagctaaaaatatcaataaaaataagagggaggacaacacgtacggggaggttgccaaaaggcggcatgccgtccctgcttgcttcctgatcagcagcaacgagcttatccacgatgtccttagtaaacatctatatacgtggggtgaaggttaaatcaagcccaatgtctcttggtggcagtatgttgtccagatatttaacccatgtacgcaggcacaaagttagaaaaagaagttgacaaatagcaaacagaccggcgattagcattgaaacaacaatttgctggtaaagaaagatttgataaaataaaggaaatgtcaacggaatggcttaccacgaggaatacgacacaagaagctattgacgatgccgggttttggcgccaacacctaatgctgtcgcttaaagcccggaacacagtcttggaccagtcaatagcagcgactcggtcgaggtcggaggcgacccggacatcgcccttgggcacataaaaatcggtagttggaactaggagctttgacctaagtaccatgatgaaatatcgaacggcctaggggtcatctttctggctcttgatcacctcgatcaactgttttgctgataacctagccttcttatgaattcccagttcatcggtgatgctttcttgaacggttcgcacaaccttgtgggatgggagtacaatgtcatttccaccaagcggggtccccaggacaagcctcacggtgcgaggggtgatctgtatcttcctgtcatcatctattgaaatgcacatttgtcgggatgtcacgtgctgataaattcatcccaaaataaaaatcattctctaaatggaataatagaattaattaaaattagaaaagaaattggcaaacactaaaatacgtacaagaaaaattcgaatgtggtctggagaatttttgttaaattcttcttggtctaaaaggagccctcaaattttatttgaattttcagagcaccggaagtatttattaagcaacaacaacaattaataaagttcaataaaaagaaaaactaaaaataaatcctccttcctcctttgggccaagtctggcccaaagtccaccctctctctctccctcggcctgtggccaaagtctccatctcctccctctctttttccttccctcctctctcttgggccgctccccccgccttcccctcggcccagctccctttccctccccctcccggcccact

SEQ ID NO: 24440 - DNA, 16109 bp, Oryza sativa
  unsure (1)..(16109): unsure at all n locations
cgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggaatattctcatcacctggacactatggaatggatggattattgtggaattggattcacacctccccctctattcaaaaccctcaaaatggttttaggctgggctcagggtgcatggttttgatagtagcacctcggccatataaggaccggtcttcgggcctctgttgcaaagcactaccgtacttccatatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctgcctgtcccgggggtttcggccgtaggtggggttgggtcggtactcttgtttatggctaggatgggttggaaactatgtcatgtcttccgtccgtataccatggtggtatgtggcacgtggttacacgtgaggatgatgtgtcttgtgggtaaagatgtacacctctgatcagagtataacctattcgaatagccgcgccctcggttatgggcaagtcgagcaatgtacccaagttagtgtttttaattcctaaaaccggcttaacaactaaaatgtggaatggttggcctgggttggcttgggacgagctgggacccagggtcgggttgccagtttggtctgaatcatcgtaggccttgggttaaggcaggttcgtgtgggttcacggccttgattaataatattgtatagctctaggaccgtgtttacaaaatagctttgagcaactaagtgtcttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcaccctagtcttccgctgtttttcgtttgtcttcttgtgtgctgggtcttcactgcccatgtaataaattaattacgcttccgcttgttaaactctgaattgtatcaacttttggtgtaccttgcctcctgggacaaggaataatgcacgcacgtaaggaacgcccgttgggttatttctggtcgtgacatcagaaaaccatgacgactcaatggcgagaagctatccttgggatcacaatggatggtggacagaaccatcgttgtttaaatgtgaacactggtactaaagtttgatcaatcaatgctaggtcttaggcttgtgaaaagaattacgaaactggctttgcgcaaagaaccatagccatcctttgaatacccctatcatgtgcattgttgctgtgatggcttgctgagtacggttggtactcacccttgcaatatataaacttaatcagaggccggagatgaagcttcggaggatccctacgcgtactaccaggagggtgatgaagacgatggcgctcagtaggtcttagttacggtcgttgcctgtggcaatggcgtgccgctgccttaactctgctgccttatccacttctgcttttggaatgtattccggaccgctcggtccgatgatctaagactatgcctgcgggcttatgatgtaataattcacactagattctcgtgtatgtgcatttggtatttcagctatgaactcgtgtgtaccagactacttgatccagggaaatggtactgtttacacgattgattcctgttataaaaacgggggtccacagagctggtatcagagccatacaactgtaggaaaagaccaaaaggcgccccacccctttcctagttggccaagggagaaattcccatttagtaatattttcaaaaataaagacgctatgtttacaaaactatatacgattttcatcttactcttaactattttcttcccaaaacgagttttactcttagctgactttgggtttttcttaaaattagatgggagatcaggattcactcactatctgggagatgggcgtaccccgctcagagggatatgtcattgagctacatcggttgatgaggcgcctacggtaccccagatttccgatctaccgagtgagacagtgtggacccgtttgggaggctcggattgaggttcatacacgagttccttcagagtcagactacagctttccgacacgccaccgtcgcgacttacagagaccgcgatgcaggacgcagcccgggaggccttcctccgacgtagctctattcaccgagctgagttggcaagtaccgactttgcttaccatccgtttcgggaggagagcaactatgtctacaaagtctaggatacaccttgctgctacaacccgatggtgactcgactgtcccgatgggctgaggcagtagacgacttctacgaggaggcgctattagagatcgacgaccagcagaggcgtttgggagagttggagaccgaggtgactgacctcacagtgcagcagcttcagctagaggaggagcaccaggcttggggcagtgagatagactcactgaaggtagagctctaggtccatggcgaccagttccagcagctatctgatcagtacaatgatcgccgcgggatgatggatacactcgaggagcagctgagaaagagtcaggagcacgtcagccagcttgaggagcagcttcgagcagctatagtcagcaccacaggagcttctacttcctcagcaatagggcgtgaccgctacttcttccttactccgccatacccaccagcgctccacgctcttttgggagaggttgatatgctagttactgagtcagcaccttacctggtggacccgacagtgacacagccacctgccccagagattgtgcacactccactgatccctacttcgtcaccgcagctgggttccagtttggagactccgatccaggttgactccgagacagaggggaccgacactgagccagagatagagccggacatcactgatccttcagaggacgagactcctgtccaccgcatcacctttatcagaggccctcgcaccctcagcactgctcgcaagagcacacgacccccgggcaagaagcccaagccagatccagaggccactacttccgagccatggggactcaggtttgcacgagccagcaaccaccctctacctgccccaggatcctgcggatggttggatgactagactggaggactattgcagcttcgatctcgcttcagatggtttttggatagcatgcgagacacaccccccctacctagattgacgggtagcttgatgattagttcgatgtatcttttagataaactttatttggactacgtatatgtgcagtcgattgcatcatgacttatgtattatctgtggaactctgtgatgttatttatgatattattactgttgggttatgaatgagtttattccaccatgcttgcaaaacaaagttcacatcaaaacaactcccttaacgggataaaaccataagggctagttaggaaattaggatacttacctcatcggcctacacagatggcaagccgacatcgggcgtcaaccagcaatgaagaaactcaaacacccgacctaaacaccctggccggagtcatggctactcaaacccaacttctgcaagccatcgcaaataatcaaggcaaccgtggaggatcaagctttggagaattcatgaggactaagccacccacattcgccacagctgaagaacctatggatgctaaggattggttaaggatcattgagaagaagctgacccttgttcgagtacgtgaagccgataaagtgatctttgcggtgaaccaactggaaggaccagccggagactggtgggacacctacaaagaagctcgagaagaagatgctggagaaccaagctgggaggaattcactacagccttccgtgacaacttcatgcctgccgctgtgatgcgaatgaagaagaatgagttcaggagagtacgacaaggaaataccactatacaagagtacctaaaccgtttcactcaactggcgcgttacgcaactggagatcttgccgacgaggaggaaaagatcgacaagttcatcgaaggcctgaacgacgagttgcgtgggcccatgattggacaggaccacgatagtttccagagtttaatcaataaggtcgttagactggaaaacgaccggaaggttgtggagcacaatcgtaagaggaggcttgccatgaaccgcccgcctcaggtcgcaccccagtgtcctaaaggaactacctcatcaggatggagaccaacggtggtaacaaccaatcgtcctaccgcacctagcaacttccacaggctggttaccactcagacccaagctcctacaccaaatcaggccgctactggatcagtgaggccaggaagctgtttcaactgtggagagtacgggcatttcgccaacaagtgcccccatccaaacaagacacccattcgcaccggagctaacgcaatggctattcacgggactgctacccctgctactggacgaggtttattcaggactccgcagactaacaggacctctaccggatttggacgcgggcaagtgaaccacgtgtaacatcccggcctagggcttaataggattaatagaatactcatatcaacaagttgcaacttcttttctggaagccaatctctaaagaactccagggttaagcgtgcttggcctggagcaatttgggatgggtgaccgaccgggaaattcttcccgggtgcacacgagtgaggataaagacatgtgttggtctgtgagggcagtctatgacctatgaaagctatcagatgtaagtgggcccggcctgggggaaggcgggacgttacaaaatggtatcagagccgactctcgcggtttcacgggcgcgtgtgtcgcagttgcgcaggcatggtgcgcacgtctggtgtagaccgggagtggttacacagcatggcacatgcgctggcactggacacatggacgtggccaagagaggacgttcctggcctagggttgatcgacgggggagtcgatctctcttaagggggtgagggtgtaacatcccggtctagggcttaataggattaatagaatactcatatcaacaagttgcaacttcttttccggaagccaatctccaaagaactccagggttaagcgtgctgcacacgagtgaggacaaagtgtgcagaaaagacatgtgttggtctgtgagggcagtctatgacctatgaaagctatcagatgtaagtgggcccggcctgggggaaggcgggacgttacaagttggtatcagagccatctcgactgtaggataagccaaatggtcaaaccttaaggacaaattttccgaaaacatgatttgtgaaaataaccttaaggacaaattttccgaaaacatgatttgtgaaaattttcctttcttccttctctagaattctctataaatcattttatcatcctctcccctcctgctttcaacttgagtagttctgaaactagttgttgaaactagaagatgttgatgtggtcaacttatggaggtcagtcaagtggatcgaggaaggaccgaagtgccaagtggtcaagatggaatgaagtttgaatcctaccttagaacctatgccgccaaactatccttgaagaatagttagtagggtagaacgtttgttgcttgcttgtgtgtaggtatggttgcattcccgtcattggtggggttcaatgatgagcgtgtaactatactaggttgcttgcttaatcaacttgaacaatataatggtctacacacatcagatcagtgttaaactggttaagatcttgtctttagtgtaacccttatcctcctatcttctctaatctgcaacagatggtgaacactcgcgccagtggaagcaggtgattggctgcacgttgttgagaagttggaactcctccagtgcacggatcaggagaaagttgttttcgcttcacatcagttgcaaggacctgcttcagaatggtgggatcatttccggatgaacagagcagaaggacaaccaatcacttgggaagagtttacaaaaggattcaataagacacatatacctgcaggagttgttgctttgaagaagcgtgagttcaggacactgaagcaaaaggatcgtaccgtggcagagtatcttcatgagttcaatcgtctggcacgttatgctccagaagatgtgcgtactgacgaggaaaggcaggagaagttcttggaaggcttgaaggatgaactgtcagttacattgatctctcatgactatgttgattttcagcagctggttgacaaagcaattcgacttgaagacaagaagaacaggatagataaccgtaaaaggaaaatgactgtattccaggaggcacaaggtagtagccagaggcagcgtatcaagccactccaaattggtgaaccttcttctgcaggtcaaggacagtcgcaacagttgaacatcggtggtgagatcaaatcagagactaatgaaagcaatgaagttaacatcgagcaagctaatcagccggtgctagttcagcaggaccagactcaggagaataacagtagtagaagggagcagcaggtatgtttcaactgttacaagccaggccactttgcaagagagtgtccgaagccaaagcatcagcagccgcaagtcaacaacattgtcgtcacaggagccaatgcagtgccagttgcgtcttcaagagttgcgtcttcaagtgttacagctcagccaccagtttcaaagcagcagtagttttctttaaagccttagaataattatctgagttatggaataataagggtagactgcagtttacctatgcccttttctttctagccgttccgaatctcgggacgagattctttgtaagggggtagatttgtcacatcctgatttttgtttcaggatttataaattatttaataaatgattattagaatttatattaaatgttcattaatttacaagtgaagttaaatgtgggaaataaaatttcctaaatataaagcatggatggatttaattttttattaaattctccatagttaattatactctctggaatattctcggatttttcggagctcaattcctaattttaatcatacaaagagcatttcagtaattacccacatattaaattaatcattaaatggtctaattgtaattttgttaagtactttgagtgtccaagtattttcaggatttttcttgaaattatttgcgcattggaagtatttttaacaattcaaagatcatttaagtgattattttaattgggaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgtgaaaagaaaagcccggcaagaagtctactttccttccctgcgctactgttcatcttccagctctggacagagccagagccagagccgagccatgccgtgcctgttgccgccgatccccttccaaaatccaacctctccgttgctcttatttccgaattggttgcgggaatggaatcctctcaatctcctcttccttgtccccaagaaatccccaaaagtttatatggaaatcctttccaatttcgcggttcaacctttcctttttccggcgaagatctaaactttcccgagtttttcccgtcgttgtgggctcgatcccggcctcccatggctatatataggaccccctagtcctcctctttcgtttgccccctctcccgtgatctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtgggcaagctcggccgctctctccccgctgtcaccggtcaccggagccccgtcgccgccgtcgaccgaagccgcgccgccgctagacctcgtcgccggccgtcgtcgttcgtcgtttggttcgagggtgagtaccgttgggttcctctcgtcgtcctctacgtgtacatgtcctccaaagtcgcagccgaccatccaatctccggcgaggtcgccatcttggtccggctattgatgaggtcatcatgacgtcatcatcgtttttctttttactgtttttctaatagattaaatcttcggaaattcataactaaatcatcgtaactcggttttgagtggttcaagttgctaaattcatctaaaatcgagatctacatgtttgtttactttatatgtactgtttatttggtttttattagtctttttcttcgttttgcgtgttagcttgtcgtttccgtcgttacgaaggttcgtgagtgcgtcgggagtgttcagaagattaattgaagaccgattattgcaaggcaagtcacacagatcttaaacacaatcctttgagcatgttgatcctatatttaaattctctatttatttcaactgtgcatttactttcgaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgttttcgtgattagtctcacacctctcacaataattatggatgttatacctggtaataatttgcttagctcctggtttggagttagatctgtacagccgggtatggttgttcaggatggttgggccgtgcagcatgggtgtgttgttcagtgttgattaaaatttctgattaattactccactgttttacttctcttaaatattttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaccacgttcgagctgaagaggcccaggaagaccagggcgtactgatgggtatgttttctatcaactccattccagttaaacttctctttgattcaggagcatcgcattcatttatatctttgaaagcaagccaacaacacaatttgaccagagttaaattaaggcaaccaatgttagtgcattcacctgggggtgaaataaccgtggatacagcttgtattgacgtacctattcgccttagggatatggtgtttccctccaaccttatggtgctgatgcctcagacccttgatgtcatattgggtatagattggttaacaaagaataggggagtaatcgactgtagacgtagagaagttaccctggccacaccctggggatcggatatgagagcaaccatggatcaagatcctagactaaccgaacgtgccggaggcatatttaccatgctacccctgaaaggaatgcccgtagtgcagcgattccctgatgtgttcccagaagatttacctggaatgccaccagatcgtgacatagagttcattattgacctgatacccggaactgcccccatatccaagagaccatatcagatgccggtcaatgagttgtaggaacttaaaaagcaaatcagagagttgcaagagaagggatttgtacgtcccagttcgtcaccttggggagccccagtgttattcgtcaagaagaagaatggtagcatgagaatgtgtgtagactaccgctcactgaacgaagtaactatcaagaacaagtatccactaccacggattgatgatcttttcgatcaacttaaaggagcgaaagtgttctctaagattgaccttcgatcaggatataaccaattgaagattaggatcggggatatacccaagaccacgttctcaacgcgctatggattgtatgagttcacagtaatgtcatttggtttaaccaacgccccggtgtactttatgaatcttatgaataaagtgttcacggattacttggacaaatttgtggtagtattcatcgatgatattttaatctactccaaagacgaggaagagcatgtgaagcacttgcgattggtactcgagaaacttcggaagcataaattatatgcaaagtttagtaaatgtgagttctggttaaaagaagtcacttttctaggccaggtaatctcagccggtggattggcagtggatcctgctaaagttgaggccgtcacggaatggaaggcacccaaatctgtgactgagattcggagttttctaggtttggcctgatactatcgaatgttcattgaaggattctctaagatagcccgaccaatgacacaactactcaagaaggaaaagaagtttgtgtggtcagaacagtgccaggaaagctttgaacagctcaaagaaaagttgacctctgcgcctattctagttcttcccgacaataggaaagactttgttatatattgtgatgcatcaaggcaaggactaggaggagtactgatgcaggatggaaaggttgtggcctatgcatcgcgacaactgcgaccacatgaggaaaattaccctacccatgacctagagctagcagccgtggttcatgcactaaagatttgaagacactatttgattggaaaccattgcgatatctacactgaccacaagagtctgaagtatattttcacccagtcagatctcaacttgaggcaaaggcgatggttggaattaatcaaggactatgatctagaggttcactatcacccaggcaaagcaaacgttgtggccgacgctttgagtcgtaagagccattgcatcatttgagaatggaagggatggctcctgagcttaaagaggaaatagcccagctaaacctacatatagtaccccgtggacagataaacaccctggatattcaacctcttttgagaacccaaatagaagaagctcagaaggacaacgaagaaatccaagaggtgaaggaacgcctagctgcagggtttgcaaaggaattttcgaccgatgagaaagatgtcttatggtataaaaagaggatctatgtacccgaacagggtggactgaaaggattaatcctaaaggaagctcacgaatcagcatattcattgcaccccggaagtacgaaaatgtaccaggatctgaaggaaggatactggtggcccaacatgaagagagatgtggcagaatacgtagcactctgtgacgtatgccagaaggtgaaggctgagcaccagcgaccagcgggtttgctgcaaccccttaggattcccgagtggaaatgggatgagataggtatggattttattgttggattgcccaagaccgcaacagggtatgattccatttnnnnnnnnnnnnnnnnnnnnnnnnngacggcaagattcatccccgtcaagacagactatagcggtgccaaactcgccgagttgtacatgactaggatagtgtgtcttcatggtgtgcctaagagaattatatccgatcaaggcacacagtttacctcgcatttctgggagaaagtacatgaagccctaggaagttaccttgcttttagcacagcttatcatccacagacagatggctagacagagagaacaaatcaggtcttggaggacatgttgagagcttgtgccttggattttagcaaagattgggagaaatgtttgccctacgccgaattctcctacaacaacagttttcaagcaagcctaaagatgtcgcccaatgaggcattgtttggtcgacgatgtcgtactccactgatgtggtccgagactagagaacgggcggtatttggacctgacattatcaaagaggccgaagaaaaggttcgcctgatccgtgaacgtctaaaagtggcacaatcacgacaaaaaagttacgctgacacccgaagaagaaacctagaatttaaggaaggagattatgtttatctgaaggtttctccgatgagaggcacaaaaaggcttaaggtcaaagggaaattaacaccaagatatgtgggaccttttcaaatcatggctagacgaggagaagtcgcatatcagttacagctaccagaaaatatcgccgatgtgcacccagtcttccacgtgtctcagttaaagaagtgcttacgagtgccagaggaacaagctccgttggaagaaattaatattagcaatgatctcacgtatccagaacacccagtccggatattggatgaagctgaaaagaggactaggaccaaagtgtggcgtatgtacaaggtacaatggagtaatcacactgaggatgaagccacttgggaaagcgaagaattcttgaagacggaatacccgcatctattcgaaaaccggtaagaaatctcgggacgagatttatttagagaaaatcccttatatacccctgaaatttttcctaatcccttctatacccctgaattttgcttacttccttatatacccccaaaatttgattttgatcccttgcatacccctcccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttatttttttaaaaaaagatcataaaaatgaggagcattcatataaagataggtataccaatgttcacaacatttttatgaatgctcctgataaaaaaatccattgtcctattaaaatttcaaataagaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtatagaaggggtcgggtaaattttaggggtatgaaagggattgagtgagttttcaggggtacacagggaatttactcatttatttaaggtgggtaggtttgtaacaccctgaaaattcgaccaacgaaatcaaaccctaaaattatgggccttcaaaaactttttaaataaattgcatcatgccgatattattcgcctatttcattggattttgatttcggagttcttagatcgcgaataaagaataattaattaggaataaaccctaaaattaaattggcaaaataaacaattagaatataatttaaaataatgatttggtgaggatagaaataaatgaaatattattgcaaccatatttgcatcaactaaatttaagtgcgacggaataagaattagccctaatataaaaattcaaataaattataaaatatgggtaatattaatctagggtgaatccattggttagaataacacaaatattaagtaaacttcatttatgcaaaaattaggatttatagaataaaatttatataggaaataggctgaaatagggataaataggaaaaaacattattcattcaggcataggtgttcgatgaggttccctagtcctgtcccctcctctgccgcacgcgcctggccaccccgagccccgcgccaccatcgccgtcgcgtcacctgtcgcagcgccgccatcccgtcgccgcgtcgcgtgcctaccgcctcgcgccccgtgccctgccgcacactcgctgctgccgcgccgcaccgctgtcctatcgccgtcgctgtcactgtcgccgtcgccatcccgtcaccgcgcgcctgtcccctagtcgcctcgagccccgctctaccgtcgccacgcgtcgccgtcgcctcgagccccgctccgccgtcgctgtcgcgtcgcccgttgccgtcgcgtcgcccgtcccgtcgccgtgcacccatcccctcgccgcctcgcgccccgcgccgtcgtcccgagccccgtggcnccgccatcgcgtcgccattatgccatgccttgattattgtttacccttaaatccttgtaaccatgatttacgtataagtccctagtcaactatgacaaatgcttagaaatgctactctagatttatgcatacacatatttatcaaatgctatatgcttgggcaattacctttgggaaggtaattgagatgcggcatgtggagacatgagcgccacattgccatgatattaatgacatgatttgtgaaaggaaaataaaactaacaaatgttttcgacgggggcggatggaggatttgggtagtatccggaaagggctagtgccgtccctggtcaattaaggaccgagccatgaagttaagcatgaaacgacccccgtacaaccgtacttctcgaatgggtatagacctagcggattagatagccgagcggaggcactatccatgcatagtggtttctcattgagtgaggcaggtgctctacagtgggacagctgttgaggtagggccgagagtcgtgccctacatcggtgtcgccattgataggactgccatgagtgtgtgagagagagaacttaacttaaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcaaatagccgtgctcgcggttattgagcaccgggacgtgtattacacttggctagactctaaattcttaacttgtgtgggatgggatattgcatgatgttttttatgctgttggagccacttcctgagaggcgggaaggtggacgtcctcagaaaaccatgacgactcaatagcgggaagctatccttgggatcacaatggatggtggacagaaccgtcgttgtttaaatgtgaacactggtactaaaatttgatcagtcaatgctaggtcttaggcttgtgaaaagaattacaaaactggctttgcgcaaagaaccatagccatcctttgaatacccctatcatgtgtattgttgctatgatggcttgctgagtacggttggtactcacccttgcaatatataaacttaatcagaggccggagatgaagcttcggaggatccctacgcatactaccaggagggtgatgaagacgatggcgctcagtaggtcttagttacgattgttgcctgtggcaatgtcgtgccgctgccttaact

SEQ ID NO: 24441 - DNA, 758 bp, Oryza sativa
catttaatgaccgccgatcacttgagttaaaaagtaactcaatttaacgaccaatgccatgtgcccccaccgcgcagtgacgcgcaaacgagttaaaaaaaactgccctcgtgccaacacgcaatggagttgcgtgtgttcagacggagttaacgaatacctcaccggaacgagcacgacgaatgcccccccacgcacaccttgtcgcaccacatgagttaaaatataaaccaaaaaaacaggtaagtcgtgtgacaccgtcgatacgtgccatgtactgatgagttgaaaaataactggcttcttaatctcacttgcgcatgcatgcccgctttttagttaaaaaataacacatggcgttatgtgggcgcgggcatggtcataagttaacaaatgactcatgaaagttgggcgcgggtgggatgtgagataatgtggtgcagtggtgggtgtggggtggacgcggtattctcataagttatcaaatgactcataaatggttggcgtaggcgggatgtgaggaatgtggggtagggtagggaggtgttgtgtcaggcgccatctaatacgtggcgcctacggcgccatatatatatatatatatatatatatatatatatatatatatatatatatatatatatatatatatatatataaaatatgaaccttggttcatatgcacctcactcatttgtgtgacatgtgtacacattataatcactgtaagatgtacatatctagctttgtatccttat

SEQ ID NO: 24442 - DNA, 1040 bp, Oryza sativa
cgaccgtcaatattactaaaacaggagagaactagtgatgcttgcaatgcataaatatgttagaacaataatattccactattattaggtctactaacctttttgcagagaatgacaataaagtgaaggagaatcaacatcaacaccaacgataaatcaatcagacgatgtcgaggaccagacttatgtatgaatgggcaaagaactcagaattgacacgatgaattgggccaaaattcacaagtctgaggagtggagcaatagaggaggccaccagccgaaattgggctggattgggccagccccaggttcggccgaacctggtggttcggctgaaccaatcccggcgccgttgggtccaggttttggcttggacgtccaggattgcatcccaatgacggttggagggcacttcggacaattccccttccacaaccgtcatacctacctctatataaggagctcactctcttcacttcaacacacacctcaagcaagagctctctcattcctctcaagtttagtttagtagtatctagctggtggaatagaattagaataggaatcaggagtccggaagtcttcggaagagttcgggtatggctctagcagctttcctttcctcttttgtcagatttgtaattttattagaatactcttctatatacatttatggtattgaaatactttctgagtatacgagtacctactttacattatgttcttgttatactgaatatactgctagcttatctgggagatgctttggtgcgggtataatgtttgcttatgcaattactctatgtcatgatgatgatattagagtagtatctggtagtttagacgtggtgtctagattacgggatatcattatttggggttatatattgcggatgagaggtgggccgctgatggtgacaactcagtacgggtattcctccgcgcctatatatatcctaagttaattttctggggagggtattcctcagtatttagccctggttggatggtcatgacgggctgtcgtaaggaactcggca

SEQ ID NO: 24443 - DNA, 614 bp, Oryza sativa
atgggagaaccgcttcgcgccgtagacgaggaagaaaggcgtttccccggttgctcggctggtgtagttcggtttgcccagagcaccgctggcaactcctcgatccatgaatcgccgtgcttcttgagtatgttgaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccacgaaagtggtatggtctgcaggacctgggccggctgatggatttgcttggcgtggaattgacacgctttacatcgccggaccaggtcgaccgcatcattgggagctgtcggccaatagaaacc

SEQ ID NO: 24444 - DNA, 2928 bp, Oryza sativa
ccttgagtaacaaatttactaattgggtttatggtagacaatgcttttccctttacaatgaagtaccccaaaaatatcatatcagtaaaaaaattactactggttctatatagggtactgctcgttcttcttcttgcacatattacacaggcatcttctcttagtaaaaaaattactactggttctataaatggtactgctcattcttcttacacagattgtagaggcatcttctcttagtaaatagattacttctgtataatcaggtagagttgcaaatgtagtaatagatttactcttcgactaaactcaaatggcacaaaatttacattttaaccatactgccacataacgtagtaatacttttactcaagtgtatttttcacgtgaagtaatacttttacttttagtcaggtatatttttcactggatcactcaggagaaaccaaattaggagtaaacgatcaacattttcaccaaattaggagtaaatgatcaacatgtcactgtatgggtaaaaaaaattacacatccacaggcaaaaaaaaaaaagagaaggaaacatgaagctaaatccacaatgtgtcggcgtgactgcttggtacgtgttggatctggtgttgagggagcagtcggcagaggccacttcgtcggtgcatcaatcttccccagcggcgagcagaggggcaagccgtgttgatggatagaaaaattacgcatttgtcatctccagcatgaatttaagcacctcttcaattctgatttctaaactggataaagagattccacttgaaatcattcttgcaagcagcagggttaggcttcataatcctgatcagcaagtgcagctaatctatggactggttgcactgcttcccagcaatatctggcactatattttcagtggatggttccatgcacacaatatgttaatatacctgtgaacttaggctgtgtttgaggagaaggaaatagagaagattgggaagatatgcaaaacgaggtgagccattagcacatgattaattgagtattaactattttaaacttaaaaaatggattaatatgattttttaaagcaactttcctatagaaaatttttgcgaaaaacgcaacgtatagtagtttgaaaagcgtgcgcgcggaaaacagggacaatcccccctatctcccctgaaagaacgcagccttaatgcagttgttagtaagttttttgtatgcgcttgtaaattacaccaaagctgttatccttcgacctcaccaaaccccacaactttcacaatatttcagagcttcgatgccaacagagtatcaaactgtccagccaaccaaaatgaaaattttaaaatggcttcacttggacaaaatgacattcagagctctgaaaaacatctctctcaatgaagattctccatccatctttcagccattcaaagaagtattcttaaaaaaattcagaggactgtttagcctatcagctaggtgttgtgctgaactacgaaatttcagaagctaataagatatcaactactactacaaaatttcagaaacttatcaggtagaaaatttcagaaactgctagcatatcaactaaatgttctcagaagactaatgaaaacaatacaagaggcagtcgagctgctctgctctattcaggaggaaaaaaatccccaaaaataaatcctagttaccaacatatttggatgcatgtgaaaaacataccgcaggcacccagagagatcaaagcatgtgaagggtcatatttgtacctggagggtggggtgttgatgatcttgttggcaaaaatagccaatgcagagaaacaccagagtatgtgcatgttgcaggtggtgttctactgctctgatcaggaaacctgcaaatcaatgaaaacggaatgcaaaacagatgtatgtatcccaacaaagatctgatgcactgttgtgtacattatgaatctctgatcaaatgcctacgcctggccaccgccggaagctgccgcctgctcctccaataggtctcaacttgggggagtggagcagcaccagtcgtcgctccagccaccgcaggatgccaccgccctctcctgctgacggtcactcggttggaggggagcaccaccaaccgtctgaatgcattatgagaacagtactcagcaggcatcaccacagtgaaatctttgcaaaatcaatgggcgtgtcagagaaaagaaggaaagaaaacgaagacgaacaggagaaagaagatgatcagatcgatggggttgatgccaggcgcacagaggagacgttgcattgcagcatcactggcatccctttcttctccctctttgtctctcttcgtggggaaaagaagcaagaagcacctggatctggtccgccgcatcactggtgtggatatggagccggcaacgaccagtcttcccacccctttgatggcatcgtcgcccacctcgatggctcggattgcaccagccaccgcatggaggaggtgaaccggacgccgggatgtggcctcctctccgccgctgtcgattccgtcatatccgccctatccaggacctccaccaccatcggcagagcaggggactaagcataagtgaagagggaacaaaccatcgccgcgtccctgatcctcctccatcctccacctccgctgcagtgctccgaccctagggaggagccagatgcgggcgaacgcgaggaggagcacgaagcctcttctccctcgcctccctcatcctccaccaccgctgctcctcctcgtcaccgctcctcctcatccccgaaccacgctgctgctcctcgtcgctgctcctcctcatccccgatccgccgccgccgcagtccacgcggagcgatcgccggatccgtcacgccgctgctcctcctcctcgccgctcctcctcatccccaaaccgccgccgcc

SEQ ID NO: 24445 - DNA, 4893 bp, Oryza sativa
  unsure (1)..(4893): unsure at all n locations
gctgttcattagtatctcctnnnnnnnnnnnnnnnnnnnnnnnnnnnnnnnnnnnnnnnnnnnnnnnnnnnnnnnnnnnnnnnnnntttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacgtacctaacttgttgcatctgatccttccattgttaattgttataccatgtcccccttaaccccttagttgcgcctcggtaatcgtgcactctgtacgagtatcgacggtcgccttcaaacttaaaatctgagaaacatcctgggtaaaacttgggttttacaaaagactcggaaaaacccgacacctgggtcggtgcttgcgaactaaatgaatttccaaaattgcggaccggggaatgtaccgggtgtacagtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacaatatggtatgggacctgatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgttttactactgctttgtgaaatttgctgatgtggtttgggattgatgtttggaaaatctgcggctgatgggatcagccaggcccgggtggccgtttgaaaagctgtggccgggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccatactcacccttgctctacataaataatccccccagttgctgaagaagatgaaacggatcccgctgacgaggagttcttccaggagcaagccggctacgatgagttttagggtttcggcctagttcccaagtcgcgcctgtgatgtttggtcgaagtcttggcttccgcttcccttttgtaatgcagttgtgagctcgggatctgtccgcagcccaacatgactgtactcctactctataataaagagacctctgttgctgtgatattctgccttcctgtgataccagcactgtttcttgggactggtatcgactaacaggttaatttggagcgtcacgggctagttccgctcgggactagttcggggcgtgacacagaacaatagatcaagacaaaagatcaacatacaagccaacatatgccaagacaagctgccggatatcgacatcagagatatgcctggatcaaccctatccggtacctatagagaccggctgtagggatttaacgttgtctctgatctcgccgggcacgaactcgaggaggaaggctaccctgttgtcgactacgagtcagaccttcagaccgccatgtcgataacagttagataggttaccccaaatattgtactggtgcgattatggtgaatatataagagcaataccggcttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtctcgttgtaatctcttcaaaaaaaaaatgtgagaaagaagtcgcctcctaatttttcaagtctctgtcccaaatcaaatattttttttcttggaaaaaggtgataacgataccgcccgttattttcattgatatgaaatgttttgtaacctaagcattgtgtgggtcaggttactacctaaatattttgattggctgctttttattgggtcctgcataacagttaacgagtgttattattttttcttagaaaatttaacaaggtagactttggggacttggatacactttgtaggccttttattatttaaacctttgatttgatttcactcctgtgttgctggagctgccaaaaacagacttgccacacaaccacaatatattccttatcagtaaagtgaattggcaattttattgcggtattttttttaaaaaaaagtgaaactttgattaaaaaaaacattctcaagcaaccacaatctattcctgtcatagcaagctaatcccctagtcaatactagttacaccaaaatcaccgaggtaaatgagttactccaaaacaatataacaaacattgattaatatgaaatagtacataaaaaaatcctttgccgtacatcaaatgatggtacaaattattgggatgaacgtggatttatgatccagctccctcatatgttacaaaaggtgacaaataataatgagaagcccaaaattaaaggccttgcgtctgatcaagaaacttgcccatgatcattcgtacatcagctaaccagatgacgacacaacttcggaaaggcacaccactacaagaaaagcattccatagcaccaaccgcgagcaatcaacagaagcaagctagcaaaagcagaggagtatccgagtatcctacagggaagctgatgagcaagacgcaatctctgtctctggtcggccggtgtcgatcggttagcatttggggagatcggacggcggagggaggatcttctggttgggtaggctcccgtcctgcaccacccatgccatcttcaggccccagctgacgtgcacctccaagtggcaatgcatgaaccatacccctgcacacgtccaagcaaaagtagcgaattagttgcaaatttcaactcatgtgtgcgcagccaaatctgttttctcgcttattgatcagaaatgcaatgtaagaataaaaaaaatcaataaaatgttgcaataatgcaatgattctcacctggattgtccacgaggaagcgaatggcaacccagccggccgccgcacgccgacggtgttgcgctcgacggggtcgacgaggttgtacttggccgggtcgttcacggngtcgaagttgccgaacccttggccgacgacgaagaagttgaagccgtgcaggtggaacgggtggctctcggcgccaaggacgctggtgccctgcatcaccagctcgaccgacgcgccgtacgggagcacgaccagcctcgtcccgttggacacgttggtgttgttcggcggcgtcccggtgtagttgaacggcgacagcggcatggccgggaagttggaggcgtacaccccgttggacctgccggtgtagtgcgactgcagcagcgccgtggaggggagcacgaagaagacgttgttcacggccgccgcgaaccggctcccgttgggaccctggcacgtcccgttcacggcgcaggggtgcgtgcccaggccgacggtgaagaagaaccgcgtgtccacctgctgcggcacgttcgccgggtactccgccgtggcgaagctgcggagctttgcggtgtagttggagacgaagctggtgtcgttgatctgcggcagggtgggcctgagcaccgggaggttcttgttgaacgccgcggtggagtgggagctggggtcctcgtactcgaggattcccgcgacggtggtgttgtcgaacgtgccggacatcgccgtggagtatggcgccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggacgatggagaagaagagctcgtcattgagcgcagcgttgatgagccgcagcatgtacggggtaccgagctcggnttgcgccaaatgcatcgaactcatgcgct

SEQ ID NO: 24446 - DNA, 43647 bp, Oryza sativa
  unsure (1)..(43647): unsure at all n locations
gcggagttgcctgctnnnnnnnnnnnnnnnnnnnnnnnnnnnnnnnnnnnnnnnnnnnnnnnnnnnnnnnnnnnnnnnnntataatcaaaatgtactagctagctagcttatagctgcaagtgtacagcgcagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgccttccctcgcgaacacagtcggccccgggaactgcccgttcaccgtcacgatgctcttgctgctgcacagccgtgtcacgttcgtcgttttcacctgcacacgtacacaccatacgcacaaacacatcgcaattaacgtaccattacactattgccacgcatgcatgcaagttggttctctcgatcatgcatgcatcgaacgtaaagaaaacaaagaagaaacagaggacagcgactcacatcgaattggtattccctaatgtcgcccttggccaggttgacggagaagagcagtagcgcggcgacggcgaggatggaggaacggagaaggtaggagatagccatggatgcctcctcgagctctcgacttacgtacactgagagctctcgtcggctaatgggctatgaatgtgtttgagatcgatgctagatgagtgtctaaggtgtctatatataatagtactagaggacaggaggatgagatcgagaaaatgattaattaatctgtacgcttctggtgattctgaacagaagtttttttttttgagtttttttcaactcggccagcttagtaagctttatttggtgcgttgttggttaatgaactgggcacgaggtcgatcttcccaactcgcaaggcacaaacactgagagcggggcccatgcatgcatatagctgtgtatagcttcggagtgtggctaaagtcaactactcttctgtttgcatgtcaccttgaccaccttttatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattatttttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacgagagccagtgaagacaacgaccttggcctggacgagagggttgttccaagcccgttcttcgattggcaacacattcgcgtcggccagaaatggccaggcatggagtacattactaatatatgtcaatttaaaaatgggggattcttgatttgtaagctgtttatctggtaggtcgtcgcccgcggatggtttggtaacggagctgtgcttcgaacagttctcttctttttgcccccccaagtctccaaaggaagagaaggatgcctgacccaaccttacctgttgctatccatggacacagcacacaatgacacaacgcatgctttgcaaggcagacttgatacgtaaggcaagtgggggttgctcaagctcaaaccttctgcaggtatgattcgagtttcggccttgatggcagtttctcattttaagttggggaagtacttcctttgtcttgttctagttttgcagactatttcgttgcagttccccaaagaacgaaaatgcaagataactttctggtacatttcaggaaaaaaaaaaagggacaggagaactagattgcaagatgttatcaaaacgttaacaagtactacaggtaaactctcagggagagggcgagaggctcaggctttccaagctatgagcacgggagactactactcatcatacgctagtgatgggttacaggaacagagaacaaatcgtcaagcagatttcagaaaaaccacgaacacctttatacaacttctcatgccctagtgctaggttacagccttacaggaacagagatcaaatcgtcaagtaaatttctgaaaattcatgaactgaaccactagttatcggcagattcaacagattgaacgcctgcgcgaagtggaaatcgcaatctagcaaaatagccataacttggcatatgaacacctttatacagcttctcatgcctcagaaatattaataatctgttcagcaaacatgcgatatacacctacaattctgtccaagttatgatgccacagcctctccaagggatgatgctccatctgcatttgacaattcagcattcctattgctgtcttcatcttgaaaaccttgtttgaatcgatcataattagttggctcgagtgtcttgaatgggcgttcccctagaacctggacaagatcatcctggtggagaacctctttctcaagcagcagctcggcgatttgtgcaacttgatctttatgttgttttataagctcaacagttttttcataggccttagcgacccattccctcacctcagtgtcaatgatggatgccgtctggctgctatatggtttgctcatctcaaaaccatcctccctttgagggaaagaaagaaggccaaccttttcgctgaagccatatactgcaacctgggcataagtcatcttagtaactttctccagatcattctgtgcaccagtcgagatctttccaatcaagacctgaaaaaaaatcacataattaagtcatttgcttaagaataaactctactgataagttagaaaatgttgtgtacctcctcagcagctcggccacctagtgtcatgcaggtcatgtcaaaaagctgctctttagtcatcaaaagattgtcatttggcacatactgagcaaaacctaaagcagctgttccacgaggaacaattgtgaccttcagtagtggctcggcatgctccaaaaaccatccagcaacagcatgaccagattcatggtaagcaacagttcgccgctccaacttgctaatcacctgtggtggacagattgataagtacataaccgctacacatgaatgtccaattgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcgaaatatttgatcacgaccctttatgtctggtttatcaatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacacttgcgagcttcttgaaataagttccgaccctgatggtccaacaccaacaaacatttcaatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctttcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtcgatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctagtactctgtactagatgcattctagtattagatgtgagcatatatatatatatatatatatatatatagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcaccaaccaaacaggcccgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacatttttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagaccacttaagcatataaaccagcagaagaaccagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaataagtttccatataagaacccaatacaagattaatcaaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaagaatccaatacgagattaattaaaatttagaaaaggaggcaccacgttcgctgtgggggctagaaattcccacattaatcagagaaaaagaaaaaaaaaagaaaaggagagtccaagtagaaatacaatataaaaatagatgaaattcaaaattaaaaataagcaatattgaaagaagtttccatataagaacccaatacgagattaatcaaaattcgaaataaaaataaaataaaatccaaaattagggaaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaaaaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagctgatgggcatcaatcccagggatttccgtgagttttttatgccaaccaaaaacactaaccattcaaaaatcagagttttttttaccgctttgttagctgatatttgctcggtgctttggaccacaagaaacaacatgatatttagatcgaaattggtttatttcccaccaatattaactttacaaatcatttttaatttggtgcactgaaaagttctttatcgcgctgaggaggtcgagatgatagacctgatgactgataagatgaaaagggtgatctcactgctttgagagatcagagaactgggattggctaaatcttctttttttttctttgtgctggcaagctagctaatattgagatgttctcttgctcaagttccttgttgcaaagtgcaaacaagtttgtatgggccaagagaggttgagagttttcttgtgtgggcaggcttgtgaagctgttgccacttggttgctaagactcctttttttgtaaaatgggtttttagacaaaaggtacatatataggccccgcttacattgaaagccatcacggcagcaaggagtacattcgttaagaactaattcaggaggttagtcatcagcactccttgtctagtcatcagaagtagtggcggcagtcggactctccccagcagcagaactatggccatcctgcagctccagcgcccgcctaaggagtccaataagcatgtcagaaaattctgagagcaacgataaacatggactacaattaaatgttatttggaacctcagaatcagtaatccacagttgtttggaaacacagtaaagtttcaaactatggatctatcaaatacacatgccattttgccaaagcacatgaaatttgttggatgaaataaaaaggataaaagaaactagctggtcagtttgcttcatcaggatactagtttaccatgacaaaaccatccggctagaaaatcagatagcaacattaaacatgaaacaactaaatgttatttgaaacatcggaactagcaatctagctgcaatggtttgaaactggagtggattttgatccctggagtggatatcccctcgttgtttgcatatcactcaaatagttatgaaatttttttaaaaaataaaaaagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggctgggtgtgccggtcagaccggcgtgtattgcgcagtcagaccggcgcagcccgcggtctgaccggtcgacgctgtgtcagtttcggtttcgggttgtttctttggatatccgtgattgtttcatggttatggcttctagatggatattatacgtatgtaatactgttgtttgctactaatgagtcaagttggagatagcttagtctcggaatatggtttctttgtttgtttcatgtgtaggtgactcgatgcctcgggagagtatttgcggtgatggaccgggagtcggcttggtggtaagacgatgtccgtggtggtcaaatatcatgcgggatactaaggctagagttgatgcacgtggttgatggagattccatatggcatatgatggaggtattgtatgcgtatgggatgcggagtcgaatttggaaggagtcaaatttggtacgattggttatgtaaaggttctttcttgtactagagggtttcctaaggtgtttaggcctcttagtatgagtttgattcgtggctttaggctgcctacctcatgtataaatagagggggagcgtgagtcttccctgcatcgctttgtatcgcttttgtattgcttttgagagctagtttagttagggttttgagtttagtcgagatttttgtaaggagtgttgttggtgcactttgtaaacgcagagagaaacaataaagttgtcatctactttgagagttcttcgatttgtgtttcaccgggtttcggcagtctaaccggcatctcagtggcggtcagaccggcggcatcgcggcggtccgaccggcggcgtaagggcggtcagaccggcggtggcgacagcaagcgacagctgatcaggcggttagaccggagtttcaatctcggtcagaccggtggctttcagacggtcagaccggacgactacctcggtcagaccgcgatccatcgatttcgagggtaacttttatttccgctaaaagtttttggtttttgggtatctcaaccattcaccccccccccctttggttggcttagttcttgtgattcaatcctacaagtggtatcaaagctttgtttgcttctttggattttaaccgatctagagtttttgccatggctgcttctaataagtttttaactaagcctcatgttttcgatggaacggatttttctcattggtgtagtaggatgcaatcttacattatggctgagaattatgatatttggagaaaagtttctcttccttgtgtgattcctgaagctattaatactgctgctgaaaaaactgcttttgaactaaattgcaaagctcgcaatattcttttgagtgggatttctcgttcggattatgatcgtgttgctcatcttcaaactgctcatgagatttgggttgctttgaataatttttatcaaggtacaaataacattaaagaacttcgtcgtgatcttttcaaaaagaagtacattaaatttgagatgaaacctggagaagctttggatgactatctttctaggtttaataaaatttagagtgatcttagatcttttgattcttcttatgatgctaattatccacaatctgagatttctcgtcactttttgattggtcttgacatgtctatttgggagatgaaagttacacctattcaggagtttgtgaacatgtctactttgactttggattcgctttacacaaaactgaaaactcatgagatgaatattcgttctcgtaaaggtgattctaagtctagtgctttggtttcgtcttcaacttctttgaatgttggtacttcttcatcgaagtcttttgttcttgctttatttaatgccatgtccgatgatcaactcgaacagttcgaggaggacgacttggttttgctatctaacaaattttctcgagctatggaaaatgttaggaacaggaaaagaggagaaccgaatcgttgttttgtgtgtggtgcacttgatcatcttcgctcgtattgtcctaagcttgggagaggcaagaaggaagatgatggtagagttaaagaggatgacgtgaacaagaagaagaacatgaaggagaaggagaagaagaagcattgcatgcagtggttaattcaagaactcataaaagttttttatggatctaaagatgaagatgagggcaaatgtaagcaatttgttgatctagcttttattgctcgtaatgaaagttctcatgttgatgaatctgatgatgataatgaagaaaagcatagttatgatcaattagaacttgctgcttacaaatttgctaaaaaaactttaaacatgttctattgtgcttgatgagaaggatcacactattgagattttaaatgctgaaattgatagattaaaatcttcgattcctgatgatgataattgtcagtcttgtgaagttttattttctgaaattaatgctttgcgagatgtcaattctgttaattgcaaaaaattagaatttgagattgaaaaatctaaaaaattggaatcttcttttgctcttgggtttgctttacatgcttgtgttgttgatgagttgattttgacaaagaatgttttgaaaaaatacaaagttgctttttgtgcaagttctttggcgaatgcttcatgtgcaaataaggcaaaacaaaacaatggtgttttgatttctgaagattgttcaaagtgtgttttgaatgagatgaagttgaaagatgctttagggcgtgttaaacacatggaggaaattgttaaacaagatgaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatctaaggttagcacacacaatcatggtttaggttttgatccttatgctcataattctagacatcctcctactgttttgggtgttgctaggagaggtgaaattttgattgaatcagagcctaagaacactgtgtttaaatctgttggcatcatgtcttctttgaatacatcttcttcgaaatcaaatgttgtgaatgcaaaaccttctgttgttgcaaaaccatctacttcacaaacttgtcgtgagaagtacacttgttctttttgtggaaaagatggacatttggttggtttttgttttagacttgcccataaacagaaaaaggaaagagaaattgcttttgcaaaacgacattggcaaaaatcgggttttaattcgaggaccacggttagaccgacactgaccagtcggtcagaccggccagcggtcagaccgcaggtaaaccggcggtcagaccggttgctaggctcggtcagaccacaggcacagtggcggtcagaccggcctcggggcaattttgtgcgaaattcaactcagacttttgtgaagcaaaaaggtaagttttttggtaagtctgattctgattttgtaagtgtgtatgtacctactggttctagtggtcgtgtgactcagtgttggattccaaaatttcttatttctaaccccaacacggaggtctcgacatcttctcgttcgtaggtattttggcggcatactccccatgtgcatttaactttgagatgacgattgtatagcaaggtaacatcactttacttttggattgacataattttggtctattctcttgtttattagctttttcatgtgctaatgtttgaggtagtagtttttgttaatactattggatgtatgtcaattcttgagaattttggtgatatcgttggcaattggatgtctttttcaaaatctttgattttttcttgatttttgttcgggaagaattggaggttattttgagggggagttagtgctttttatgactttcttttggcatgttttgagggggagtttgtacctcatggttttatcaagcaaaaatatgacaatgaaaaaattgataaaagagagctttgtttatacatatggtattttcttgtgtatgctagtaatattttgaaggtttatttgtctctagcataacttgtatgtattctagtcttttcatgagatttagtttttgcttttaagggagatgatgcatgacacttaaattctatacttgaattaagaaaatatgtaatgttgaagctagcatctggtttgatttataaatgctctatttatatgctttattgaattgttattccttaaatagctttaattgctcattgtgaaaaagagaataaaaaatatgaaaaaaatgaataccgaattcttggaaacagtcttgacgacaaggacgtattcgatgtgagcaaaataatgggtgccgaatccctggaaacagtcttgacgacagggacgtacccggaataaaaaagaaaaatatgagcaaaaaggcttaagaaaagagaaagttcaaaaaaaaattctcttggttgttttgtgctaaaggttatttgagaaagagtgataaatgcaataggtatatgtgtttagtgtttatttttcaacctatgtgcttattaagatgttgcattataaatcgtatgaaatcatgaattttgattgttgattcaagcttaattgtaaaatctttggttcatggttgtactttaatgcatgcttgttctgttatagatgggtttatcttctttttattgcaacacatgacttgatatgctatatgtatgctaagctcttatactttcaaaaacataattcctatgcttgatgaaatcattgtcaaaagggggagaagagataagttttttgggaagaagagatgagtttttatgagaagagaagagtttttgagaagagcatgttttttcaattgggaatttctttcttttaaaaagggggagaagttttcttttggatttttgagcacgatgtgtacgtttgtacaaagtgtgtttttttaccgtttttgtttttaatttttcaaactccaaaacatttttaatgggtttgccaatttgttcattaagggggagattgtaatatcaacgtgtgttttgattcttattctgtgatgaacaattggcatatgtgattatcggttttgatatttggagattatcgtcgaagtggttttggagataatcaattttcaggaaatgaacaggatttactggtttgtcgggaccggtcagaccgggttgggtgtgccagtcagaccggcgtgtattgcgcggtcagaccggcgcagcccgcggtctgaccggccgacgctgtgtcggtttcggtttcgggttgtttctttggatatccgtgattgttttatggttatggcttctagatggatattatacgtatgtaatactgttgtttgctactaatgagtcaagttggagatagcttggtttcgaaatatggtttctttgtttgtttcatgtgtaagtgactcgatgcctcgagagagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcaatctcggtcaaaccggtggctttcagacggtcagaccggcatgactacctcggtcagaccgcgatccatcgatttcgagggtaacttttatttccgctaaaagtttttggtttttgggtatctcaaccattcacccccctttggttggcttagttattatgattcgatcttacatcattttataaacaaaatgtttatgctagaagcaatcgcatatctgttgtttaccttgagagcatcatctgattgcattgggcatgcacagagagctcgtagccaagcaatccagctatggacagcatcatgcaccataaaaacgtagccccaatggtttcgccagcaaagccaacgccagtcagcagcagaagaagaaagaagctaatcaccagatatgggacaatatagcacaacatgatgtggccaatctggtcaacggacaggagggcatcatgaagcacaaacctagcaacgaaagcagcccaggacaagatggcagccccctccacaaccgaaagaaaggccacgaacataggcagcagatcaggatcaggatcagcaaacggcctcaatagcagagctatgggcgtaaccatcagcagagatattataccaaacccggcagctctaacaccacgatctgtcttgaaggacgtctcctcctcctcggtcaagaaggttgggggatccacgcgcatggccgccgtctccgtgccaatgcgctgcaggtgatcggcgtaggcgtacccgagcaggccggccgtccagcctgtggcgaggtgcatgacggcgaacccgacgctggggccagcaaccgttccggctgcgtcggccagaaggacgccataggagatgtggaggaacacggtggagggacggattgtgcgcgagagggtggagatcaagaagaagaggtaggcggagatgaggaaggcgatcgtccacaggagggccagcggctcgcaggagttgcggagcagcagcggcggggagaatacgaggaacatgcatgagatcaagataacgcgaggtataatgtgatctggaccgccttcaccggaggagagaccggtgatggtggtcgacggagccttggcgtcgacaaggtggccggccaccacagcctcggcgccatctgcttcgcaagccgcggcgatggccattccagtcgtagggttgtgggggttgtgaagtcgaagcgagagcagggccggcgaaagaccaccacgacagccgcggcggcgatggaggagaaattgacttgactgctggtgtgtatcgctccagtcaattaggactgatcgatttgttgccaaaattagtgggatctctaattgtaaatagcacatttactattcttaacgttactaaggctgagttctttccaactcaaccacctctttttttttgtgtgcatgcatttcaaactacttaacgatttgttttgcaaaaaaatgtttatacgaaagttgatttaaaaaattatattaatttatttttatttttaaaaaataattaatacttgattaattatatgttaatgagtctctctgttttacgtgcgttagagatgagttcaaccccaagaaacaaactcagcctaaaacttgtccttgtcgatctttgcctttacaggtttttttttagcaatctaaatgtgcgtctagtctaagcatctccaagagtttcttcaaatctcaaatcttgctctttatttgttcatttggcaatgaagcaaaataatttcttttcaaattttatatacattctaacagcttcttcatatcccacactctctaaattattttggttgtttagattgatgttattttaaaccataccatttttttaaataaaaagttgttaaatatgtctatatatttatatatttagttcttttaccaaaacttaataaatacataaggaatcctaccaaaacttggtaatattgtcaacttactgtaattttatcattgtcaaaatttggtaagatgtattttggctatggtctaaacaacccctttgaggaggtatcagtatttttctctttgagcgagtatgagtatctttctctttgagcgagttgcaacttgcaagcgagagagatgggaggaagagagaataggagactcacgtttggcaagtggtcatcgtttggaaccatgccactccgtcactcttttcgtcctccccgtcaatctttccgtcattcccatcctctctccggcatgttcaccacgttgacccgctcctccatcttgccggcagccatgagctcgaggagggagtcgaggaagtcgctgccgcggccgtccgggtgcacggcgtaggcagtgacgaacatggggtcgcggccggcggcgaacggcggcggcgatggcgaggggatgctctcccatgaccaccgctccacctggtgcccgacagggccgggctggggctgcagggcaagggccagctcgtcgccgtggaggccatgttcctcatgtcgctcgcgctcgccgccgcgcacatcgccatggcttaccgcgccagctgccgcgagcgacgccgcctgctcgtctacagaatcgacatcgaagctgtaagtgattgattcccttctttgctcgtatcgtatcaaaacaaaggattttgcctagtggtagcttgtagtgtggattggaaacatattaaacccaaaatatgcaagctttctagattccaatccgtgttttcgagagattctggagaacaatcgaggcatacgcttgccgaccttttactggacatgacaacggccagaagaacacgacgtcccctcacgcgaggaaagcaatggtggagcggtggccggcggatgagggcgggacaaggcactgccggttcttgccgccgctggctgcggcgcagggcgcgaagaaggcgaccgcggagtctgtgcgctcgatgcggagctcggcgacgaggcgcaggtcacggccgtatccgcggtcggcgaggtgggtgagcacggcgtcggcggcggcgtcatccggggcagtggagaggaggagaacggggagaggatggggaagacgaaaagattgatgggaggatggaaagagtgacggaagtggcatggttctaattttaaaattttacaagtgacatctagcagataacgtgaatagtaatggtatattttttatttaccacatttacagtgatatggatccaattaacccaaggctaaaaggcaaatatagtcacgggccaaaatgcagctaaagcatgaattccatatactttgatcaaggatggctaccacaaacagtactacatagtagctcagatgtctcaattcaaatatgtgccgatcgataagggttaagaattacacattcatagattcgtattatagcataatgcgctcgaggataacccctaatctttacacatgcatgtaggagtattcgttaaggactagtggactactaattcagggggaaaaaaattctctggggcggagccccaatcctcagcgcgtgaggcaccattctagataggtgccacctgtattctcaccaatattgaagcaccggaaaaaagtaaagcaatttggattttttttttcttagcgtatacgctccgtattccagtggtgccctacgaacttgtatcgtattctctgccctaatcacgtcgttagcgttcctcgttcgtcggagccgtaatccagctattcgcccttccgttccggccatcgccgcgcgtgtagttcgccgcccttccatcgtcaccgtggccgtggccgtggccatggccgtcgtagtcaatgtagatgaatccccgcggcggcgccttcaccggtgccgcatcctgctcatccaccggcgatgacgatcctccgaggcccctgatcaaccatggaccaatcaacaatgcatggcagcccgtttacaagacacgaagctccaaagaaaaatatactagaaagaaataacgtgtttgagtatatcgaatcactgcaaattgcttccaggaagaaataaaggttgcaatagcttacaaattagaaacaatagttaatgttattgttttctacttatatgataagtacaatgtctacttaggaatcacagcttcttcaaaatctaatctccagttcattgagcatcgacgaatgcgccatcgtcgagaatatcgatgccatatggttgtggtcaaggttgtgctggcagttgcattcatcgatatcgtggtgtttgtggtgggcggcctcggaggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctaaggattggggctccgcacgagagaatttttttccaattcaggggtagttggatgttgagtgttgagatcaataagctgccgcagtactatttatctagacgctggcagtcagagtcaagaccagacctgttgtaggccatcttcatctctgctctgctccaccggcagcctgaggagagtccaataaacatgtcacaaattcagatagcaacattttaaacatgcacaacaattaaacgttatttggaacctcagaatcagtaatcctgcaatcgtttggaaacgcattaaagtatcaaactaaacagaattggtatgtggcagcactacggatctatcagacaaactacaacctgttagcaacccacaatgtgccaaacaactccccgtcgcatacagatcatgccaatgctcatcaaaagtttaatgaagattaatttgcatagttatgcagcttctcaagtaaccattttacaaacatatcgcttaattatgctagaagcaaagacctgcatttagtttgttgatttaccttggcagcaccatcttgttgtattgaacacgcacagagagcatgtagccaagcaatccagcaatggccatcattacaaaccagaaaaacatagccccgatggcatcgccagccaagacaaggcagctcagcggcacacataggatggagctcagcagcagatacgggccaatatagcacaacatgtagccaagctgatgaaccgagacgaaggcttcaaacagtaagaacttagcagtgaaaatcgcccagcagtagatggcaatcccttccagaatcgagagaatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacctactagtccaccaaaattcatgttcaaattcgatctacacatcgagaaataaaaaagacaaatttagatataaacagtacgctactattcatacgctgaatttgtattttttatatctcgacgtgtgagttgagtttggacttaagattttgtggagttgtatatatgtgttgtatgaatgttgtcaaatttgttcagaattttttataaccgtttagatggtttttaagcaaacgagggaacatcccctcaaggggtaagaatagtttcccgaattaatccccttttcccttttttccgtttcctcccttgcaggcccgctcctctctccgttccgttttttcccttcttctcagccgttcccagtacttctaaaaaaatactactatcgttcccagcccacctctcgtattgcttctcttgtaacaaaattactagtcgaataattcctattgcaaccagtttctccttcctcgtagagaggcctttcgatcttagtcttacccagcgacgtcttgcgcggccatccgatttattcgagaagcgtccttttataaacagattgtttgcaaacacatgcaattagttttgctgtttaccttgacaggaccatctggttgtactgagcacgcacggagagcatgtagccaatcaatccagccatggccatcatcaggaaccagaaaaacatagccccgacaatggcatcgccagccaaaacaagatagctcatgaggcatacaaggaagctcaccaacagatacgcgccaatgtagaacatcatgtagccaagctgatcgaccgtgacgagggcttcgaacagcgcaaactttgcaacgaaaaccgcccagcagtagatggctgtgccttccagaaccgagagattgatcacgagcagggacagatcacgaggaggcaccttcactagcagagccatggccgtagccacaagcatagagaagacggcgaagaaggtcacaacgccactacgatgtatctcgaaggaactcttctcctcctcggtcgagaaggtggggggagccatgcgcatggccgttttctccttgccaatgtgctgcaggtgctcggcgaaggcgtacccgagcaggccggccgtccagcctgtcgcgaggtgcatgacggcgaatccggcgatggggccggcgaatgtgccagcagagatggccagcaggacgccgtaggagatgtggacgaagacggtggtgggacgcattgtgcgcgagaggatggagatcaagaagaagaggtaggcggacatgaggagggcgatcgtccacaggtgggccagcggctcgccggagtggcggcgccgcagcagcggcggcgagcacgcgaggaacaggatggagataaagcacacgcgagctccaatcagatcactgccttcgtcggagagactggtggctctggggcctccggaccggatcatcgccaagcccgagcggtcgtcgtcgaccgagtcgcgctcgcgcgccggcggcgggcgaacgccggaggggctctcggggaaggatgagtcgctggccacatcggaggtgtcgtagatggcttctccccgaaccaagtcctccgtctccgcgccggtgacggtgatcttgtcgccggcgacggtcgtcgacggggtcttgtcgtcactggtgatggtcggcggggtcttggcgtcggcaaggtggacgtcgacagcctcggcatctgcttcgccatctgcggcgatggccatctcagtcgttgtagtgttgtggggttgtaaggccggagtgagcgcagggccggcgacagacctcggcggcggcggtggaggaggaggaattcgaggttttggctttggggaacaaggcattttgctctgtgtgcaacacatgatgtctgcgagcctgcggctgtgggtcttcccggtcactatgttttgactgtttgatttgttgccaaaactagcgaattttaatatgatgataattaagataggattttatcatcatgcatttataaatatacaataataatttggtagttacatatatgtcaagttatagtagattaaaattttaaataacatacaaaatatgaacaaaatgatttattaagatattaacaacataatcacggatccaaagttagaaaacaaccttgctctgtaaaatcttagatccaagagcaaatctactgtacctaaggaggtaccataaggtactaaaaatttagtgtaaaatttggtacctcataataactagataccaagagataccaaatttataatagaaaaagtggtacctcatggtacctcctcaagaaccgtaaaattgctctagatccaaagttgtgctaaagaggaccataaccttccacttacaaatcgtactataaaatttgctaagaacttaaaccaaacaataccatcgtattagtgactcctttgatatctcgagaatatcccctattttcttgaatgtcattatgaatttttttacatgcttcgtaagtgtcatgtaggatcctaaggcactgtgacgttttagaattgggtgccacattttagcaagttcgggaaattgaaatatatgttaagagttcagggatctagatgatacaaccaaacaagtttagagatgaataatacaattttgttagatatacacccctcacatagagttcactcaaccaacacttgtatttctcgtatatcccaatgagacaggagttagaactttctaacacaacatttgtacaggtacgtacgtttggcgaaggcatgttcccaagttatactcacttgtttttcacacgcgcatattttttaaattgttaaatgatatttttttaaaaaaatagaaaacttgttttaaaaatatattaatttactcttaaattttatgaaatatattaatttattcttaaattttatgaaatgtatttatttaattatttgttaatgagttgtttcattttacatgcgtagggagagtctccaactcttacattctatatttgtatatatatatatatagctatacgttcaacttcttgtatattattgctttgtgtctaactcttttggaaaaaaaaatattgtatattcttggtttgtgtctataactctctttggaacaaagaacttacgcgcgaaaaaaaaactttttcgtgtatcctaatctatatacagctccactttaaaaatttgcagatatgtaggaatatactctctccatcctaaaatgtttgacgccgttgacttttttaaatatgtttgaccgttcgtcttattcaaaaattttaagtaattattaatttctttcctatcatttgatttattattaaatatacttttatgtatacatatagttttacatatttcacaaaagtttttgaataagacaaatgatcaaacatgtttaaaaaaaatcaacggtgtcaaatatttagggaaggaggtgtcaaatatttagggaaggaggtagtataaatttggagatgatgaagccgtaataaaccgagcgacttactactctttttcttctcctccaagacgaggggagcatctcaatctgcaataagagcgaagccccggtccaaagcagattaagatatcaactcatcgcgcccaaaaacccacacccccgtagccaaaacccgccgaggaagagggagaggagcacacgcatggcgctcgcggcggcgcccgcgaatctggcgggcaagcagagcttgcgagtcgtcgtcatcggcgaccctggcaccggcaagtccagcctcgtcgtgtccgccgccaccgaggcgacgtcccccgcgtactgtcccccaacccgctccccgttgactactttggcgaccgcatccccataacat

SEQ ID NO: 24447 - DNA, 9371 bp, Oryza sativa
  unsure (1)..(9371): unsure at all n locations
ttggggattttaattcgtgaccaatctgaattgctaatcaaggcaagaccaaaggtcaaacctgatccccaagtgccagtcggcgaatgtgttggtgctcacatacgcctgtgaccaacctgcgacgctggagcggctcagctcattctggttccccgaactccggcgcctccaggtgaggctctgcactcactcccgaaattgattggtaattttgtggattaattttgtccgctgtggctcatgttttgttctgcttggctcagttggaggcaccggtgattgtcgtgggatgtaagctggacctgaggggtgaggagcagggaactcttgatgccgtgatggcacccatcatggttgcattccgagagatcgagacctgcattgagtgctctgcgcttcgccagatcctggttaatatgtctgcagtcataattttgtgttgataggttgctctgagatagggatgcttggcacattgctgcacataattaagttaatagctacaacactagctagatcataattttattgtattctaggcatgaacttgttgtacttttactgggcaatacttttattatgtactgtgtttattagctaaccagtagcaccaagttggacagactagagtaatattaccaataataattagagcagttttaaaaattatgaaatatacaagaaagtattacacgatattctgaatacacagggacattctctctgaatttgggtttctttctcagaaaaacccaggcaactctattattctttgtttatataaataaaagtcgtattatgttttgggccataatttattttacaatataatattgacatctagggaattaacattcatgtgaaagtactttgcaatagaaatgcaatggtatcatcttgtatggcagtaaacatagtaacatactatatttgttaagtcaatagttataaattttgaattttccaaattcatgtgtgacttgtagttatcaatggagggagtacatgataattctgtctgatgctgttaggcttgagtccatggcctttctcatccatgactggctgttgtagcgagtccagcacgctgcgcgcgctatggcgtgtttccctcacctgcctagtctcccgatacttgtttccacaaatcggttgatgaaatttggcaggtgttggactgtttgtatcagttgtacaatgaattagttaattatcgcatgaattatttgaaccatcagatgcattaaaagtccagacattgtgctagtctctagctaactataattgcgtatgtttgcaggtttatgaggtcttctattatgcacagaaagcagtgctttacccaacagctcctctatttgatcaggaggcacagatgctaaagttacgctgtatgagggctttgaagcgtatatttattctatgtgaccatgacagggatggagcttttagtgatgtggagctcaatgattttcaggtttgtagccactaaagctgccttggtttctttgattagtgtaaggcaaactaatgcttgcactatcattctattaatacttctggtgatgttaagaatctccttttggctgctttacaggtcatatgcttcaatgctcctctccaacctaatgaaatcataggcgtgaagagaaccatccaagagaaattgactgaaggtgtaaatgaaaatggccttaccttgactgggtttcttttccttcatacccttattattgggaacggaaagctggaaactacttggaccgtgttgaggaagtttggctatgataatgaactcaagcttagagatgacctcattccagcaattaaacgagctcctgatcaagtaatgttgcccttttgttgcttccagctatcctgtgtactatctgtataaactagagtaattgtacatgtgcatgatcttaacactgatagttaattgttttagattctataaattgagttgctctgaattcagattttagaggtgaatttatgagaatttagggtaattgatcgtttgttatgctttttatttacagtttatatatacaccctttggtattttcatcactaacattactactgtggtaaaatatccgcactcttaagaactcctaaactgctctagaaaatgtgcttgtaatttgttagtcattcaatttgatgcgaatctatggtgttagcttcactaagcatcttcatgtttgatatttatcatacttctggtttattatatattttgctgataattaatttaaagtcaaatcattttttttgttccaaaccttggaattgaaaagtcaagtcattgatttcttgagagggatcttcaacatgtttgacacagacaatgtaagttctatgcactgatgtgattgttattctcctgaatcgtattcaactctttgttgtactgagcattttttgtaataaaaactgtcattttacattgataatttgaaaatgccttttggtataatatccaggatggagctttgcaacctgctgaaatcaatgatcttttttcaaccgcacctgaaaagtaagaagctgatagaacgccctttcatgtttaataacttgatactttcattgtaacaaaaagttaggttaccaaaattgttaaatatttcttgtattaatttctctattggacttgatgtaatgaagattctttgcattagaagggtgtgaagaattactatttaataatctgtctgttgatatttcctgtatcaatactcttctattggaatttcagtccgtggtcttctcatctgtacgagaactgtgctgaaaataatgtcttgggtggtttgtcgtttgaagggttcatctccaaggtattttctcaaactttgcatgataagagttgacacaacaattgacaaccctgtatttttttgttgatggattgaccttttagcaaattattatttgttgattggtttcaaaacaagaaagagaagccctttctctattcagaactcacacgcattgtatttattggtgtggctgtcctgtagcactgtgcaagattctttcatgactctaggaaaccccatattgttgttcttttaatctctatattcattgatctgtgcattctgagcatcaaaactaggtatggaatagattgcttacagtgcatgtaaagtattaagcaaattaatctgggagcaatcatatcttgtataaggagcacgcagtgtttaatatgaactatataatttgtcttgacaaacctgtgggggtgttgttaggcagaaaattgatctttgatttctagaattttattgttgctttaatcttgcgtttggaaaatactgaatttccttattggtctgttttcttttattgactaattattctgtaattgcagtggactcttatgacacttatacacccgtcaaatagttttgccaaccttatatatgttggctatcccggcgattttgattcggcatttaccaccacgaggaaaaggcgagtagaccgtaaaaagaagcagactcagagaaatgtgttccagtgttatgtttttggtcccagacatgccggaaagactgcattgctacaatcattccttaaaagatatcactccatagtattttatatcatgaactttgtttgccatggttatttcttctgatattctcactttcactcttggtccttgcaataggcaaccttccgatgctcctcctgtcaatggtgaacaatttgcagcaaatactgttgaactgcctgatgtaagtattcgaaattcttgatttattttgctcacaccatatgcaaccattttgatagttttattttgaacagtgcaacatttactcatgtattcgtaagtattctacagtctgagatgacagatactctttaaacaatccatattcttgtttattaaaaaataagtaactagcaacatatttatatgaaaccataattgatctgcatcttaacacttgataatgtgtgtcacaaacaagttagtttctaactgtttggtctgattcaataattttcttccactgaaggggactagaaagacacttgtgatgcgagaaatttctgaaggtgatgttggaccattactatcagataaggaatctttggcaccctgtgatgtagcagtaattgtttatgataggtatgctatccactgaattatccccctctttattcatggccataagttttgtcagttgcatttttctttcatggtcactgaattcttcctttttattcatgacaaaaatcctcaatacacagttttcagtagcagcactcctttcccattagctatagcagtatgatttgtttataaacctggcatactatgagagaactttatttttgctttagatgaaatcaattttgttgttgtgatgcatttgtattaaccccagtgacaaaaacagaaaccaactgccaacaaaaagagaaatttcagtcccccaaaaaataaaaaacagaaatttctcttgttttagagacacgtcaacatcttgtggtagctatcaagggatctaaacaaactagcagtaactggaggtccacagtttggtaggactggcaaataacatatgctgatggtaatctaaatatagacttgaaaccaacagctaactgcctgggtactggtatgggatgttcatctccacaaggaatatgaattagcagtacaccacttaaatagaataaccgactacacgatactgtcaattggctcgttgaagtgactgactttaatcctttatcctgtcaattggtttaaatattcgttgttctatgcgagccctcctgctgacagttcacagattcaggattgaaccaatgtagtaattcagaagttcgacacataaatattgtttattcagatgtacctctctctatattatctattcagttgtacctaattttctgcacacaaaatgtgatgctgttgaaatggcagtggtgatgaagtttcttggcaaagagcaagagaattgcttgtacaagtggccacacggggaaaaaacactggctatgaagttccttgtctgatagttgctgctaaggatgacctcgaccaatctccgttggctctgcaggactcaactagagtaagcttcaatacaatattgattcatttttaaactgttatattttatttacctctgagaatcatttgtcctttttggcacagttggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagccatgacatgggaatcgaaacaccaattcctattagtgtaaggttgagggatttgaacaatattttctgccggatagtccatgcggcgcagcagcctcatttgagcatcccagagactgaagctgggaaaacacacaggcaataccgtcaacttctgaaccgttccctcacggttgtctcaggtaagttagtgtcaagcttctgcctctaaagtgtgtttctgtatttgcctttatgctctggcacaaatcgatcatgccaattactacagaatagtaagagcacaggtttagtaagacaataaaatctaaaagtaatagttatttatgattttgagttgaaactgaatagtggttttatcttaagttggttgagttctaacacaactgatggtgtgccaataatttgcagtaggagcggctgttgcagttgtgggcgtagctgcttaccgggtttacgcagctaggaagaacgcgtcatcttgaagctctcctggacagtgatgaaatgctactctcctggacactgatgaaatgctgctattcccctcactgcccaacaacaggatagattagattatttttattgcttgttgagcttcgtaacatgctgttttctcttgcaacatcgtttatgtaaagatatatactcagttaaaatcacactggctgggaaaagggaatgtatatactcgatatgtccatgttgcgtcgcctattgaatttcagtacgtcccatgagccatttttgaactgactctaaaagatatattatagacagttctataaaagaaaaccctccaaaaagttatttaaaaaatcttccgtattgggatatcattacagaaagttcaactacacaactgtctgtggcagtctaacagatagaggaggagtgcttggtctcttggtaatttcgacgcgaatcgcaagtttgcaaccccaccagttacaaaaaatagggttgtgtttagttattgtgccaattttttttcagtatacggacacatataaagtactccctctatcctttaatataagggattttgatattttgcttacaatatttgaccgctcgtcttattcaaaaaattttggaattattatttattttatttgtgacttactttattatccaaaatactttaagctcaactttttgtttttgatatttgcacatatttttttaataagatgagtgatcaaacagtgcaagtaaaatgtcaaaatccattatattaggggacggagggagtattaaatatagactaataacaaaataaattttagattccgtccgtaaactaggagacgaatttattaagcctaattgatccgtcattagtaaacgtttaatgtagcatcacattgtcatgtcatggtgtaattaggctcaaaagatttatctcgcgatttacatgcaaactgtgcaattgatttttttccgttcacatttaatgctccatgcatatgtctaaacgtttgatgtgacggaaaagttggaagtttgaaaaaaaaatttaaatctaaacacagcctaggtaagatacacgattttgatatcattcatgtcacctcaaagtagaaaaaagaaaaacaagaaggagatatcattaatgtcatctcaaagtcaaaaaaggaaaagaaaaagaagaagaagaagaagaacgaaacaaaggctggtttagttcctaactttttcttcaaactttcaactttttcatcacatcaaaacttttttacacatacaaacttctaacttttccgttacatcattccaatttcaatcaaatttttcaattttagcgtgacctgcacacacccaaagaaggcgctcgaaacggcccgacgaggcgaaggcgccttttattccgtggaaaaagtacaccgaaggtccctcaatttgttatcgagttacaaaatcgtctctcaaccacaaaatcagatacccgatgtccctcaactaacaaaaccattcacttatcctccggtggttttgacgctggttttatctgacgtgacggctgagtcagcgtgggacccacgtgggcctcacatgtcagagtgccaggtcatctctctcctcccctcttctctcccttcctcatctctctctgacttctctccaatttgttgcgacgcgagcgacacggctgcggtgatggtggcgacgagcgacgcggcagcggtggggggaggagctgcggccgggcagtgggggaggggcgccgggggtaggagcgccgcgcgggctcccccgccggccgccacccacgaccacgaggcggcgtgggcagcgtcaagttcggcggctccaccgcgacggccggctcgttcccggccgacgggctagtcgggctcggcggcggcgcggtctccctcgtgatgcagctcggtggcgcggcgtcgctcggccgaagattctcctactgcctcgtcccgcactccgtcaacacttcatcggcgctcaacttcggcgccctcgccaatgtcaccgagcccggcgcggcgagcacgccgctcgtcgccggggacgtggacacgtactacaccgtggtcctcgactccgtcaaggtcggcaacaagaccgtggcatcggcggcgagtttgcgcatcatcgtggactccggtacgacgctgacattcctcgacacagctctgatgggaccactcgtcgacgagctctcccgccggtgcagtcgccggatgggctgctgcatctgtgctacgaggtggccgggcgggaggtggaagccagagagagaatcacaaatcacatcgataaacatctctagaagtccatcttgttcagataatcacagtacttatgtagaaaggatagtaagatacagaaatgcaaaaataagctgtgttactcctgcaaattgcaagtgaacagaacaatctcaagctaagctgttctttaatcagaagaacaggatatgaacaagcagaatttcaagatattttgtggcgccggtttcgctttcttacctcgctatagattctgtgagagatcaaattacatgacccataaattgtagagcaatgcaggagtaacactcccagctgagaaattgattgatgtataacactccgatcttcgatcttcgttaggcgatgcaatgagagaattcagaattctcaccaacagccagcttgctagaatagagtatgagttactgatcttgaatgacctcgtgtgtacagccaacaggaagcaaaccgaacaggcgagtccggacttgacgctggagttcggcggtggcgctgaagcaggagaacgcgttcgtgacggtgcagcagcggacgctgtgcctggcgatcgtggcgacaacggagcagcagccggtgtccatcctcgggaacctttgtcgccgccgactgcgcggggagcggccggccggcggaggagacgagcggcgggcaggcgcgctgcgggagcgggacggggagagcgaggacgccgccgccgtcgtcgtccatggccgcagatctcgcgcccgcgctgtcagcggcgtcgccggcgggagtatgtgattgcggggcagcggcgggcggagcaggcgatggcgggcggagcgggcacgacgacgaagacagcttcttcccgcgtcggcgccgccggccgcctctcccttctcaagcgtcgcagccgccgccgcctcccttatcccgtatcgtcgtcgccgccgcctcccgggcttctccgatggtccgacctccgaggtcgcacgcgccgccgctggacctcctccccaacgccagccgccctgcagagaggagagaaatgagagagatcaggaagggagagaagagggtaccgagctcgaattcgcgcctatagtagatgggttaatcagtanntcaaantcaacncacgg

SEQ ID NO: 24448 - DNA, 1482 bp, Oryza sativa
  unsure (1)..(1482): unsure at all n locations
gctgcttngtgaagtgagataccaattgactaaggccgaattcgagctcggtaccccccggtatctggttttcgcttgagggacgattttgtaactcgataacgaattgagggaccttcagtgtactttttccttattccgttgtcatgggctcattgtaactggttggcccacttgagaactggagaggcctatgttatgggccttggcttacgatagggcccacccgacggcgagccgtccgcgtacggggtcaacgcaccgagcaacggattcacaccggaccacgcgagctccttccgatgcggggcccacgtgcccaggaatccgaggcggaagggatcattccaacagctgggagatctccggcgccccgcacccggttcaggtggacccacgactccgcaactctagctcggccccgcgtcccgcggggcgcaccaacacccggaccacgcgacgaagcggagtcgtggatatgggtggcgcccgggcccaccgtattcgctgaacccatcacttcccgtacacctggcacccctacactcccgcacaccgcaaacgtaaacgcagtggaatccaaggcgacattgtcctcctttatccaaaaacaaccctgtataagacccttaacttacaaatagccccttacatcgttgtcagggaggacttatatctaaatatggataatgtttgtccttagttgaaagagtttcaaacccaaacagtggccggtggcttcccgcctctccccgcgcgttttcccgcttgaattcgttccgcaatccgagggcgggtagggctccacgtcaccgatccagctcctccttgcggtgtaaggagccgtccaattccgtcctttgcaagccaaattcctcccgccgccgccgccgtcttcgcctcctttataatctcccttctccgccgtctcctcccaagttccctcccaaatcccccatttcaaaaaagggaaaccaaatttctcggcgaggaggaaaagaatcctgcaatggagagcaaagcagaggcgttggctgcggcggctgcggcggcggccgcggcagcatcggcggcttctaccggaggaggacacgcgtgcggcggatgggagacgccgaagcgggaggagtgccgcatcccggcgacgctgccctgccccgcggcgccgaggaaggccgtgccggacttcgggaagaggcgcggcccgcccaagaacggctacttccagccccccgacctcgaggccctcttcgcgctcgcgccgcgccgccaggcctcctcgtgcgcttgattttgaagcttcggctgcggcggcggcggcggggagctctggtctagattaattttgggatctgtagatacttcgctatgtttctcttctgttgtactctaggtattagagtggattagggatgggcaagaagagggtttagggggtacgaaggacgttatgtgctgcaaatcttgtcccagtctcccagc

SEQ ID NO: 24449 - DNA, 14949 bp, Oryza sativa
  unsure (1)..(14949): unsure at all n locations
nttgggcatttttgcactctctctctctctgctgatgttattggttcttgaggtgattgatatgaaatcatgtactcatgcagcagtagactttgattaagacctttaatggcgtcgacatcggcggcggcagcagattgttgcttgaagattgtggcctccgggacgtcgtggtttgctcttttctgaatatctgttacagcccacaggggaatagctgtataccggcagttcttttttttttgcttcactttcatccgcggcatctgactaggtaggaataggatagtgatcaccgatcatgttgtagtagcttgaaggtttgaaaaggtccctggttgattcattgattcataagcagtagtactgcagttcagtcttgtcttgtgtttactgcttgtaccagcaatggactcgcaaaaaccgtagttttactgctgagatagtccaggtttcgttttgccaaggaattaatacgggcgggaggaaagcagagcagtgtgtgcgttcgttcttgaatctggatgcagttaatgcggctgtgggagagagccctgcctctgcagcatggtgtgtctttgcctcctccctagctggagctaggtacggtgtaccactagtaggagaaattgcaaatgcatgtggccaatgcgtgtgactagtgtcagggcttcatgagaacaatccgtggtcctgaatcaagcaaagctatagacagaaaggagagaagggaagatcttggtaacacggacagcttcgagattctgtgaccgacgagtcgacaaggacacaacgtatgctcgccatctcgccgcggtgccgcctgttgggcgaacggcgggggcgcatgtgtggtgttgggtggacgaggacgacacgccccgtgaggccgtgacttcgtgagggcagcgagaggaggccggggagcgtacgccatacgtgcagcgtgcggggacaccgggcagaatgagccgggtgtgcaattgcaagcagcacggacatggccatgtgatgcccccacgacaagtgttgcaagtgagatcgatcgatgccagcaatttttgtttcttctctagaaaaagttttttttttgcccgtgcttgcagaatgatatccatacacctatgctcgcgataggtcgagagtagttttctcaacgactaacacttgcgacttgcgaaacgtcgatcagtcggggccttggctacaacaaggacagcaactcggcaccggccagcctcgattagtgcaggtaatttcgcccgcaatctatggctcttgacagaggcagagagttcgttgcagcaaccagtagtattatatagttaatttatacagaaagattgcacattagcacgaggaaagtgcagcaaaggaggccccctcaacaactccatgacggctgtggaaactttcgtcaggaactgttactttaccttgaagccaggcacaaattctgtcgtagaaccacatctaactggtgacacaaaagtattttgtcccatcgcaactaacacgatgagttgtgctaatctagtactcacaggaccataacgcacagtagctcgaaaaaactctttttgtcagccataaagaacacctggttcatattaaaaactagcaatgtgcagagttccatatcagggaatgcaaaggtttaggcgttgtggctaataatggcggttgcttgtgttctaatcaaacaccaacagatctccatgcaaaatgtcccctcttacctccagcctccaattacaggatgattcttctcctcgtgccctgaactcctcttgcttatgccaaacgtacttataccaaagctgacaacattcccaatatgagacaaaaataagcaattttttttcgcactgcctcatctaggtttccatattattgtccagataacccagctgaatgtttgtcacctggaagaagatgaagaaggtgccaaatttatttaatcctagttcattgagaaagcaggcctatataagcctacaccagcaaaaattaagtactgtaatacctggatagctgcttatggttggtttggtttgttaccatgccaaaatattgacactatcaaaacctgtcaagttttggctttgtcaagattttggcaacacatgtgtaattggcatatttgttgccatgacaaacaattcgtttatgctaattatatttgactgggccccaatttaacaaggcgacacaagcatgtcaagttaaatccatatcggaaaagccgcttggccaacagccttctgttcacttgatttggatgactggatgaaatgaatcatatatagaaaaaaacataaaaaaagaatgttctggctccacttcaacaacttgcacacaagctccaagcaacgtaacggcactatttaagtcctttctttttccttttttctttttgttccgacaacattctcccaaaaaacaaattcttgagagaacaaaagaactagaggaaaaggttgatgaagttttatagaattgacctggagggccatgcatggttagcttcaaaggctcacaaataaaaaggcgcatgcaaggtaatgcagcggaagttgatctaagataagaaaggtgacaaataatgttgttttttacaagcaggaagcatgacctcctaaagcaagcctttcatgatccaattaggaattgatatttcaccttctatgccttctgtgaaaattaactggctctcaaagtcatatattattatgcttttttcatcaaaaagttatataggtatgcttcatagggaggacaacacactatactactagataacagcaccaatcttaacattgcagcttattacacacgcctcttggtttctttttccaaaaaaaaaacaccagaatatgttttagttaattaatatagtagtccattgtaaatcactaaattagtgtggtcatcgcatactcgcatggatgtagcaatacatctgaaaattagctgccttgccgaaaactgcaattcgatatactcaatagacagcaagcaggccctctgcactccctagccaggtgcacaaagcaggagcaaagagtggcccaatagcagtttttttctatggactcctaccaactcggccaaccactaccacgctgtgacctcccaccatgcagggcacgaacccatgatgatcccctatatagagagcccgtactcatttctcgccaagtgcaccacttcactcttgcttccaagtgcaaccacaaaaccagttcaaaagctgcgccccggcagccgcacggcttgggctgggcatccgaaatgggcactccccgtggcctacgaaatgccggctcctcctcctccgcatgccgcttcctcgccgcctttgccgtcctcctcgccttgccgacgctcaccgccggccttacccgtcactacacgttcaatgtacatctctaacgagcatgatcgatatacgtacatggccggccgtgtcgatccattcttgatgtgtggctgcattgatgtttctggccgtgttctgcaggtgcaaatgacgaacgtgacgcggctgtgcgtgaccaagagcatcccgacggtgaacgggcagttcccggggccgaagctggtggtcagggaaggcgatcgcctcgtggtcaaggtgcacaaccacatgaactacaacgtctcgttccactggtaatgccaaacaccatcgcacacattcttgcgcaatcccgcaacgtattcatgcaattcgatcgtgtgtgatcgatctcatgacgatggcaatgatatgtgcgtgcaggcacgggatcctgcagctgcggaacgggtgggcggacgggccgtcgtacatcacgcagtgcccgatccagggcgggggcagctacgtgtacgacttcaccgtcaccgggcagcgcggcacgctgtggtggcacgcccacttctcctggcttcgcgtgcacctctacggccctctcgtcatcctccccaagcgcggcgagggcttcccgttccctcgcccctacaaggagctgcctcccatcatgttcggtacgtgacgcctctcccctgtgtgatggcacttgaacttgaaattgtgacggtgtttcgtaatgcgtacacttgtgtaggtgagtggttcaatgcggatacggaggctgtcatcaaccaggccctgcagacgggagcaggccctaatatctccgacgcctacactttcaatgggcttcctggcccgacttataactgctcgtccaaaggtgagatgctctgtcctctcctgattggcccatgaattaatcacggatttgtctgtttatgtctctatgatgctcgtggcagacacgtacaaggtgaaggtgcagccagggaggacgtacctgctccggctgatcaactcggcgctcaacgacgagctcttcttcggcatcgccaaccacacgctcaccgtcgtcgaggcggacgccaactacgtcaagccgttcaccgccaagacgctcgtcatctcgccggggcagaccatgaacttgcttctcaccacggcgcccaacccgggttccccggtctacgccatggccatcgcgccatacaccaacacgcagggcacgttcgacaacaccaccgtcgtggccgtcctcgagtacgccccgactcgagcgagcgccaccggaaacaacaacctccccttgccggccctgccgcggtacaacgacaccaacgcggtggccaacttttcgagcaagttccgcagcctcgcgaccgcgcggtacccggcgcgcgtgccgcgggccgtcgaccgccacgtgctcttcaccgtcggcctcggcacggacccgtgcccgtccaaccagacgtgccagggcccgaacgggaccaagttcgccgcgtccatcaacaacaacttcttcgtccgccccagggtggcgctcctggaggcgcactgccagcgccggtacgccggcgtgctgatggccaacttccccaccgcgccgccgcacccgttcaactaaaccggcacgccgcccaacaacacgttcgtgacgcacggcacgagggtggtgccgctcgcgttcaacacgtcggtggagctggtgctgcagggcacgagcatccagggcgccgagagccaccccttgcacatgcacggcttcaacttcttcgtcgtcggccaagggttcggcaactacgaccccgtgaacgacccggccaactacaacctcgtcgaccccgtcgagcgcaacaccgtcagcgtgcccaccggcggatgggtcgccgttcggttcctcgccgacaatcccggtaagaatctcggcatcacatttggcaaaatcttggtttgcatcgacttccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgttgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagctcgagagtaagaaaagcgatcacattatcttactatctgttataaaaccagccccgaaatcgacgtcggtagctaaacgcggaagaaaacgccataggagatccaaaacgacaacgtcaccgagatacgatatttggtaccggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatttatgagagatcttaggatagagtccgactcatactctagtcctaatacctattacaactccaagtcctaaattgtaaccaactacgtacacatattcgacacaaactctaacactatctacaattggaggaaaaaaaacgttgctatctactatacacgtaatcggagatgctataaacattactcaacatgctttttgggacaaaatcacaattatttctagcattgtgatctgttacgtgattcatgcttcagacgagctattaggtggttaggtttcaaggtaaggagggtgagggatgaggaagttcagaaatgctaccccccctctcccccttcctccacctggtttccttttttgacaccgcattactttcctattttagtaaatttatacacctaaagtttatacacctcaagtttatacatctaaagtttagataccaaaagtttatatatccgattcaaatttgaatttgaattcaaatattttttttatatatagtatttctatacatctaaagtttatagacctaaagtttatatatccgattcaaatttgaatttgaattatatccgattcaaatttgaatttgaattcaaatatttttcatatatagtatttcgatacatctaaaatttatagacccgattcaaatttgaatttgaattatatccaatttaaatttgaatttgaattcaaatattttctatatatagtatttctatacatataaagtttatagacccaaagtttataattcaaaagtttacatatccaattcaattttgaatttgaattcaaattttttatacataaatttttctaactttttattttttttaaatttttttgtggtgtactgtaataagaaaagaaggggagaagggagccgcggccgcgcgatgaagttggaaagtgtccccgacttagtgcaatggacggagcgatagtggaatcatctcagccacgagagaaggggcatgagtggtgggccaatgttggtactggggaaaactcattgttggagtcattacgaggtggtgagaggtgatatacggtgtatctaatggatggtggcgtgagggcattgagttgaagaagaaagagaagtgatgaaattgagttgtgagtagcaaatgctaaaggcaatactggcaaggcagagggcggcaaaagaattgtgacatgcggtaacggctaggagtgtaagtgggtcagccacgaacccacttatagatcaaaataagtgggtgtggtttattagactataagtggatttcgtgggttagctacttacatccctagtcacgacatatatgtcaaatgatacataaggatctattgtttcgcctattcgtagaataagccaaacgatatatttgtaaacgaaaagtaatttgtgaagaaaaaattatatgtgtgttcttagcgatctaaaagcaaagactgaaaaataaacttcaataaaatacctcaaaatcaacaccaaatttaaggtttaaaatttaaagtttagctgataagtataagcataagcgaaaagatgaggctctacgattttatttgtgatagaccataatgtaataatcttctttgattgcctaaatgaatatttaaaagcttgtagcatctagaaattatgtcccagttatgttagacatggaaattccaaattgtacttcatcagctacttccttcgtccatgaaagattgtacggacggaggaaatatgcatttactttggggcttaaacgatttgtttaacaactctaaccataggacgacaagctgttgttgggaccataaactaacaatttgtcttgttttggagctagtggctattaaaggtgatatgtgtaggctttaaacttgtactgatctatctgacaaaactgattaataactgaggcgttcagcaaatatataaagcatgcgttggcataggctaaatctttatatttcgaaaagaaaggatgtagcccaaatctaaggttacttaattaggtggacaaaagctagttaattactatgctaaaaatttgaagtcgtgcgcatacgtgcttataaattagaggactcaaatgtggagatgaacttggcattgtgagacgagtaaatcttctgatgaatttgatggcaaaagagtttcttggagatggcgcatcagtattttttttggtgttatctttttcttttgtgtttttgtgtgtgttttgtgtgggtggggcgctttgccacggccaacttcatggtatagagaatttcttggagatgcatactgactatgatgttatgccaaggcacatatacttaaaaactagctgggtggcccgcgcaattgcgcggctagcacctaaacaaaatcatatattttttaagaatgattttacttaaaatttattaaatagctatctcattgtcttaataagactttaaaagaccaaaccttatcatcctcgtgtttctaattatatagtttttaaaagtcacaccagttgctaccccttatgtcatctccttctttatttgcttgctcgatctaccactatttctattcattcttcttgtaatctttaaaaattggattttatagtttttagtgtttattgtcacattgggtttcatttttataatttctagatgtcctatcaaacgttgccattatacttctctacggcctatccactgtttcttctctttattgtcattgagattttaaaaattaaacatatttatcgtttgggttcatttttactttctagaagtcccgccaaaccgtcagcggctttgccattgtactcctctacggctcacccactgcctcccttctttattgtcattgagattttaaaatcgaacatgattatcattgctttttttttactttttggaagttccgaacctttaaaacttgaacttgtagtttcattttttataatttttagaagtcccatcaaacgatgccactatgcccctctatagcccgtccgccgccaactatttatcgtcattgtgattctaaaaatcgaacataactatcgttggaattcattttctattttctagaagtcccgtcaaccgttggcggctctgcaactatactcttaacaccgcgcccgctgcttctcctttttattgtcattgagattttaaaaatcgaataaaattatcaatggggattattttttttactttctagaagtcctggcaaccgccttacttatttgtttgcttcttggcctgcctgacgtccctccttttaatcgtcattaggattccatttggtgttttattaataattttatatgtcgtatcaaccgccaccactctactcctttataggcttgttacttaatttatctcgtcatgtgttttagatggtcttttctttcaatagtcttcatttttctcacaaattttagttatttataaattgtattcctaattgaaatcttatttttctttttctaatttcagaatttatttttaaaaaaaatttagttaataccttattgtgttcatttaatgattttattttttattttcaatttcagttgtttcaaaattgtattcctacttgaactctcttttaatttttctaattttggatattattttattttttattcgaaattttaattaatctcgtattgggttcttatatagattcttctttcaatattgcttattttaattccgaatttcagctaattttaaattgtattcctacttgaactcttattttattttcttttgctaatttcggatttatttatatttttattccgtattttaattaatctcgtattgggttcatatatggaaacttctttcaatattgcttatttttaattccgaatttcagctatttttaaattgtattcctacttggactttcctttccttttctatttttggattttattttttttatttcgaattttgattaatctcatattgggttcttatatggaaacttctttcaatattcattatttttaattccgaattccagctatttttaaattgtattcctacttggattctcctttccttttctatttttggatttaattttatttttatttcgaattttgattaatctcgtattggattcttatttggaaacttctttctatattgcttatttttaattccgaatttcagctatttttaaatattatttctacttggactattcttttcttctttttcttcgattaatgtgggaatttctagcctccacagcgaacgtggtgcctcctttcaaggctgttttaataatataatagatagattattgacgatatgttatagtgggttttgttcagacttaaaaaaaatgttagaccaactataccggttatctaatccatatacagtttctcctaattcgattcatatacagtttagagctgaggggttgtttaaattgtagccaaaataaatcttgttactaaaactttaaagaaaatgatgtggtttgaaatgccatcaatatgaacaacacataagagtctaaggtaagaagagtctacaaaagttgttttagtaacaactaaaaagaaagatcaatcgaataaagctacgctcagattgaatggttttacctacgaggaagcactttcgatcaagacctaaaagcacacacccactactgtttcccgacgcctactattttttctactccctccatttcaggttataatacgttttgactttaatcaaagtcaaactgttttaagtttggctaattttacagataaatatagtaatatttataatactaaattgatttcatcaaataaataattaaatatatattttcataataaatttgtctttggttgaaaatgttctttttcctacaaacttggtcaaatttaaaatagtttgactttgaccaaagtcaaaacatcttatatcctgaaacagagggagtagacaacataataaaatttcatctttacttaatgagttacaaccaattattacacaaattcacacaataacgagcacacaccaacaaatctaaaaaagctcgcccaaataacatgaagcaagcataaactaatatgcaccaatacaaggtaaagaccccacaagatggtgaaaagttgcataccatttgactcgagtttacgacatgcagtatttattagcttaatgtcatcatcacacctttatagttgagcctaaaaccggatccagcacgttgcccaaaaaaaacctacatataatatttgagcggtgatttgtcaaaaaaaaaacaaatcatttctcctaaaccatagaatccaacatatagcatatgctcctaaaataataagtttcatgttttctttatcaatacccacaagccaatccccaaagatatgagatgaactatgtggaggatataaaccataagaaacctgtaatgctctccagagcaaaatggcactccatgaataaatgatggatcccctcatttttattgaaaaaacaacatctcacactaatatttcaatttctcctaaccaaattgtcctttgttaacactatccctttaagcaaataccacataaaaatcttaatcttaagaggcatcttaagtatccagttaattttgttcctcccaatataagtattattaattaaagctaagtatatagaacgaaccgagtaactattttgatgaaaatttcatttaaatatttcactttcttctgtcaaatggatatgcacaattgaagccattgttatcaagtcgcccgactagtcgtgattagtcgtaaagtcggtcaagctagtcgactaaagagccatgacttgaccaaatagcaagtcgtgcgattagtcgtggttactcgtggttagtcgtagattagtcgtaaattcagccgtaaattagttgtgattagtcatagcaaatcaccaattcaccatgctaattggcttattgtgtttagtactttagttttatttcttgtcgacttattgttttgctttgcaactctatagtccatagtttatattatatacattccttagcacagtataatactagtaaagattatatattgcatccactgtttttgcatgaccaagtcgtgggctagtcgtggactagtcgaccaagtcgacaagttggttcaggggtacctcgactcgactttacgacttgacaaccatgatcgaagcacacaagttatgccaattgaccaggttatagcctactaaagctctttaaaaaacattcagcggaacagaactcataacatttgcaatcgaagagtatctccttcaaactatagaatacaaaggcaggtacctatctttaaaggaggtatttcctatccacttattcttgcagaatctgacttgttcactattattaattatctaggaacccatatttaagaatgtactcttaactttcataagtcccgacaaaaaataggaaaccccttctttcctctcaacttgatttgttgatagattatcgaagtatatttttttcaataaatcttgccaaacacattgctaatttattagcttaaacaaccatttgttcaataaacattggttttgaattttcaattataaactccaagtccaccctgattttttgtcagacatataatatcccatcatgcaagactatatttctttttatgttcatctccttgccaaaagaaacgtgatatgatatgtaataatcatttaactactaagtttttctcaattattttccagcctttgttgctaagatttccatgatatttttctcaggtatgaaagtttgagttgggctaattactttttgaacaacctcagtaattctatttgtagcaatttcgataaaaaaattaaaactaatattaagtaagcaaatagatttatattgttgaatctttgtaatctttttacacttagatagtaatataatattatcaaaataaacaactctatcaactgctgattcttgaactgcgtcgtacgcgatcgtatgtgcatatgcgtacgtgtcatcgggctgacctgacacatcgaaggcaatatggcagacagatatttgctgccccttgcccgtcacctactttcctttccctgtattctacgttaccgtggcttgatcacatacacgcaattattttgttcagaatttacggaagcaaattgctccacatgcatcattgcatcacccatttaagagtgtgtttagttcacgttaaaattaaaaatttggttaaaattgaaacgatgtggcgaaaaaattagaagtttacgtgtgtagaaaagttttgatgtgatgaaaaagttaaaagtttaaagaaatatttcggaactaaacacggtgtaatagtggggagagtacataatgctactataaacgagctgtagactatctactcgtattgttatactgtggactgcttcaacagtatcatatctgactcaagccacctgtatggctgtatagactatctgtccatgctgaacattttgcccgaagctctgtcgcacgtacgtacggcgtgcgtccgaactttcagcgaacgtgtacgtacgtaggcgaacgttgtgtttttgccacatcggagatctatctgatcgactcgtcgacgtgaggaagaaaaataaaaattaccgtaagagatctgggcgaagcaaagaagcggatcacgcatcctaggcactgtgcgttcatagtgcgtccgtacaccagcagttgatcagactccacagaggttcagagccagcacgacgagtgccgctacgccttggtcggagacaagcgccacagatgcaccaacgcaatgccaacatggctgtaatcagttccgctcttcccttcccttccctcggttcctcgcagtgagaattgtttgcagtactgttaatatagtagtagacattgacgtgtgagtctagacccatatgtcagccacgacaactgtatcagcgctactggatttgcatccggctcctcggcgaacaaaaaaaatctcgaggagaggaggcctgttccatctttgaccggccgggctccacggtcgccgaatcggatagccatgagcccgtttgatttggcccaacctggttttaatcattggccatggcgacgcagcccggcggcgagcgagctagcagtagctgatactgacatgtcagaaagcggactgtgacacacacaggagcgcccagcgagctctctcgttgttcggtcgctggagtacttggacagttggaccaaaagttgatgagcacgcatcgtggaactgcagttggggaagccgggacaaacacaaaaggcgagcgggcagcggagacaggaggccgatcgatcggcctatggacacgggactcgtcacgggtcacaccgggaagagattcgccgagatttcttttttgagcgcgagcgaatgaatgatcgatcgatccggagaagcagagcaggcagtacgctgttctttttttttttttttttttgaccgtcactacaccagatcctcacatctctgatgggatacctgtgacgggcaatcgaaatggtcactaatgaccgtcacctctgacgggttatacgggatgccgtcatcggtgaggcatccggctgcgacccgtgacaggtaactagttacctgtgacgggttaaaaatagaacccgtgtgaggttacctcacctcaaacgggtttaagtcctaacccgtcataggtnnnnnnnnnnnnnnnnnnnnnnnnnnnnnnnnnnnnnnnnnnnnnnnnnnnnnnnnnnnnnngcgactcg

SEQ ID NO: 24450 - DNA, 7453 bp, Oryza sativa
  unsure (1)..(7453): unsure at all n locations
ggagagttttggaaaaccccttggagaagaagcgaaatgccgttgaagagggttaatacccgggggagaccgcaaagggacaacacctacggaacaaaaataaaagggattttaggttttttctgcaacaattgggcgaatggttaatacaaaaaaagttaaaatgattattaagttaatagggacaaacttaaggatggacagtgtttaaggaacaactttacgtttttaattttgaaaaaaaaaattaaaaaaaggagtgggacaaacggtatgaacaaaactttagaatcacttaaattatgggccggagggagtagtatatctttttgcttaatggcatggttcatttcttccggccaacatgaaagggtgcaaataggtataaagaaaacttgtattgagggaacctagcacttgtggtgaggagtgacgaagtggaacaggtatatttttctttttttggaggggagcacggcagggtgacaacctggtcagaagggaatgggtgacgccggctttgatcatcttggttaagcgtataggcaggccacaacaaccgccctctgccagcaagttctctttcacccatgtattttgtcttgtgttgttcatattgttccaattgttgctactgtgattgatgattctgagtcctatggtgattgagattcttgtgattttgttttgtgattgggacaactgcgatgaaacaaagaagaattgtgacaatttttttgatttgtgaatgccaaatgcaatcggtctaaatgaatgtgatggtaacctatgaggacggtgtttctctttttttttccctttttttcacaccagtgacggccccaattagttaggccatttgaggtgactctcacctgtgacgggttttggttgggaccagtcagaggtaactctcacctgtgacgggttttagttgggggccgtttgaggtggctcttacttctgacgggtcttcactcgtcacaggtgactcaagtcatcagtgaccactaatctctgacagggagctgaacccgtcaaagttgagggtttgagcccgtcagtgctgacctgatccagtgtagtgcgtggccatggccaacttggccatagatggtttaggcataggtaaggtggtggaaggagcatggtgcgttgccggccggaggagggcccatcacggctgcgggcttgcgctgtggccagggtggccgaccgcccgtccgtccgtcgcaacttcccgaggcggaggacgacgagcactgccgctgcctctgcccccgccctgcctgcgctgtagccgagcgagcgcggcagccagtcccccctcttccccggtccaccaccgcgcgcgcaggccggccgggcagtctcagtctgatcctctgccctgcccggcctctcgctcgctcgctcactcggcgctcgctgctacagtttaaagctgacggccgcggctgcgtgctgacccacccacgtacaccagccacacacggggccgatcgctcgctcgctcggatgggctatggactgcagccgctgccccctcgctgcgacgcccacttgatcccctcaccgcgcgcagccgcggaaacgtgccgtgtttatccgcgggcgggggtagggtggtgtgactgtggaccaacatgagaaaccctggtgatgcgcgaggacggcgcatgccggcatccgtgcgagagtttgggggaaatctctgcgcggtggagcgcaaagcgcaacatcggatggaacgcaattcgtacggcgttggttgtgtgatctgtgaacctttgtgatttgtgaacctggcggaggtagcgaagctttaagccatttggagcaaaagttttcgggggactcgagcttttgacctcacgcacgggacggcaccgcatcggggccgctcgggccggcaactgcaaggctgccggatgcgtcgaccgtgcgtatgtatgtatgaacgtgtatgcgtgtgggggtgcgagcagcggcgcaggcttgtgtccggagtttgaacggtcgtctccaacaagagcactgctacggtgctctctacttgtagtattctattacaagtagaagcaatctgagccattaatttataagggcaaattagtattttactaatttatggttaagggtaatttttaacttttacttttttttcttaatagtaggatcagttcgtctgtgtcaccgctcctttcgttctcgcgtgcgcccgactccggcggcagtgcccactccggcatgtgcgagctcctccgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctagttatatgtctccttcttgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaattgatatgcaaaattacgaattcaaccatccccgtccatattttttggacgattataccctctgacgtttctactattgctatttaagataggagtataaataaatctaacccattagatataaaacgatcaacggtttagattaatttatactccgagtggaaagcactggagtgggactcctccaacaatggaagtacgtagcagtaggagtagtttagatttcctgtggtactagttgcatctattgttgtggcttcgctggtcaaatttgctgttctacacttcataacagtagtttacgtaggagtactttactcgctctctctatatagtgcaacgaccgtcaagatatctatagttcgtagtagtactgggtttgccattcgtcaaacgatttgccttctcaaaaatggcagaaggcgaggaaaattagccccctcacacacctgacaaacccttgttgctgcaccagagcaaagaacaaaataaaacgcagagctttcatttcacggcagaggccagaagagcaacagatagtcgtaggaaattaaaaaatggggcgtcagccttgttccaacagcgaaaaccctgcataaacataggaaaacaccaagtgggtccttttttgggacgtcatggccctacgtgcacacatccagctccattatatagccatttttatgcctcttccacaggagcttctgacctcggtcactctcactctcatcagcttagctacactctctcacacagtctcactccccgtgattctgcccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcgacggcggcgccggcaagagcaggccgtccttcacctgccggtgcgtgcggctcgtcaaggagcagcgcgcgaggttctacatcatgcgccgctgcgtcacgatgctcgtctgctggcacgagtaccaatgagagggtactcgatcgatcgatcgattcatggagggggcgagcaaatgcgatgaagctctctctctaggacttaaggaactttgtgtaaagagaatagtatcttttttccatttcttttcctcattttcctttccttttttttttcctctctgaggagtagagcgaatgagtggtgcagtaggccggccagtagcccagcatgcgtggtcgctgcactgcgcatttttatttctaattttttgatgtcatgtgagcgcatgagcatctaaatatagacggacgtactcgatcaaaatgggtgggtagttcttggattctgctggtgcagtggcgcttactctattccttctacttccgcttccggtgtttgactccctcgacgtgcgcgcgtgcgtgttggttcatcggagtgcgaagagatactcctctgaatctagatttggacggctcgccacctgccattttcctcaccctggcagaggattccattgcgtttcttgttctcctaccccaaaaaaaaaacacaccaagaaagctaccactaaaaccaccgtcactttccggtaaatccgttctcggcatcatgcaagttgcaactagtaaagcacaatccttgacagtttacgctggtgatttttaccatcgcgtagaggcagtaactcgcggtaaatctcgctgcatgcgactgaagggaggggggccaaattccgaaaggtaaaagaggggagccgttaccactagtagcattctgatgagccccctgacccggaatgaagctgtggagtgtggacactcccgaggaggagaggccccaagtgtgctgacgcatcgaattatttactcccaaaacgacgcctccgtatctgagcgcccctgtgagctgcgcgccatcaccagtaatcaaaaccctctctctctctctctctcacacacacacgcaaacacacagcttggaccttggaccaaatgggctcgcagtgtacttggctactttggtgaagtctcgcatgctccgatgctcctggcttggctacgagtatctaggagactaggactaccaacgggtggttcaacgatcgagtactctacctacttcacgggcatgcatccgcccagatttcggcctcactactatagtaggagtgtagtgtcgatcctgtttgagacagtcatgaggttatggctcatcctcatcatcatcatcatcacgaagagcggcagaagcttttttttttccttaggcagaagacagaggcagaggtcgtcagtcagtgtagattaggtatacttcgtactgaccaccagcttcgtgcgcatgcatgaatggcgaagtggtggtgtaactgacgatcgatttcgggaggtcgtcttctcttttactgttcccgggaagcacgttttctttcctacgtaggacgcggtaggagaggtgagtgagagtaggtagctgctgcaatggcgcatgcattgcagcagcgatatatgcgtgcgtacccagcatcttcggctgaagatgccagggacccatgcgtgctgcgatgctacgaacgttgcagaatcagcatgatcagtggccagtagcaagtttttttttctttttttctttctttcttttatttttggcgagcagtgtccagcgtgcagtagtaaagtggtcctatgatcctactgagatgagtgatgagtactcactacctaggtcctttgctctttgcaggtaaccggcgagtaagctaggagaggatgcacagccgcaggacccccccaccatccatgcacagtggccttcacaagctcgcagagctcagctccggctgcctgcactgcactggctgcaacatacggtttctgctcctgtcccccctctcccctccctctcttccaggacggctgctgcattcatgcccctatccagtatccggccttttgtgcttggatacttgcatgatcgatgaagcgtgtgtcacggagaggtagcaagggcagatcctttagagcaagtctaatagtatagcccactactagctataattcatctatacccgatttaatagccaattcatacaatagttgcttactacactattaatatatggtctcacctgtcatacacacagtatgtcttggagtccgtgctgcagctggctacaaatctgtagcccgctgctcttctctctcatcgtttatctcattaaaatatatttatagctggctaatagtctgctattgtacctgctcttatgtgtgtggttgcaatgattccgaccacagtgtgggtgactgttcctcttgatatcttgcatctggtaacagtggtgacaagtggacgctgatcagctacatgcatagttcagggctaatggtcctatgtagtagtatatttgtaaggcacgcagatgagaatagtaacaaaaagcataagaattgatgctagatagatttcattcggtgtttcagcgcataaaagtgtagctgaagttcgaaaagaaaacatgggcagaagatgtagttaagcttcagaatcttcagataagcaacaccatgtactatctcgttatctttacacctatgcgttatcaacacagacgtgggctgatctgatacgaactctgcacacgacttcttgactttggccaatataatccgtcactgcactgaatgcctttgcaggtgtaggtcgcccagatagtagcaaatattctctctactcgagtctcgtcatctcttatcttcagagttcgcactcttcaagaatacaccgggcaactcgccgaagaagaagcttcagcggcagaagaagaatcacccatcgagagttttcccctcccaaggaagatcagggtaattccgtatctccttcctcatggaaacgcactagttcatctttaggcccaaatcgaaaaagtttatatatggctagttcttgtgcatttttggtggtgtcactcatttcagtacttgatggagcatattattcaggaagaatattcagggaacatgattgtccatttttcatgttttgctcgtttgctgggataatctcttaggcattcaattttaaggaatcagatatcagcgtaccatgttttttcattagatcctaatagttttgtttttttgagaaaatgcattcttggatcaaatagaagaaataaaattttaaaaaaatgcataaaagtaggaagaaattggttgtggtttgcttcaactatatgctagtgggttctatgctgattttcaggatctcttcttgagataaaaacagtcatgtctgagaccatagatttaaccggagatagatgcattcttaagacagtgatcaggagagcaaaggatgatgctactgcaccttcagatagtcttcccattgttgatggtattgcagctatctacacatcttggtcttgcttcagtacacctattcttcagatttacaaaagcataannnnnnnnnnnnnnnnnnnnnnnnnnnnnnnnnnnnnnnnnnnnnnnnnnnnnnnngggtaccgagctaaggttcgccttggagtgaatcgtatagcaaatcaaggncgcg

SEQ ID NO: 24451 - DNA, 744 bp, Oryza sativa
  unsure (1)..(744): unsure at all n locations
ctgtccaatggtacgcctnnnnnnnnnnnnnnnnnnnnnnnnnnnnnnnnnnnnnnnnnnnnnnnnnnnnnnnnnnnnnnnnnnaatcgacgacacaaccgagctgtggtagctgtcacaaacagactcgacacggatcctcgttacaccacctatacgctaagtgaactggctagcatattgcggtgcgacatatggacacattgacaccgtgagtgataaaagcattgtgctgcagccagacaccatttctgtcataacaagctgctactctagtacacactatctacgccaaaatcaccgacgtagagaagttactctaaaacaacttatccgacatataatcatatgacaccgttcataacaaaacactaaaacgcacatcaaatgagggtacagaagcttgacaacaacgatcgaacatgatcctattccgtgaaagatacaaaagtgctcatatgatatggagaagccactaatagatggcactgcgtttcttcataaacatatgacatgaacattcgtacatcttctaagcaaatgacgtctcatacttaagaaggctcaccgctacagggaaagcatggcatggcagcaaccgcgagcggattacagatagcagctggttcaaagtgctgagaatacgcgtatactatcaggaagctgatgagcgagacgcaatctgctgtatctggttgacagaagtcgatcgctaccattatgatgagatcggaccgcagtggg

SEQ ID NO: 24452 - DNA, 9466 bp, Oryza sativa
  unsure (1)..(9466): unsure at all n locations
ctgatgcctnnnnnnnnnnnnnnnnnnnnnnnnnnnnnnnnnnnnnnnnnnnnnnnnnnnnnnnnnnnnnnnaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggagaaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcttatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacatccacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgctcccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataatttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataagattataccccaagaatggtcctccgctggagtttgaggcagtattgcctccgtaggtctcttggtccatgtacatgtgtgaacctgtaatgcagagttaccatttatcttggaaatcatccatatcttcaatcaattctctcctagtagtttcaaggcggttcaaaaaaaaaaacaagtgaaatccacatatttatctagtttggaacaaagtgcacaaccatgaaattgagaggttccatccacctgtactattttatttattccctcacctcagattagactcatgctgtaactaaggtatttgacatctacaaatggagcctttcaaagttaatttctactacctgtaaagactgttgtcaggaaaaaaattcaggtttaaaaaaataggaaaaagattcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcggccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatcgtctctgcacctcgtccccttcctcgccagcgccgagcacaaccaacctctgacagtgtggtcattgcgcaaagtgtaagctattcacttcgcgtgaaggataaagcttacctcctccttcaaggcgaaaatgacgtgttatgttggatgccagattctccagttttgcaagcagcgccatcgcaattttggactagctaatgtgcagctttcccagcctttgttccaaaactgtgtggtagctggagtctctgctttgtcagcaaggccagatgaacacacctaacccgtctctctgcgttgtgctgctgaactgcggctatctgtacagaatcagatataatagcccatctaccttaacagtcactagttttagaactataaagcttgttatatggatttccaggttattagtactatttgatagtaccttttcttctagttggagtacttgattagtttttgtgccatgatccgtgcaccggacttgttttggttggtcttgttgctgtctcaggatctgtgagctgatccatgtacctgtctgtaatagtatttttaattgccccttttattcttatgtaaatacagcatcacctttctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgccggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcatggacgccgccatctgcgtgttgttggggccctggcaggtcatgttcgccgggcacggcagcgtgcccagcccgaccgtgaagaagaatcgcttgtcaaccgactgcggcacggccgccgggtactccggcgtcgcgaggctacggagcttgtcggtgaagttggtgacgaagtcggtgtcgttgagctgcggcagcgtcggcttgaacagcggcaagcccttgacgaagctcgccgctgagggcgacatggcggggttctcgtactctaggatgccggcgacggtcgtgttgccgaaggtcccaggcctggcggtgaagtagggcgcggcgaacatgtaaaagttggcgccggggtagtacggcttggcggtaaggagcacgttggtggtctgccccggcgagatcaccagggtgtcgacggtgaacggcttgacgtagacggcgtcgacctcgacgacggtgagcgtgtggttggcgacggcgaagaagagctcctcgttgagcgcggcgttgatgaggcgcagcatgtacgttttcccgggtttcaccttcagcttgaacgtgtctgcatccacgcgcacgcacgcatgccaacggtaaccagagtcagcacgtttcaatattcactaatcaccagctaaattcttcgacggcgacgtgcatgaatggaaagcgcacctagctcccctagctatgtcgcaactaagattttgtttacgtgacaccagccggacccaataacagagtttgcttttccaatggaccaaaaatgttaggtcgagtaccacgctcagatcccacgacagtgacacaccgcattaattcggagcaacaaatgcacaatcccatgcatctccgttacgagaaaggaacacggaatcttctccgtccacctttggtgatttgatctgttaccaacctccggagccgaattctctcacgcgccaaaaaagatgcaggaggaagcacagtactcgtgcacggtaacgtttgtctctgttttttttcttggaaacaaaaaaaaaaggttattaatttgtggttaaccgggcgaaatgcacgtaccttgggcagagcagttgtagagagggccggggaggccgttgatggtgaaggcgtcggagacgttcgggcctccgccggtctggaccgcctggttgaccacctcctccgtgtccgcgttccaccactcgcctacgcgacaaacgcaacaatcaaattaaaaggtagcgagcccctgatcatgcaatgatcagtaagtatgcatatatgtcgcgacgttgcgtgcaaaccaacgcgatgcgcgacgtcgtacgacgacgtaatgcgtgcagcgtgcgtacgtacgtaccgaagatgacggggacctccttgtgcggggcggggaaggggtaggggacgccgagcttggggaggatgacgagggcgccgtagacggtggcgcggagccaggagatgtgggcgtgccaccacagggtgccgcgctgcccggccaccgtgaagttgtacacgtagctctgccccgtctggatcgggcactgcgtgatgtacgccggcccgtccgcccacccggtccgcacctgccggacgccgtgcctgcacgtacgcacgaatgcaccatcgatcggatcaaaaaactaaagcgtgaggaatcgtatcgatcggtacggtggcttaccagtgcaacgagatgttgtgcgcgacgttgttggtgacgcggatgacgacgcggtcgccttccctcgccaccagctccggcccggggcactgcccgttcaccgtcaccatgctcttggtgttgcacagcctcgtcgcgttcgccatttgcacctgcatgcagatcgatcgatcgatcaatcaatcaatcaatcaattaagtttttcatcaaggcgagatcactttgcattggctatgcgtgtgcaggcatacattgaattcgtagtgcctagtgatgccctgagcttggacgatgagaagcagtagggaagccgccaagagtagagggctaggaagagcagaggagatagccatggtcatcttaatttgtgtagcctaagctttgagccacaatctgtaatggctcttgatcagctagctctgtgagactttgagtgggagatggcctggcaaggatggaatgaatgttgggaaaaagcactcgagtcgtctacatatatataggacatgccaagtgtgtcgcaaccaccaccgccatttctttgagggttttttttttctacacgcgcggccgtaggcgaggagatacgcagcttaggcgacacctcttgtttggtgattcggtagatgaacgatcaagggaggagcttgagcttgagctagctagctagtgctctgtttttggagtgtagccaaagccagcggcaaccatgcatctgtttttcagtcttttgaccatgcatgcgtgttttgttgtatgtaccatccatgcaatggatcgatcgcctgaactgtgttgattaatttgcatgcatagtggcacgtactgtttctgatatgatgcaaaagcttgctgaaactgaaagttaaaactatgcaaactaataaaataaagaagttggtttactgcgaattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgcataaatataatacaaacacatcgttaattttttttacatgtacaagttaaatttaaatttggatgtttctgaagtgatatatcttcattgatctatactggtaatttgtactacctccatcccaaaatagctaaaaatacgtatattttgagatagatggagtatattgttaaaaggactttttaatgacttttttgatgacatgtaaaaaacgaggggacgttctcgagtgccaaatagactttccactttgtccaagtaatgaaccagggaattaagtcttgcactaaacatgtntggaaatggaaatattttttggnggcaattacatttcgtcccagagttggccct

SEQ ID NO: 24453 - DNA, 1897 bp, Oryza sativa
  unsure (1)..(1897): unsure at all n locations
agtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcatgatcacttgacatggatcccaagatatatatctatccagtaggtgcaacctgcatggttggtgtagtctagggtggcttctttccttgtactattcccaacggggagaaggatgcttgacccaaccagaccgagcgctgcaacatttttcttcgtattatattgactcgaacagaagcatgatcaacagtaagatggcatcgccaaatgcatctcgcagttcgtaccttttcagacacttcttccctgttgtttgtttatttggaatgctcaaagcatataccttaaaggcttttataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttattttgttagtagcatcgtggaaatccatacccattacttttgaatatgaattgcataaaagtagtgagatatagggaaaaaggcaatcaagattttccattcgagtatcatctttcttcaacatgtgtgtcagagttatggataccatatacctaatagtagttgactaaatctcggcaggacccaccacataccatgtcttctacggaaacaaccttcggatataggaggagttccgcataaggaaggatgaatagagttctacatggaaacgacaaggactactcggattgtatccatatggtttccttagttctactagcttggacaaggggacacctatgggtataaatacaagaccctctaggaggagaggggagacggaatgtagcgcccgttccatcgtggcgcctagcgggaaaactatctcataaaaaaaaccctaattgcgaaatctgtttctttgcttgttgtctagtgtctgtgccatctcagatctcaan

SEQ ID NO: 24454 - DNA, 1997 bp, Oryza sativa
  unsure (1)..(1997): unsure at all n locations
cgctncaattaagatagaatcacnnnnnnnnnnnnnnnnnnnnnnnnnnnnnnnnncgctccgttccacaccgcccccgccgtaatcgctgtcgtcacaacccggccccgccactccgcgcgctagcttccaagggacgaaggcagagcttcccccctctgccgcgtcgccctctctccctcctccttttccccaaagtggcaagggggcaagccccctttcccctcctccttttccccttttctctcccgccggtgtcattccccccgcccccccgtcgccgctttggccgcgaccgccgagcgctagctccctcccttgaccgccctaggtcggttcccaaatcgacgttgccaccctataaagcccaggcgccctctctcccttctcctcttgttttgtcccatcgcctctactccattatcgccgcctcccgtgctccgttcatcgtcgcgcgtgtcggaggagccggcacgagcgaggacgcggaaggggactccgggcgcgccctcttcttcctcttccctggcccgaggccggagagatcactcccgtgccgtcggcctctcgtctcagcgccccgcctcgtcccggtagtgcctccctccgttctccctcctcgttccatctcctccccttagactcgggtagtagcacgagtagcctccccgtagctagctggcgccgccccgaccgttgccgccgctcgctgtatgctcgccgccgtcgccgcccgtgctccgtagcgcctgctcgtcgccggcctcgcttggcatagctccgcccaatccgacgctagcaatgggttcccgtagccgtgtagatgctctcaccgctgggaatcggcccctcgtgacctcgtcgccgtttcccccttttctctccgccggttgccgccgccgcaatccgccgccgacggactccctccggcgaatccaagccgttggctcgctccctctcgttctccctcatcatcccggtgtacgtcccgtcgcccctcgtcgtcgcacgacgtcccggagaaaccgccgccgcccgccgtccattcgcggccggcgccttcgtcttcctccagccggcccgcgtcgcagccacgtaggcgccacgtcggagccacctcggcacgaccggatcggctgacccggccagccgctccctccgttccccccccccgtgcgcatggtccgcggtgagccatgaggctgcgcgtgggcccgccgcaccgcgtcctccgcgaaccgcgcgcatgcgtcgcggctccctccctaaaccctagcacgccccgcgtgcacctcgctcacggtgagccgagtcgccgacaagcgggtcccacccgagaccacgcgggatggacccggcccaccggctctctctctctcccctccccgcccccgcgcgcgctttgggccgccttcttgggccggccggcccattaagctcggtcgagccgcccctttctctcgggccgcgccctagccgcccgaggaaagtctaatttccctccctccttcctttcctttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacgtacctaacttgttgcatctgatnnnnnnnnnnnnnnnnnnnnnnntatagtgagtcgatgtcncactttgcacag

SEQ ID NO: 24455 - DNA, 1791 bp, Oryza sativa
caaagtcagggtcaatatcactaccattacccataattggatgctcatgattttgtatctgacatgaccatgaactcttgttctgcagcgtgatattcgggatgctgattgctctccccatcacattggtctactacatactgctggggctctgaagagctctccaagtctcaactcaactgtgcaagaacttgatgttactgacagtttgattaggatttatggttctgttttagttgctcagattttgtttggatgataggtcagcttagtgatgctagttagacaattatccgaggacttttgggttcaagtgacggccagccacggtttctgattgaagattaggaacatagacatcacattagtgacaacaggcatctaatttgtaagacattgagaaggtctgtttcaaattactgacaatgtagtaagacattgaacagtgcttataagcttatttagcattccaataactgatggtaatgcacttaaaggagctactctgaaggacttttttaatctcttgagagattagctccggattttttccttttggaatgtttctttagtttgagggctctgaaaacacgaaaatagaaaaatcgtaggaacatgatgtcatgctatacaaatattataggaaataaatttattaatttataggattttgcaaaaaagtattgtttattagtagcaccatcggaaaatcaaaggaactttaaggctgcgttcttttagtttttagaaacggctaattagccgcactaaaacttttgaaacggctaattaactacacgtaaaacgataagtgtgattagtatatgattaattaagtactaatatgtaaaagaattgatgaatatatttattagattttttaaacaactttatataaaaaatttttacgtaaaatgcaccgtttaacagtttgaaaaacgtgctaatgaaaatcgaggagtagcatgaggtctagtctcatgttttctttcaaaattcctacacaatgagcaataggaattttaaaggattttggggaagtcatttctatgttccaaaagatcatgttgggaaattttccaatggattttaagggttgtttggttccggttacacttttcatcacttgccaacaaaagttgtatcactttgtttaaggtgaggtgaataaattcttagtcataacttactaagcctaagcctaaggaaactttaccatatttttttaagttattgacacgtgagacccaatttgttagaagagaattttattaactatgggtaaacactgaccaaattgattaactaatcttaaatatgggaaactggggtaaagtgtatgttccaaccaaacatcctctaatcttttaaattcccctttttttttctttttatacacttttactttgtttaaaaagaagcggaaagagggaatcttttttgccacttttttcaaagtttcaatggaagaaaaacatggcgtagcattgttgagcatctttttcatactcccaagtataacaaaaagtttggccccaaaattaaaatgctaatggctggcctgtttgctcgaaacaacaggacagaaaatgataggtgttgggagtcagacaaaagtgtttggctttaagcatgcgcacttgaaggttggagcaacatccgacaattatactccactcttctcgtctgtatgacaaaacttaacgggtggatggattctgaaagcgattaaccaacgggaatttttataatacgttgccgaaacatattgttattaataaaaatggggac

SEQ ID NO: 24456 - DNA, 739 bp, Oryza sativa
  unsure (1)..(739): unsure at all n locations
tggacctgagaatccgttgactatagggcgaattcgagctcggtacccatagcagcagatcgtattgggaggaaaccagttgttgtgtttggcattttcgcggtgttagtgatatttttcctcctctatatgaaataatagttgatatctggcacaacctagtttactccggtatagcagttccttttctttttattggtgtttgtctaactaagttcttggtataatggaaccagggtcatatttaatacgctatttgggcttagtttcacctattggatggcaatagctacaagattccttcttggtgctttaaatggtttacttgggccaataaaggtacaataaagttgaaactttcctttgttgtacttgtacctggtcatgtttttttttcctccaatgcttgtacctggtcatgttgatcttgatcaatttatatttgtcctttcaagcctatgctattgaagtttgccgacctgaacatgaagctcttgcattgtcacttgtaaatacatgccatactgntctgntattaatttttttctggttaaattgagttgattttgaatttttttaatattaggttagtacggcatggggaataggtcttataattgggccagctattggaggctacctttcacaggtatgtcacagagaattgaacagtgttagggatttttttttaacaatggggctacatttaatacgatttcttttatggcagcctgcagaa

SEQ ID NO: 24457 - DNA, 743 bp, Oryza sativa
ggatgtgtttgagatccgttgattatacggctaattcgagctcggtaccaggcctcaatctactatcgtacccaactttgcaattggaaatattgctagctaatcgaatttgtgttgctcaaactacttccatgtttgaatgaacaacgaaatgttttgaatgaggaagtaggagcattatccatgtcaggtcagaagatttatactaaaagctagaaggaatgcatcttaaaaaacataagggaatttacctgcatatctccttttcttgttagctcttcttcttttgcgctcagcttgtgtaagttctgcttcttctttaacatcaccttttccttcaaaaatttcttcaagagcaagcattgcagcatctgaaacagctacaggtgcaatctgcaaaaagagagagaaatcatgacatgaaatgctcaaccgtataaacatcatggagaaatgaaggattttatttacctcctccattgctagagctggtacatttgtttgtatagacatatcttcaatgacctgaaaagtgaatatttaccttgttagttaacttcgctgaaagaaattacaaatttaagtaaaatatctggtcactattccataccggctttggagcaaagtgtaaatgagatagtgcatccaacctcaagcatattctcttaaataaggtctttgccctagtggaaacagaagtttgtcaatgcagcaagcctctatatcatcacaggggaaaaaaa

SEQ ID NO: 24458 - DNA, 764 bp, Oryza sativa
  unsure (1)..(764): unsure at all n locations
tggggnngtgactggtaggcccgtgntatncagcaacactataagcctggattaaaactcgcccacccagaactttgggaggatattcctagtagcgaaagagtaaccctacagttatacttaccagaaattatctctcttttgtgtgattccatgtcctcgtcgtcatgggctgggaagagaaaggtgaagcctttatttcattatcttactgtccatacacataaaagtatcatagcttggaatacacttacagtactgtgtgcttcttgcagtcagccaaggctataaaaaaactatgtgatgctctaggagaatccctgtctgtgcaccacaataatattcttgaatcacttttgaaagaactacctggtcgattttgggaggtaattagtactatgatttttctatctgtggcttatcagtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggg

SEQ ID NO: 24459 - DNA, 763 bp, Oryza sativa
  unsure (1)..(763): unsure at all n locations
tgaaaaatctggctgaaaancngctgaagtaaacctactcactacaaggctatattagagctcggccccctacatcctctgtcaagcctaataaaattttcctatagtgtatgtgtaatgttttcgggcttgtgtgaggaggcggcttccactcctcactctctcttactataactcttcttcctttattcaatgcatgaggcagtgcccctgccctttcgcaaataagaaaattttgggtactagagatggaaatcagcaattggagaagctgctttcaattgtccaactctgatcacaaagagttagtcttcttagtaaatctattatctttcttctgtctctctctctgaaacattttttctctcatttcaatatttattatcttctttcgtgtgtaactaattatatatgtatatgtagtgccaatgcacaattgtgatacttttttttaccacaagcggcgccagtgggtccgagaggaagatttggctaaagcattaaagatttcctctaagcaactgcgccgcattctccagttttttgaagaagagaagctggtgagaagatgtcatcgggaagaggttagaaatctctgagagaaagttgntctcatttttgcatagcccttttttttttattctagcatggnaatcgccatctactncacttaaaacagaaagtgntaatttattagtagtttctgaaagcaagacctgatagaagagtgagacaacgattgcggcctctcagtttgcactgt

SEQ ID NO: 24460 - DNA, 1835 bp, Oryza sativa
  unsure (1)..(1835): unsure at all n locations
ncgcgcattgatgactggctactctacnnnnnnnnnnnnnnnnnnnnnnnnttttttacttttttgcggggagaggccaaacttttttattcggcctccggaaccctgcaattgcggtgctcgcctcgattgggaaagcgggggaggagggtggggggacccggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggaggaggaggtgacgccgcggcgcgcgcacggctgtggtggggtgttgggtttgcggcgagcctgcggcgggagtggggccagtagcagtgtgggggcccaccaggcagtgaataggagtaggagtatactgtatactcctccaggagtttagtacgctacagaagggggttggttttgttttcctggaatagggagagaggtgaggacctggagggatgtccgcttgaacaagctccccgcggacaggacgacggcctgcacgtttaaattgcgtgggacaacgaaaaagtggggatttttttgaggatttgaacggtaaatacaaatgtttagctccatttggaactttcaaaataagtttgcagatggatatgagattactcagtcggagatactccgtagatgagaaaattatgtatataccataaactgtaactagctgggtggtcggcgcaattgcgtggctagcacccaaacaaaatcatatatttttttagtatgattttacttaaaatttattaaatagctatctcactgtcttaagactttgaaagaccaaaccttatcaccctcgtgtttctaattataaagtttttaaaagtcacaccagttgctaccccttatgtcatctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgattgcacacacgcacaccctacccctatgagcaacttcgn

SEQ ID NO: 24461 - DNA, 3383 bp, Oryza sativa
  unsure (1)..(3383): unsure at all n locations
cgcgctgtataacttactactctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctaaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcctgaaggtaaccgagactatatatataagcggccactacagttctcagaagtatccagcattttgggctgtcctgatgatctgaaagagagctgcacaaagaaaagagtagaaaacacaatgacttggtaagatgttcataaagttatgatgaaaaagatggaaactactgccaaggctgtaatgaagactgaaatagttgcaggatttttcatgcaaggagttctattttaccaacattagactgtctgttccatttgaatccttaactagggtaacatcaaaccttcctcttctattttccaaagtcttaaggagaagcatatatttttttgagaagtttataagcatataaggatttattgcctggcaacagattagtagctgatgtccatgggtgtggtagctgcagcagttaacaaccatatctggagtaaaccatgagactatttttggaattaatcagagcaggaatctagcttcttattctttgaaaaggatttgactaatctaagatcaaaacaggaaacacatagatactttcccacaaagtgataacatcctaaagcaaaactaatgatgtgtactacagctacccccatacacgactactgataatagtactagattagcactttcgcaatttagcacagtttagtcctggagagagcacagaagcaatacccataaaaacaagaactaagggtgaaaatagttaaaatctatttaggttggtaaaggcattctgagttatgaagagtatgagtgaagataaatagctcaaccattcaccacaaatatataaaaaaagaatgtaacttacatgaaccaacaaccacaaagacgaaaaatccaagcacaatgggtccaacaggataatcatttcctttcttgactgtctcaggaacagaacccctcttggtgacgttcttctcaaaccgtgccactttcctatctgagagacgccttgaggtagtctgtttcatcatcagcaaataatatcagaagatatcataaaagaccttgtttgaagaaagaaaagaaatatgcagtgtatttggacagaatcccaaggaaatgacattcatgatgccagtaaattcatacaaaaactttcatctattcaggaaaaaaaatgttactcaagatgcaaagcacaatggtgccatcaccagctaactgatgcctgctaccaaatatttctgacaacatgttgatctgtccgacttgcatgttaagggagtaatttttacattaccccctagaaccagtaagcagggtttgaaagttgatcataactaaatccatcgaaattataaaatcaagcgtattgggtgagttatatgtttttgtgcctttattatatgtattagatgatactcaatggcacgtgataatgctgacaagaaaattagaaatgctttactatatcataaaaatagtaatatcctctgctcgatttggtggaccctgattccaaactactctctctgtcccataaaaaaaccaacctagtactggatgtcatcctagtactacgaatctggacatacctctatccagattcatcgtactagaatatgtcacatccagtcctagattcgtttttttcgggacagagccacagagggagtaatccctaatcttcacatcttatcctggaacacattttcgaatcaaagcataggagtcgaaaacaataaaaccatacattaaaatatatgctaaattgaagttacgcaggatcggaagcgttgtagtgtgctagacgacaaatgcaaaattgcatgggtcaattaatactcttcgtcgacatttcaaatgcgttataaagtaatctatatactaccaaatatgatggctagcccacgtaaatgcataaccaggttttctaggtctttgataggccaatccagaatatgcggttacatgaagtgatgtaatgcaagacaactagtgaatgttcgctctcggatcaggaaaatcaatctctgcgtcactgttattctaaacctgacattagttagtcagcaacaaaacttgataaacttgttaccagatcctctaaatcttgccaaaggataatattgaagcatagcctaaaaataaacatatcttttgttacgaaatgaacggtttaaactacaggtaggcacgatcatcatagaagtacactacactatctacatacaggagaaatatgaattcaaaagcaaacagatgtgcacagccacggatcttcctgcgaagattcagaagaagaggaacagaaacaagtaaaccagaaatcaacatttcgtcggttctatttcacaaaatcatcgccaggacaggggcggatccaacttgggacacccaaacttttcggggaacaaacaaactgttacttgtattaaggttaaggcactgaaattaagggaagagcttcttccagatctagaagagaagctagggttaacgaacgaacacaagcaaattccagaaccgatgggagagagagatgaatcagaaaaaggatgtgatgctcaccatgatcctctcccctgctctgctcgccagatggagatcgccgccactcccctgttcagccgcgactcgtcttggcggcgcaaggaggaggagacgagaggttttctttctgttacgccacaaagggaaggggaagacactcggagaaaggggaaatttaactatttgccacttttaggttcaccaattatccaaatacccctcttatatttgcccttattttcttgcccctctagnnnnnnnnnnnnnnnnnnnnnnnnnnnnnnnnnnnnnnnnnnnnnnnnnnnnnnnnnnngctagcgatgtcagtcacc

SEQ ID NO: 24462 - DNA, 7697 bp, Oryza sativa
  unsure (1)..(7697): unsure at all n locations
ccgatganttcaatgannnnnnnnnnnnnnnnnnnnnnnnnnnnnnnnnnnnnnnnnnnnnnnnnnnnnnnnnnnnnnnnnnnnnnnnnaggagagggaggcaccggaggagaagccgagcgccgtcgcgagttcaacttccgccttgccgcactccgccgcaaccacgacctccagtcgggaatgaaggagaggacgatggggctgaccggagagaggggaaagggagagttgtgtgactgacgagtgggtcccacggcgatttttgcactacgctgccatgttggcataccacataggcaaaagtggcaaatagttaaaagggcacaaccttagaagggcaagaaaataagggcaaatataagaagggaatttggatatttggcaaacctaaaagtggcaaatagttaaatttcccacagatatggcatatcttcacgtatgcggattgttctcgtgtacgccgaaggaatttatttcgaattatggaaaatatctctacgagtcaagtgatttccaaagtcctgcttggtggggataaagtttatgttatatcgtacaagatccgatgtctctgagttttacttggagatcaagatgatccacggtattaaggggcccaaggaggggtgcaaggcatcaaaattcatcaccaacacacccaccatagtttacgaagccagagtactcggagctaggtcaccgggagatctcgtcgggaacatcgactacgatctcgtcagtatcgtcagtttcgactactttctttgtaatctgtggttttccatcatcaatcccatataaactggagtagggctattacctgataaggggcctgaaccagtataatccttgtcttctatttgcttgatgtcatattacgtaaatccttgttccaacgtatcccaatacccaaatcatccggtctacgagtaccactcattgacagtggcacgccaggtaggggaacttggtgctcaaggttctacaaatatgacttcaagccatcccgacaacagtaccaacaccggcgtcaatcaaggagcctctacctcgacatcgctggtttggactcaagtcgggactattgtctttccggtctacaccgtcatgccgatctcgacaagcccaatcactattgggaacgagaacggcacggctatgacttcgagaaatgacgcttcgctgacaattcctcccacgcaagtggagaatggaacatcgacggccttagtacctggaaggaatcctcaagcggccgagttctgtcctctgaacaagagaccagagccgacaaggatacccatccagaaaccgaggtcttggtgtcccgtccataagacatccaagcatactctggaagattgcctcgtgatacttcacgcaaaggctgaactctacgcctgctggaaacgtgggattcaacgcacttcaccaacgggcaccacttattgcccgattcatagatcgagatcccacgatctcacaagttgcataatcttccttaggacattcaagtcgtcgcatcctcacatcccacaaccacgagatcaatctcagtgcgttgtcgaggaacgagacgcagcgactttagatcggttcgtaggctttatcggtgtcaaccctagcgagccatccatgctgcacctactgaaagattacgagtcttcttcagactcaccacgagacgtgaacgtgatcaatggtgtcgagacaagtgcttccgcggccgcgagaacacctccacaacaactgcggaacctcgacgcaatattaagagagagcccctttgaccctgtcctaaaccccgatgtcgatcagtgggcggcacgactacgagagactgtgaccaacctcaacagcgcattcgtggatgcagcagtcgagcctccaccccaagatccaccgggagggaacggtgaaccagctaacgggaacgcggaagcgcaaaaccctactagggaaccaccggctcgagacccgactccatcgcgtcgtgaaaatcgtgaccttcatgaacatctagatgaccggcggagggacaggcgagattggaatgacaatgatcgtcatcagcatcgctctccctccagacgaggagagaacatcgctcacgtcaacaccgtcaccgttccctttcacgccgaggtgggaacgcggatcgaggaggccatcccaacggtgaccgagatcggcaggcccgtagcgaccaccaagacaatggagataacaattgagaacggaggcgaggcagcaacaacggacgagaacgtagctcccggtctcccgcctctaggcgagatcgaagacgtgaccaccgttcgagaagctgggctcctaaccctagtggaccaccgttcgagaagctgggctcctaaccctagtgatccctcgtcttcgtcttggtcatcttcttcatcggacaagcctcctcgacgacatcacaaccgcgggccacctttcgcccaagaaggcgtgtgcagagcgtttgcgcgcacattgcgagatgtgcgatggcccgaaaagttccggacaggggcgatcgagaagtatgacggaagcacagacatagaagaatttctgcaagtctactccacaattctctacgctgctagtgcatacgacaatgcgctggcaaactatttaccagacgcgttgaaagattccgctcgttcatgactggttcacctcccaccctactcaatctcttcatgggaagacttgtggtaacagtttgttgtcaacttccagggaacatacaagtgtcacgcgattgaggacgaccttcatgccctaactcaaaacccagatgaatcatagagggactatattcggcacttcaatgagtgcaggaatacgatccccgagatcactgacgcttctgtcatccgcacattcaagtcaggcgtccgagattgatacaccaaccaggaactggcaactcgaagaatcacatctgcttgcaaactatttgagatcattgacagatgcgctcatgcagatgacgccttgagatgaaaggaaggaaagagcagtgtaggtgaggagaagaagtcagccaacaaagacgcgccggaatcaagcaagaaaagaagtcgtaaaagtgggaagcgcaaaccctcgggagaggtcctcgccgctaagcaaacggacccacccaagcgctcgaacccccaaaacgacgactcgaagaagtaatggtgccctatacacaagactaacaatcactccatggaggattgttatgtcttcaaaaaggagctcgcgcgacaactagcactctagagagggaagcgagtacgtgttgtcgaaacggccgaagaggcggccactcccgactccaactccgcgttcccagagtacgacctccatgtcttgcacatattcggcggttctacatcgtacacctcaaaaagggagtacaaaaagatagaacacgaagtctgctccacgtcgcaggggcctaccgctaagatgagatggtcccaacacaagatcgagttctcggagacggaccacccgaagatcgcgaccacacctggtagatatctgatcgtgatcgaacccactattcggaatgtcaaggtagcacgggctctcatcgatggcagaagttccattaatctactcttcgccagcaccttagatgccatggggataccgcgaagcgagctgacgcccacagatcagcccttccatgaaatcactccagaatcatcatctaagccgctgggtaagattacattgcccgtcaccttcggacaagccgacaacttccgaacagagcagatcacctttaatgtcgcagagttcgataccacttacaataccatcattggaagaactgcactcgcgaagttcatggcagcatcccactacacttaccaagttctcaaaatgccaggaccaaaagggacaattactatccagggaaacgccaagttagcggtgcagtgcaacaagcggagcctcgacatggtcgagcatactcccaacccgcccgccacaattgagcaccccaagaaagtgagcaagcccaacaagaaaccgaagttagacggcgccatcaagattattccgttgtccaactccaaccccgacaagaccatcaagatcggggcaaagctggatgacaaataggaactcgcgttcatcaccttcctccgcaacaatgcaaacgtgttcgcttggcaactgtaacgccccgattttcgttcgggaataaaaatcaattaataatacattttctagaaattaaataaaatttaaatcaacttaatcaagtgaattattgagggaattaaaaatttcctttaaaaatcattggccgagaatattttgtaatattctttgtgccctaaaatactctccggatttttccgcaaattttcgaagctcaagaaataattttaaagtcacaaagatcatttaaccaattaaataaaaagaaaacaaataaaaatctccttccttcccttttgggcttggcccaagccttcccctcctctcccgcgggccgcgcgcctcctctctctctcggccggcccgcgccttgcgaaagtctgctttacgtcccccggtttccctcctctctctccatccggccgacaggtgggaccgtgggccccacctgtcagcttctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccactttcccgccggttgccgcccctctcggccccgtttccgccgctccgaccctataaaaacgaacccggagcatcctctctcttttcccctcctcacccgagccagccgcgctctctctccccctccccacgccgctcccgcgcaccgccgctttccggcgagctccggccgcccgccaccgctgctccacccaccgccgcgccaatccgccaccaccgtcggcttcgcggcaccgtgccgcagcccggcctctactccatttcccctctccgcctccagaacaccgccgcctcgtgcaccaccacctaccgcctccggccgcctctagccgccatcctcaaccacctcaagccgcgccactgcctcggttagatccaccaccgcaagggcaagcccggccgtccatccctttttcccctccaccaccagaaccacctccctaccacgccaccctaccggccattttttttccgtctccggtcgccgttcgccatcaccccggctgccaccgcgacgcgccgaccgcatcgcctccttcgccgcgtcccgctctttcccgtccgccgcacggtcaccgccttccgccgccgggagcccctcctcattgtcgacctatggagcgccgccgcctccctccgccggctgctctcgccgtcgccgtgcccctcggtgagctccaccacatccctctccctcactgcccccgtttcctctcgccgcttcatgcgctgagcgccgccgctccctgcgacgcccggcccgtgtgccgccgtcgctttggtcccggccgccgccgccgccagccttgtgtgcgcgctggccagaccgcaccgcccggcagtccccagccgtccgatcggccttggccgatctagaccgtcgggtgcgcgaccgcgtggccgatcgccaccgtggactcggtccacggtgggccgtgccgctaacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggtgaaatttctgggcgtgacagcagccgtcagacatgtcgggagttcccagggaggcgattgagcacaaactgatggtgcaacccgacgccaagccagttaagcaaaaactatggagatttgcacctgatcgaacacaagtcatcgagggtcggaactgtattcacgttattcaaggggtgncatgcaaggactcgg

SEQ ID NO: 24463 - DNA, 27133 bp, Oryza sativa
  unsure (1)..(27133): unsure at all n locations
caactggtgattcaacagcgggctgctagttcttaagctttctcgatgctactccgggctaccaccagatcaacatggcaaaagaggatgtggagaagacagcgttcgtcacgtccttcggtgtattctgctacaccaagatgccgtttggattaataagcgcaggcaacacatatcagtgcgggatccagggagcactaggtgatcagctcggacgaaacgccgaagcttacgtggacgacatcgtcgtcaaaaccaagacgggcgactcattgatcgacgacctaaggaaaacgttcgacaacctccgacgatatcaaacgaagctcaacccggagaagtgtacgttcagagtaccgttagggaaactactcggcttcctggtctccgggcggggaatcgaggccaaccctgagaagttcaaggcaatcgagaacatgaagtcgcccacaagactcaaggaggtccaacgattgacaggatgcatggcttcgttaagtcgtttcatcgcaaggatgggagaacgaggacaagctttcttcgccctgctcaagaagcaggacaaattcgagtggacccaagaagctgagagcgcgttcattgcgctcaaacgctacttgtcaaaccccccggactagttgccccacaaaataatgaagaattattcatttatattactgccacaccttattctatgagtacgtttatcgttgtagagagggaaagagtacaatacccagtgtctatgtcagcaaggccctccacgatgcaaaaactaaatatccacagatccaaaaactattctacgctgtgatcatgacatccagaaagctacaccacaacttccaagcccataaggtcatagtgatctcctcctcccctttgggagaagtcatcaggaataaagatgtcgtcggccgtattgctaaatgggtagtcaagctaagccattgaaatagggtggtccaaattgaaatgtaaagttagttgttctgtaaatgaaaagaatggttaaaggatgacataatatgaaaacttttaagaatacatagtacgaactgtaatttacttttttggtttagcacaattaaagatgagttgtctattacctggtactcttgtgatatactaagtcattagtacaattaaagatgagttgtccattactcaatagtcttgtgatatattaagtattgttgggtcagtgtacttggctattactaatagtctcatgatatgttgatgcatgaagatgcatacttctactaacacgagataattaattatggttatatagattcagctaaaaaaagataaaattaatgccatcaatttttctcaacaataaagcattcgactgtggtctccttttctcactgcatgatatacgattgtaggtattaccgtaattctttcatattatttttttctacatatacgttaatttggactaatattttttctcataattaaatatttaataaatcatttttcatatttctactataaaatgtgaagagggcattgtataatttgaaaattatattataagtgtatgtaatttaatgtgtaagatatgaacttatagtataagatttaactttttataaaaatgctgcatgatagtagataggtaatgaactaaacaaccataaaatatatagtgaatccattgtgtgttattgattttgtccttattctacaatatgtcactaggtttgtcaagttctaatatgccatcgcattttgcttaacttctataacataccatcgtcgtctagttagcttctgttagtattgtataattttatcataatgaccgaaatagccatgggacgaaaaatttcaaatatctcattgtaaacttccaaagtttgagatggatatcttctctgccttgtttataatattatattttggaatattctgtcaaattttggaatttctgtcccggggatatttcggtcattagaacaaaattatacagtactaacgaagtctaaatggacggcgacggtatattacagaggataagcaaaatacgatagcatattgtataacttaacaaactcagtgccatattatagaacagggacaaagtcagcggcacacagtggattctcttaaaaaataatctagtcaaaaaagtttctttattttattcaaaacaaaacattttttctaccaaacacgttaggagaacttcgaaagaagataagaaaaaaaaggaggtttagtcattagctcaaacacacgtggggaaaagctactcacatccatggtatggtatatactcacattaatcgataatatactaatattattaaaattattcttcgtcttaatacggtgtaaaactaaaactttaaccttatattcttctgttattccatcttcttctcgctttctcattcttatttatttttgataataatattgctacaatcaacactagtacttgcacatgaatactagcagctaactcatatgtgtgtgctccgtaatatatattatctatgtttttacatgagtaaacaacaattattatatttcttaatgatattgtaattatataaggtacctaactagttttctaagaactggaaagatatttttgttaaacataatctagaatgctataaagattaataatattgaacgatatataaccatataatttttttataaatgaattagagatcgactcttgttaagaatccaatgatcataatgcactatatatattgtttaagtgagttatgatattctatttaggatgtgtttgacaaatgggttatgagaggtgggattgagaaagggaaatggatgaatgattaggattaaatgaggtgtgatgaatggatagttaggatacaatactaccctttggagggtggaatattatttccctatcctatttgcaaacaaagccttactagttacatgtgtatgcattaaagtgggatctagagataaaaatcagacactgctcgccaaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtagatcaaaggggaaaaaaggccaacgaaccaaactagcatggcatcattataatcaacaaagacacccaaattgcatacaaaagtacccataatcatcagctgcttcttatgttgacatcacagaaaacaaaatggataggatgtgcagatgcaatgcaccacactggcctacaccaaaagtctctagacatgcaaacactgatcaatggagtagtatcaacttagagcaggtataatagtaggtggtaagactttaaatattatatctgtgctgacatggaagggagaaaaggttaggaaacgcaaaggcgagcgcttcagttagcgctagctctagcacagcctccaacgcaaagtggtggggcccataagtgggagggcatggccagccaattggatggagctaagccgagtgatacgtaaagttagttgaataaaatattaaaagtaactatgactagcttaagtagtatttcttctttttatttacttttgctgaggtggattattttgcagcggctgcgctattaaccttgctcttattagtatgtcataatgaatggccacatgggtacatggcaccagtcaccctcttgtcaacagtccaaatgtccaatctctcgagtcttgagaacgacctttcactcggttcgtcatttttttttcactaacaccttgctcgttgaaaaatatacccttattaattccattattattagggagtactggagaaatctaagagattgttcaaataagcataacattaaacgctattccttctcaaggatactattaaatccccactaataaaaagatatttggccccttactcaaatcccatctaaacaatcactgaggtggcattaattaatgtgtagggttagatcaatggcaagatgaagggtgaggatagagaagcagagcaggattttgggttcggatttacccaaccctcttatccggttcgatcatgtgtttcttataagttatatgtaacatgtgtccataaactaatatatatcactcgagtgatttttaaagtaaaaaagtccatgaatataattataacgcctatattttttttacatggtcttcaataacatagtttgactagtattttatttcattctataatctcaacaaatataaaattagcatcacatgaaagtaattcaaaatatgaatctagtaatataacatgcataatacttagtatagatatagttaggccctgtttaaatcccaccccaaaatttttcaccatgtcacatcgaacgtttgaacacctgcatgaagtattaaataactgtcgacgttggatgtcgcgattccggtatttgcatagtatggggatcgttggtactaggatatacgcgagacttaggtaaaagagacggaggagaggatttttatacaggttcgggcccctgaattgtcaggtaatagccctacatcctgttggccgaaaccggtcgttgctcttattcaccataatcacaccagtacaatatttggggtagcctatctatctgttgtcgacttggcggtctgaagtgctgactcgtagtcgacaacagggtagtcttcctcctcgaatctgtgcccgacgaggtcagagatagcgctagattcctctctttggttcccgtaggtaccatattgggttttcccaggcttatctctgatgtcgatatctggcagtttgtcttggcgtatgtaggcttgtattggcctgtggctttgtggcgtctatgttgtctgtgtccctctcctcctaggcggtcttgtatttatacccataggtgtccccttgtccaagtagaactaggaaaatcagtatggatacaatccgagtagtccttgtcgttttcatatagaactctagttatctttccttatccggaactccccctatatccgaaggttgtttccgtataagacatggtatgtggtgggtcctgccgagatttagtcaactactattaggtatgtggtatccataaccctgacaataactaattacacatataggctaaaaaaataactaattacacatattgcgactaatttgcgagacgaattttttaaacctaattgattcatgatttgacaatgtagtgctatagtaaacatttgctaatgacggattaattaggcgtaataaattcgtttcgcagtttacatacggattctgtaatttgtttcattattatactacgtttaatatttcaaatgtgtgtccgtatattcaatgtgacacaccaaaattttacagccctaaatctaaataccctttagtatgattattactcaaaagctaccaagtttattttttaaaaaaaaacagggcgccctataattttgggcggcgggagtagtaaaagctatttttttttacactcaaaccagtccgtgtatgtgcgcgtagctcgcctgtctcaacgtaattaagtgaacgataaatcaaataaggcaaaatcttccaaggtcaaaatggaggaacccactatccccagattaccacgggccaaaattcggcccaacctgtgatgaagcggcccagcccaagtcggctaaacccctctcctcttctcgtgccctgcctgattccgctgcctccaccgctccacgtatccccgaaagattctcctcctcgtcctcatccatcccccaccgccgccgcggataaaaatccaaggaatcgaaggccccaacgtgtagtactacgcctacgcgccccctcccatggcgccgcctccgccgctcgccgcgctccgccccgcgccattccctctccctcgcctcctcccctgccccgcctccgccgccgcccgccgcggcgccgtcgccttctcgctgcagaccaacgtgcggctcctcaagcccaaccgccgctcccggcgatcccggtacccctactacgaccacgacgaggacgaggacgacgatgaggcggagttcgagtttgaggaaggggaggaggaggaggaagacggctacgagaccgatgtaagttccctcgtttggcagtagccgcttctagctttgctactgtcgtgagaggttgcctgagtggctgggtccttagctaaaattgcttgcgtactcaagctcgtgccatgggataagtgcaaggctgtgctatcacatgatatcatcatccaattgctgctcattatgtaattagagctccggaaggaatatcattcaactgctgctcattatgtaactagagctccggtattccttttgttttggagtacattagagatgtgataccattttattgcgtcaggctagagagtttcagaaattgaactaaccaacatctcattaggttgtaggatgtaatgttgtatgcacattgagttaaagaggcataagtttgtcaaaggaatcaacaaacattgtaggatgtaatgttgtatgcacattgagttaaaagaggcataagtttgtgaagagcgcactagtggtaaatcatcgttcctgtatttaatggtataacaccttaaccgctcatatgataaactgttttaaaagttttctgcctggctgccacagttaaacaattcttatttatatggtttatttgttccatgcatatttatgtgcttaaatactcaatggtatgctcttaaacttaggctagctgggtaacagtaggtagaggtgggcattagggtgagagactaatttgatttctgccttgggtaaaccatatccaacatacggggaccaatagaaacagcgaaactcgcttttctgctgattagtgaagacttaaaagagagagggagagagaatcagttatgtttcttctgccaccctgactatatgatctgttctgcattgagttttcaatatatagtatactgcatcactgggtgtttagtccacatgccaaaccaggcagaattgcagattattggattcaaaaggataaagttttgtgatgctaactttcattcatttctcatagaatgaaatatgagaaacttaccattggcaatattctacatttccagcattctaatatattctcttactcttttcaggatgatctatcaggtttggagtatcctggtgtactttattcaaacaatcctcgtgctccaatcaagaaaccaggtatgaaaggctgtgaaaatccctgatatccagtggttactttgtattaatactttattctccaggccgggaaaaaccagcgctgaaacaaaactgggaaggaagacaacctaaaacacgagacagatgtgacacttcaaaaaaagtcgatgctctgcatgccaagagtaaagctagcagatcaactggtcttgtggacatagataatgaagtagaggtagactactaaggttgattcagtgtgtccatgttcttgtttatgttcaatatttaacgtatgcaggataaatgattgatttattttcgcagttgaaaaatgaaagtatctctagaagcttgtttcagaaacttcaagaagaatatgactttgatgataaatggttaccactaatcgattacttgtgcacatttggactgaaggaatctcattttacaaacatgtatgagagacacatggcctgctttcaaatcagtcaagcttctgcagaagaaaggttggagttcctgctaagtgttggtgttaaaagcaaggatatgaagaggatgcttgttagacaaccacaaattttggaatacactctcagcaacctgaagtctcatgttgcatttctggtgggcataggtgttcctagtgcacggataggtcaaattatttctgctgctccatcatttttctcttacagtgttgagcagtctctgaagccaaccataaggtatctgattgaggaagtgggcattgaggagagtgatgtgggcaaagtagtgcaactaagcccacagattctggtccagcgaatcgatagtgcatggaaatctcgatttctttttctatcaaaagaattaggggctccaaaagataacattgttaaaatggtcacaaaacacccacagctgcttcattacagtattgaggatggaatattgcctcgaatcaatttccttagaagcattggcatgagagatactgatgttctcaaggtattgacgagtctgactcaggtattaccacattcaagttccctatccttttcatttttgttttgtttttacaagtatcttcattgttcaatgtagacagatgccattataataccctctaatatttgtttcttttcaggtgttgtctttgtccttggaggaaaatctcaaaccaaagtatctttacttggtcaatgaccttaaaaacgatgttcaatccttgacaaagtatcctatgtacttgagcttgtcccttgaccagagaatccgtccccgtcaccgttttcttgtttcattgaagaaagctcctaagggtccattccctcttagctcctttgtgcctacagatgagcgattttgcaagaggtgggctgggactagcttagaaaagtatcatacatttcgtcagagcatgctgctcaaaggtttttcagagaagactggaaggaaaacattaacatcgaggcggtagatacttcatgattgagaagtaggttgtttttgaacctatgccacgctgtaagatgatcatttcacgcagtacctcaaatattttgagtttattttacagaagttgcttttcatagcaatgctgattgatttactgtttgcaggaaaaggcctgggttgctgtgctggtattcaatcatcagcattcggcacacatatatcaatatcacagatacatcactaactacagtttagacttccttttttttttactcctattacaacaaggtgtaaattcttcatctgattcctccagtcgaaaaacaaatggatgttccaggagtcaatctaaggatgaaaagggatgcaccagaatggttgatgtggcattttgttgtctactgccacggtgacatcaccttgaccattagctaatgttaaatatgtctagcacaacaaactaaccatctattagggatgtattaggcagcatcctacgttgccgtaagtctgtagcgtcgttaagcacgatattttattttccacggttgtaaatgatagaaattctatcaccagttcgatctgtactttgtgcgcttttctggtttgttatgttggaaaattattcctgttgctgtggcttctatctgtgttgtgtttggtttactagtcatatagaagaaatcatatttttcgtgtataacgttatgctgcaacacagcatttacgatataactgatctagataagtcactggtgattgaaaggtagaatttagcaaatactccctccgttttataatgtaagtcattctaacattttctatattcatattaatattaatgaatatagatatatatatctatctagattcattaacatcaatatgaatatgagaaatgttagaatgatttatattgtgaaacggaggaagtaacttctgattctggaaaaggaacgaacgttgggaaaagctatctaaagactgataaagatatactccctcattccttaaatatttgacgccgttgacttttttaaacatgtttaaccgttcattttattcaaaaatttttgtgaaatatgtaaaactatatgtataaataaaagtatatttaacaatgaatcaaatgatagaaaaagaaataataattacttttttttaacaagacgaacggtcaaacatgttttaaaaagtcaacggcgtcaaatatttaggtaaaaaaagtcaacggcgtcaaatatttagggtcaacggcgtcaaatatttaggtaaaaaaagtcaacggcgtcaaatatttagggatggagggagtatgatttttcgaaaacatagtggccaattgtttgcattttgagcaactggaactggtggtcaggtgctattccggggagaaatccccaaaagggaaaaatcgacgcatcacaagtaaagaaagcctcaaatgttgtcaacttatcaggaaaaagcacgtattacatgtctaggtagtaagcaacatgacaaaaaaatagactggatctcagggctatgcttatgtacgtcaagctgtttctgctttactgctaactgcaaaataaccctttctataacaacctacttgaccatgcttacttgtgaatcctaagttctgtattataagtataacccaaaaaccatcctactactactattaataataatctgtggaaacctacttgacctcactgcgtctgtgtacctatttataatctatggcaagtaaataattaataataataataataatttgtgtaccaatgtataatctcttgtcagtgtgtttgtagtattggtgaagaaataatagcgctcagtagagaccaaggctatctggaagaatgatctcatcactgcaaaacagttcagacgactcggatgttataactagaaatgccagatgaattatcttggaaaacaaaaaagaattaaagagaactgaaataacataagtaggaacagttacctatcttcatatgctgaagcttcatccaaatcatccgacctgtgtgatttttttttcatgttgttacctggaagatttacatgagacaaaatcagacatgacaaggaaaacgactgaatcgtaatcattccctcagaagtgacacagtacaaatctaagtgtaagaatttgctaacctatataatgctcattagtgacaccgaaacctgatgtcctgtgttcacgatagtcaaattgcttatttttccgataaatttttctgtatcagtaaatgggaatagaatgttggttattcctcaagttgaagatataaagagcaaaagaaaattacacaaggtataaccagcaaatatgaaatattagttcaccatttctctaaaaagaatagttataaagaaactacaccaataaagtcttcactgatagacaaaattcagtcaacaattataactgagcaagataggctaatgattttacaaacgatggtatgtgtagaacagtgataaaaatgcaaattgaacccctaatctgatgtagtgctgtaaatatgaagtataagcatggaatcaatctctgcaaaaatgatattctagatctgtcctgattgtgagatcaaattagccccactgattactgtaatgtaacatggggccttggtctttgctacactgttctttgacttctttcttttttttggatggtgcctttgctatagtgtggccaatggtaaccttcaaacaactatcaacttgacttccagaaacactcttcagccatgtcattcttcaaataaaataaatattattgcatttatggaattttcatgtgtgtatggatgaggggtattgttctgtatgttgtaaacccgcattacataatcagatccttaatagtaaaaactataggcttaaattgggtaaaccataaaggggaagcaaatatcatttttcatctttaacgtcttggtctgccacgcatgaaagcaaggaatcattttaatgaaatcgatagtggtttccaatgcgtggtagtaataatgtcagaaacagcaagcgacataaaacagccctattgaacagtagagtgttaccttagttcagacttttccatgtagcgcttgacaagaactcgcaatccacagatgaagtgagctgtcccctttgataagataagcctcactgtctcagtgtataggaagctcacaaaaccaaacatccgcttctcctgatagggaattcgcacaccggagacaggcccaaattgcctggcattatcaagacaatattgtcatcacagtaacataataacatgacaaattgacaattcacacctagtaacaataaagttaaggcaatacttgaagtaattctcgacatcatcatcagtgaatttgctgtgaacagggaaggtcatataaatctggttagacccagtgccagtatccatcaagttgcaactgtgagccaagcccaagcaatccatgtacttcttccgagcatcttccaccaggactacatgatactgtccatgttctctgaagttgaaaacggaaagagccatgatcaggatgtgaagaaaaaagaaaaataatcaatcatgatagagccatatcagaaattcatagaagaaaacctctcgaccactctgatggtgttaagccccatgagcagacttgtaagactgcaaccagtccttccatgctgctggctctcagtgagccatccatcaggccgcaggggcttaccgtacttctcaaagtacatcgacggcaaacgatcgactgcgactggtggtggtattccgatcaggagttctctgatctccatatccagcttgctcagcgacgcaaaggggtgaacttgcctgggattatgcagctcagggacggacccatggaagaactgacagttgacacctttcttgcagtaacccctgaagaaatggaaatggcaaggcttggaactcgacttcgagctactatgaggatgtccgacgagatttcgaccagcatttggagaattccttggcatgctcaaagactgcaactcttcctttaagcagatggattcaggaaatgagctctgcaatgctccagtttgatcaattaatgggcgacgttgagcttggattccacgataattgccgcttgattgacgctgagccctcaagtaagccagtgggagttcttgccccggtggaggaggcagcagtgagggtaaggaacgtagatgctcgtcaggactagctgcatactgtctgatctgcgggtatgaacttgttgagaggatgtaaccaccgtttgcacgcgatggctcgaattcccgagctctattcagcagcactgaacatttgttcatagccatttcttgattcctgcaacagaaacgaaatgatgggattttcattctataaaaaaaagttccacctagaaaaagtaggagattgttttctgataatttcactgcaatgcaaaacaagagtgagattgttttatgattaattaaaaggttaagatgcaaatactgtgacaatatagaactttagtccaagcaaaaacgaaaaattgcacattccactgtttccaccacaaacaacaccgagttcgtgttctcccagttgctgcttccaaaaatcaaacgacaaaaatgcagaaacaattctggataacaaattacaactctaccttaactaaaccaccaaacctcttcagaatacgagaagaacccatgattaacaaatgctgtaccaaaaaacccatccctataatataacaaaaccgaacgaatccaagatcaagaaatgccgtaccaaaaaacccatccctataatataaccaaaaccgaccgaagaccacgatccttcgcatgaacacgccaaaaagaaaaggcgaaatttcaataaatttaacatatatgcaaccaagaatcgttctgggcttctggccaagaacctgtcccccagaattcaaccaaaaccactcagattgcaccagataccccccacaaaccctcccaagaacccaccttgtctcgcagttctcctaatgcgcggatcccttcttggtccaggaagaaagaacgccaccatgtgaaacccccaagcgggcgcgattgcgcgaatgccgtacgtcgccgcgtgtgcaggccgcggggcttgccgcgtaggtgggatttagcagatgggaatcggtccagaggttggaaagattgtagctttcgccagttggtgttccctaaatcttgggactgagggtttatagtgccattttcgccggaagggagagcggtttgcggaaccgactgacgacgagagaggaggccctgcgccgacctgcggttgttcttcgtgtgccaagtgcgaacacaaacgtgtcccttttttttttttgaaattataaaaactacctggtgggccgtgtatttacgtggccatagctcccgtacaaaattatttaagcttttttcacgtgattttctcaaaatttgttaaatagtcatctcgttgtcttagcatattaaaagaaattgaatatttgtttttcagttttatagctcttcaaagttacaccagccatcacctgttacttttattctgcctctatttacttgtccgacatgtcacgacttatttcatccttaagacatttaaaaatcatatcttataatttttagagttcattgtctcgttaatttttctttttattgtttttagaagtcttgtcaaatgttgttactgtacttttttatagccagcccgctcttactctttattgttattggaatttaaaactgaacctagttatttttactttttataagtcccgtcaatcgccataaccttagtgcttcacggcctgtccgttgcctttctcttaatcgtcattggattctaaaaatcaaacctgctcatcattgaaggattttatttatagtttttagatttttcatcaaccgccacgacactaaccatgtatagcttatccgctaccccattcttttttggcatttgccactgttgtgttctagatgtattgttttttatattccttttttattatttctatattgtatttctacttgataactcatttttatctatttttagaatttatttttatttataactttaattaatatcgtgttgcgttctacgcggactattttttaatattccttatttccattctgaattttagttttttctaaattatattcctacttaaacactcaattttatcttatttttatttctgaatttattttattatatatttcgaattttaattaatcccatgtaatattctagatgatatatcctttcaatatttctttcatttcaaaatttagtatctctaaatgaggtagcttttgtaaatttttttcttttttttttccgttagtggcatgccactggcaaagagacggtatccgtaaatggtttaacttaggctgtgtttagttcacacggtgtgttagaagtttggttgatattggaacgatgtgacggaaaagttgaaagtttatgtgtgaaggaaagttttgatgtgatggaaaagttgaaagtttgaaaaaaaactttgtaactaaacacggccttattctcttcttccatattttctctcctatttggatcagaggtgaaggtggttcaattttctctcttgatttttttttattaaagcggttcaacattttctcctatccggtatttttctctcatttaaccttttttcatatgctattttagatcgcggatttttgagcggtttctctcttttttttaatggtttttcagaatatttttatatgtgggataaggtgggaaccagaaagatggctatggctagtaccggatatgacacatcttagcattacgaatctagattcgtagtactagaatatatcatatctgatgctagattcgttttttatgggacggagggagtagtagagactagatttgaattgctaaaactttctatttttaggatactaatttatactccctctatttcaaaatgtacttgtgccctttttaataagagattaaggctgggtgtgtggaaaatgactgtgatgggttcagatgagaaaatatatgagaaagattatgcttggttgagatgaggagataggtagagaagtagctgtattttttgaaaaatttaaataacacaagtagttgtgttttgagacaaattttaaatcctagatgtcgaagtgtgagctcctctatcggggtaccgcgaggccccctctttgttagttcgaccaggggcagcgagtgagattcgagattcctgtggtggatgagagaaagagaggggggcggggccctcgaagacagagacaaaagggatttatacaggttcgggccgctgagaagcgtaacaccctactcatgtgcttagctgactatatgtggaatacatatgcttaagcgcgtgagcccccaagcgccagttagacaaagagttgatcccccctccctaagtaggcttggaccttcttttatatctcaaggagttaccacatgggcccgccgagcctattcagggaggataatcacattaaatgtatttcttattgcttgtcttggaagtctgttgcacaccttgctgcgacgtagggcctgtcaaatccatccggctgacagtgtcaacacgcatgtcattcagcatttaaagagtgaggacttttgggtcctcatttgcaccgggaagtgggaaccctgccctaaccgggttaggcaaaccgtctccggcagacgtgagaggctgagctgcccctcacaattgcgacatgacgggggggggggggtgtcaggcggccgcctgacatgcaaccagagcgcaggcacactaccccagccatgtcaatcatcggtcacagatcggtcacggaccggtctgacgcaccacgccacaataaatgttgcacgtggagcgctcgctcagaccgccttaaacgcggttaggtgggcgctaggaacgcccgtctagcacggcacacgtggcgccacgtggagggggtcgaggtggcccgacccccaagcgaggagggggcagccgccactccaccccgggcctgaccctcttcggggaagtgtcatgtgggtctaggggcagtctcctcctttcaaactcggtaccctaagctgggagggggcagccgtcgctccagcccaggcccggcccccctcagggggggcgccacgtgggttcgggggcggcctcctccctctaaacatgataccccgggcccatatcaccaaccctagagcattgatttcaatatgtgggaataacattttcagcaaatcaggttctttataggaaaatctaagcaattcaaaaaattaattgctgagataattgaaagatattttttctcttaatcttaattttactaaagaacgtaaaaatatcttaaacttaatcttagtatttgcaaatgtttgcataatgtgtcacagttctttcagcccgtgggttaggaaggctgagagaagatgcaactatgcaagtacataccggagtccggagacaggaaggccaataggctgcgccctgcgctgtgcggagatggagtcgagtagtcgaccgcacgacgctgaagatttagtaccatatgttgacgtaatatactcgtcccgttccaaattactcaaaatttatacaatataaatgtttatatagatatttcctatcaatcacaagttatccttaatttctactaaaactttataaaatgcctatattttgatgcgaatcgagaagaagaaaaaatccagggtcgatagatgcagctataaccagttatcgttgctttttctatcttttgccctatagctaaaatttaaattttaaattttacaactaaattttaaagttgatttagtatatattttctaccgtagatcttctgcaatggagtataacgttactcttcccaacaatgacattttcccctcaaatgaaaaaaagaatcagaatatgttccctctcgtttatcttccagcatacatttcagaacgacatcatcagctatggcatgctgcatctggactcattctagcatttcaagaacaaaactccaccgtgcaaattcagtcactcccctcctataaaatactcctgtaaatttagatgcttcactgaaacacaaaatacattctttttgtgaaggaactggtctaaacacttctttttttcgagggaacgggcagcctgccatttcattaatagaaggatagataggtctaaacacttctccaattataataacaattatatacaatgttaataagatgcaaccggtttaacccacatatctgagcaaatctacactcgataggcattcaaccaccttgtcaaaaaataggtaatcagccccccaaagaatgtacactcaagaatgaaactgtcacaagattaacacagtttcattcttgtcacagaaagattaacatgtattgtatggctacactcttaagtgcactaagctgtttcagcattaacatcaactgctacttaaccatgtttacgtgtagtagtatatcctaacgacttcagtgtgacgccaaaatcaatcaactaagaaacattcctccgggccactgtacacaaactttcccttttgtttgactggcttaggtggcttggaactagcaaagtcatacaagtgctgcttcaccttcactgttcctcactaaataggtcatctggaagacagcgctccctgcaaagcagttggcatatgtcggatgttacaaccagattaattagttgggggcgaaacacaatacagtatatgagtaagatatgaaatacaatggctgttgctattgtacattcaaaagcacaaagcatctgaagtgcgttgccaacatattttgacctctcgcgagaacaataagatgggagtgttcatttgcattgactaaaaaagtttgagtaaagttcacagccggtctttaaagttgtagcgaggtgtcacttaggtcaatgatctaggaaaatcgtcaatacggtccgcgatcttgtttaagtgaatcatttaggtccaaagcacctctgatcgggttgactggcttacgtggccgtccacggtggcagcatttttgcattttagccccccccccccccccccccggcatcttgcctcccccatgtccgatccaggcagtctcccccaaatcctcctccttctacacgcgatttctagggttagtgattgcagcggcaatagggcgggcggccgtgagtacgagacccacgacaaggagggtggcgcgcacagaggcaacggcatgggaggcggcctcgggttcgtgaagtgcgctggtaggggagcccatgggtactcaaagtagtgggtcttcttcaagtgcccagaggagaaggtccgaccttcccctgataaagtgcccttgctgctgcgtgaagaacatcgtggagctcactgcacggacagatgctaatcgcgggcgcatttttttcacatgtcctgaccacgaggtaatggtccgattgatttggttttgggttttttgagttcctttattttcatgaacatgacagtgcttgcaattgatgaatgtgtgtagaaggatggttctgaatgcaatttctggtacaggaaagaagggtatgtgaagtatcttgagaggaaaggctacattgctgacaaggagctaagagatgtgaagcacatgtcagagaggaagaaggctgtgaacaatgaagatggtggggaagatgaagtgaagaagctaatgttatctctagtttccattgggttggagatagttcagatcttgaagggcatgctagttggttttattttacttgttgttgctttagtgtgtttggtgcttgctgtatggctgaaataagatgatgattatgggtggattatgtagtagttgtcagttgaggattatgcagttttaacatgtaatggcaatggccataattcactctagaatcaatggccataagtgtatgcagtttatatatgcaaactggattgactggttgtagtggtgttgtctgaatgtaggtggcaaaacaaatgcagttttaagatgtaatggcaatgggcttaatttactctggaatcaatgcaaattgggtactataatgttggcttgtatgattgcatttcaactcatgaattcagtagcaaataaaaattggcaatgatccatacaagaatgaataaaatcacaggtctgcaagttgaaaatcacaatttcagttggagaaaccatagatttgaacccattaagtttgcattggcataacttgtttgcatccaagcaagttcaagcaacaaaatacaatcccagttaaaaattttcaaatggttaccttttgtttgtctgtcataatggtccatggagaggtgttcactatcccaagttcagtcttcaaggtatcaagaaaccatgtccatgtgctgaaagactcaacttctaccacagccattgcaatggggtatatgcagtcattgggatcaattccaactgctgtcaacaattgacctccaaatttggtcttgatgtggcaaccatccagacaaatgattggcctgcaaccactgaggaatcctctcttgcatacatctagtgagaagtacaagctactaaatttgccctcatctaacctaagatagaaagaactcccaggattggacctccttagttcattgccataatcccacaacaagttgtattgggctatttcatcaccatatatctcttttagggccagcctcctagctcttgcaagcttgcttcttgaaggagtcaagttccactctttttgtactgtctttgcaaagctaggaatggtcatcttcccatcagccctaaatgactcagtgtacttttcagctaaccattttgcagtacacctttttagaatccactccttcttgcatttgtgatggggctcatatgtcttaacaatgaaggcctttgccctgctgtccattgaagcataaaagttccaggggcatccttctgcacaatgtgccttgatcctagttctatcattcctgggcatctttatgtccaccctgttcttcatgctatattcagagatagcctttctaactaattcaactgaagagaataccatgcctactttgaagattgggttgttaatgtcttcaggattaaaagacttaaacttcaagttgaactcatcatcatcatcatcacttggcaagtgcagttgttcatcatcacttgtgtcaccttctgacaaatctgccacaactttcttgcccttcaacacactacctgcagccttcttatggttgaatttcttcctatccccctcttccacatcaccatccacattttcctcaaagaggtcatcatcatcatcctcccactcataatcactatcaacaaaatcagaatcagactcactgtcatctgagtttatatgaaagctcaactatttcttcaccaacatccaattcttcatgcactacatgtccatcaggtgcattcctagggtttctatcctcgctttctgcctcctctgtctgctggcactgtctactagggttgaacacctctggcaactcagcttctgggctcagaacaatgtcatctatatttcttcctgagacatgattagtatgatcaaaatagatgacaaaattcttgattttatttgacactgatttcatgacattgatctcaacttcactgtctatgatcctcaatccatcagacatgttctttccaggcaataaccaataagttttcaactttccatcagagtcatatccaagcatggcaacaaagtctgctaaatgtagacatctaccccaatctcgagaatcaatattgtcaaaccagtctactttgccatccatatatgtgcggttcactcccataccacagaaaaaccccccatgatgaaactcaattgaaaagtactttgatccaggacctatatagtgcacacattcgggatgagacaacatactaaaccctacattacatcacaatagctaaaaaaacacacatttaccaacacaaaatcaactaattgcattctagatgaaaccctagaaaaaattgccaccgaccaaaagtcccaaatttcttgaagaaacaaacttccaaacctctcaatcacagattaaacttaccaaatgaaagggattaaaagatgacgacgacactcactataaacaggcgcaggtgcgccttcatctcgcaaggtcaggtccatctcgcgcctccgacgcctccgatgacggcgcccaatcggttggcggccaaacgcgccacccagaacgcgtctccggccaccctgaccccgatcgccgactccgccctaatcgccgcccctcctcggagtgctcctagctcggccagaacgagagaatgggggtcaattttggtcgcgtgtagaaggaggaggatttgggggagactgcctggatcggaaataggggaggcaagatgcggcggggctaaaatgcaaaaatgctgccaccgtggacggccacgtaagccagtcaacccggtcagaggcgctttggacctaaatgattcacttaaacaagatcgcggaccgtattgacaattttcctagatcatagacctaagtgacacctcgctacaactttaaggaccggctgtgaactttactcaaaaaagtttctatgctgcataaagaatgaaaaatgccacttcaacgttacagatgtacaactgtgcagcagcatcagaagtgctccaattttccaacatatcttgatctttctcatgaataaattatgaaaagtattaactcttaatttcattaatttgtttccgtgttgcttaaagaataatgttctcagaagcaataatgcatcgtacaggttgaaataagactgtttaatctgcaaatagaaacaggagtactcattactcacatagctgagaattctgaagattcatccacattagactcttttgtcgcatgatcatctaaaacatcacagaatcaagtaagggcctgtttggcacagctccaactcctaaatataactccagaagttgagtctggagtggagttgtggagctgcctaaacccagctccacaactctattacattttgtgagagagctccacccaactccactcctagttttggtggagctaaaactgtttggctgagctccagctccaggaggggtggagttggagctggagctgtgccaaacaggccctaagacttactaatataaaaactataacagtttaatgaaaaacaaggatgaatatggagtagggaaattccacatgaataccttctggagattctgttttcttctcagagaggttatgtgttagaggtgaatcaaaatctccaaattgatgtgtcagtgtctcctgggaaagttcaatgaaattcggcattttttgtcctatcagaaatgacaaaagaaatggcttaataagtcaaaatatagaatcacaaccataagtctagaactaaatcagaagtggcacagcacaaagccaaggaagggcatttacagatttactcaccagagtgaccctcaatggcattgtcacatgatgtcctgtgtgcaacattgtcaaaacggtcgtttctctgaggaagctgcctgtatcggtaaacatgttattatgtttgaacatgtaaatacagagagaataaacaattgcacaatgtataagcataaaatattagttcaacaaaagcaaactaatttccaaccattaaatcagtaaataactgtctcgtggaacttaaatgtgcagcaaaaacaaactatttccatgtattaaacggctaccttgcagggacttgtttaagatgtacgtataaattataattactgaaaaattcaatctgcaacttaagtacagacagaaaagctagttattattttttcacaaagacggtacatgtggaacagaatggacaaattgaccatacacttaaaataattaaccaaatgagtaatatgtcagtatgatttatgaagcacgcatgagtgcatgataacaaaaaagcgtgaaactgatgtcccatagaccaataattatttctaaaatcaaattagtccccactaaccactgccatgaaaaagaagtccctggtcaagatcatatttcaactaacaaccacatttcaagaactctcaaattgacttccagaattaatcttcagctaataactagttttaaaatcctcaagaaagcacttatggaagatttcgtgcaagtccttagatgagagagatttgatcttttgcaagctatatatatgaagatcagaaaagggagaggacactgtggcaagactgccatttggacctcagaacaaacaagaacacatcaaactctaatcctgtaattagcagaataccgtgacataacccctctgaaaaagaggtgcacccagctgcttgccaggacagagaaggattgatttgggaatggttaaaatgtacttactatagatttgagtctaacccctttatccaaacaggttcttaacagtatagtttgtaaatcacgaatcagatattgtttgaacaaaaacaacagcaggtttaaaatgctggttaattaaagacaatctgagaagcaatcaacaaaagaaacagtgaagttagataaagtacctttgctcttgtttggtcctatccaggtaaggctttgactctaacttctactccactgatggaatgcgatgtgctctttgataagagaagccccactgtgtcatcattttcgaatgtcacaaaaccgaaagtgtgcttctcattgtctggcttaaaggggatgtagacattgatcacaggtccgaacttcctagaagaaataccatcataatattattgaattgaacatagtggtataatttgaaacttcaaatcatattgcacctagtcttgtcctcaaaacaaagtaaacatagtactaagtttagaagaaaatacttgaagtagtcccgaatatttttccaagtcaatatgttcttagcgatggtaatataaatcgtaaactcggtactttgaccgaagaaatccctctgtgagccatgaggatgggattgcctctgattgtgaccaaagaaatccctctgtgagccacgaggatgagatagcctctgattgtgcaactcagggacaccagacccgagaacttgtgcatttaggtaatcccttggcatgccatcgaaggcattggcacatgatgtcctgtgtgcaacattgtcaaaatggtcgttttcttgaggaagcttcctgtatcagtaagcatgttaggtttgaatgtgtaaataagagagcaaaaacgattgaacaagctaaaaatattagttcaataaaagcaaactaatttccaaccattaaatcagtaaataaatgtctcgtggaacttaaatgtacagtgaaaacaaactatttccatgtgcccaaaaattaaacggataccttgcaggtacttgtttaagatgtacgtaattatataattactgaaaaattcaatctgcaacttaagtacagccagaaaagctagttattattttttcacaaagacggtacatgtggaacaaaatggacgatttgactacacatttaaaataagtaaccaaatgaataaactgtcaatatgatttatgaagcacacctgcacatgcatgagtgcatgataacataaaagcatgaactctgtcctatagactgaatgaatattaaaatcaaattagtccccaccaaccattgccatgcaaaaggaggccccgataatagatcatacttttattaacaaccatatttcaggaactctcaaattgacctccagaaagaatcttcaactaataactaattttagaatcctaaagaatgcacttatggaagattttgtgcaagtccttggatgagagggaatgatcttttgccggccaaataaatgaagatcagaaaagggagagtacattgtggaaagactgccatttggacctcagaacaaacagaacacatcaaactcaaagcctgcaattagcagcaggatactgtgacgtaagttacataaccccactgaaaaagaggcacaccaagctgcttgccaggacatagggatcgatttgggaattgttaacatgtactcctcctaacaggcgctcaacagtatagtttgtaaaccataactcagatatcgtttggatnnnnnnnnnnnnnnnnnnnnnnntatagtgagtaggtcaaatcg

SEQ ID NO: 24464 - DNA, 2869 bp, Oryza sativa
  unsure (1)..(2869): unsure at all n locations
nctgcttgccaggacatagggatcgatttgggaattgttaacatgtactcctcctaacaggcgctcaacagtatagtttgtaaaccataactcagatatcgtttggatgaaaacaacagtaggtttacattgtaggttaattaaaaaaactgcgagaagcaatcaacaaaagaaacagcaaagttagataacagacctttgctcttgtttggtccattccaggtaacgcttgactctaacttttactccaaagatgaaatgaggtgtgctctttgataagagaaggctcaccgtatcagcattttcaaatgtcacaaaaccgaaagtgtacttttcattccctggcttacagctaaggtagacattgatcacaggcccgaacttcctggaagaaataccatcgtaaaattattgaattgaatgtagtggtataatttgaaactttaaatcatattacacctagtattgtcctccaaactagtaaacataatacaaaggttagaagaaaatacttgaagtagtcccaaatattttccttagttaatctgccgccatcaaagttgatggtaatataaatcgtaaaatcggaaccttcaccaaagaaatccctatgtcggccacgaggatgagattgcctctgattgtgcatctcatggacatcagacccgagaacattaacttgtgcatttagataatcccttggcaagccatcacctggaatgttcaaagactgcaaatgcgcagaaaatgggatgtcaaaacctccactttgaccaacggggaggcatggaaacttaactccatgataacaactacctacctgaaactgaggctccaaatagagcgatggggattcataatcataccgcgttgaaggtgactgcagtaagggtagctgctggaggtgttgtattggggggaacctcatgtagtatgacttcgcctcattaatcaaggcttgtattgcctcatcccgggctgaaaatgcataccaactgatccaacttggctttgatatgttggcgtactgaacaatagcatttgcacatgatggctccaactgatccaacttggcttgtgccgcaaaaccagttgacattggagcatatgccccccgttcctgcaacacaagggacaaaatataaaaacccactgcaagccaatatttctgattggaaaaatcagcagttatttctaaaagattacaaggataacaattaaaccaaaatttggcagtagagaaaattagtgcaagcaaaaccggaaaccttgcatctatctctgtttgcacccacaaaagaggaaacatttgcaccaactcgtgtttttccacattgacccaaaattatgttttcctggttccaaatctgaagaacaaagtgcaaagttatctgttggatgcaaaacagaaactctatacccaccaacccagccaaaatatccatagtaagagaacgaacccaatgagcaagaactgttctttccaataacccttctcagaatccaaccaaaactagccgaacgctactcctcctgtaatccatagacctgcctccacaagaacacaccaaaagaagaaaagagaagttgtatatctacaaacaagaactattccagccaagaacataatctcggaattaaaccaataccactcagattgtactagatactccacgaacccctagaagagctcaccccgcaaagaatcacaagagtacaaaacatcgttctggccaagaatcagtatccagagtgcaactaaaaccgccaagattgtacctgataatccacgaacccctagaacagctgaacccgcaaagaatcacaagagtaaaaggcaccgtcccggccaagaatcagtatccagagttcaactagaaccaccaagattgtaccagataatccacgaaccgctacatgaattcacccgcgtaaagaaaagacaagaagcgaaggatcgttctagccaagaacccacccgtccccggaattcaaccaaaaccgctcttgattgtaccagatgctccacaaaacacctcaagaacgcacaaggatcaagcaaacgacagaaaagagcaaatgcaacgccgcgctagctccccaatttactagtacatacattgtcgtccaggaagcgcaccaccctgcgacaccgagcggcgaagggggggcaggggggagaagggagacgaagacgacgaagcggccgctgacgctaatgccgcgacgcctctcgcaccggcttgcttgcttggtaccgaaatggattccgccgcggatggcaattcgatcaaaaaggctgtggatttcgctacttggtgtccctctcctaattcttgggaggaggaggagggtttatatagcgccatgcgcgcgggggggagaaggcggttcgctaaaccgagctcagcaacggcgagtcgattcccgtttggatgtcgggaatcgaaatgccacccgggaatgccatacattgggaaagaactggattttgaacccagttggggagggattagcagaggagaaaattggataaatcgcagcgactgaaaccagtcggaggtgggattagagggggaatttgtataaaccccggcgattgaaacccaatggatgtgggattggagggggaagagtgtatttataagcagcgattgaaacccagtggaggtgtggttttaggaggggggaaatgggatcggagagaatgaggatgagaatacccgttgcgccggcggccggagccaggtgccaagcggcggcggtccccggccgtccgtcggagacccgccgnnnnnnnnnnnnnnnnnnnnnnnnnnnnnnnnnnnnnnnnnnnnnnnnnnnnnnnnnnnnnnnnnnnnnnnngtcg

SEQ ID NO: 24465 - DNA, 1443 bp, Oryza sativa
  unsure (1)..(1443): unsure at all n locations
caccaaaatggatttggctctatcttccccttttaggattacacaaaaaccaaattcatctggaattagttcctcgaaagactttggggaaaggtgtcaaaaagaaaaaaaatttgcgaaaacatcaaattttgctggttaatttggcaaagaaaaatgcagtacctgaattttccctatatacggattaggcataaatccatcggcttcgatgggcctgagtatgcctacaggccgaggcgggtccaatcgaacgctctgcttgttgggctttggaagctttttgcccacccgtgtcctgacttgggcctctgctcgggccaccgtgtcatggatcgctagcctaccattggtagatcaagtcaaccgctgtaaataggtccagatcgacaatagttataaggcctgtttggttgggggagtttttaagagggattgggagtttagagggatgaggctattaagtgttttgtttggttaggagacatgataattttggtgggatggggatggggaattgagtaagaaactcccttcttttcaataccttggtaggggcaggtaattgggaagtaatttctcctttagtttttctaagcaaatctcagccatccatttttattaatgacctaatctccaactaaacttcctatcaatttccatcacctctaccaaacaagatattaggattaaaaatcaaattcccatcttaatctcatcatcaatttcctcgtgtaaactctcaatccccttccctcgagttaccaaacaagccgatagtttcgggggaaatttgcgacggtcctctcgttcttgtattatcgttcgtgtttttttttacaagtacctcgcagacgagtactccctccgtattttaatgtatgtcaccgttgacttttcgaccaacgtttgaccattcgttttattcaaaaattttgtgcaaatatgaaaatatttatatcatgcttaaagaatatttgatgatgaattaagtcacaataaaataaataataattacataaaaattttttaataagacgaatggtcaaacgttgggtaaaaaataaacggcatcctaccttaaaatatagatatggatgtagtacgtgacagcgtgagccaaactttgacggtccattgtattatctgtgacgccgtttccggcgcccctgacatgaacagaacgacgcgcaccaagcacagccagtctcccctcgtcggcggcgatacccgactacaaaaacctacaaaaaggcacagannnnnnnnnnnnnnnnnnnnnnnnnnnnnnnnnnnnnnnnnnnnnnnnnnnnnnggcgtaaacgacatgtcgacgacttnannnnnngnnnnannnnaanngaataattaattgtaacgcacagaatgaattaataaaagagaaagganggngataatttaaataaaatgcaaataggccgc

SEQ ID NO: 24466 - DNA, 6696 bp, Oryza sativa
  unsure (1)..(6696): unsure at all n locations
ncgtgctgagtacacgtcgcactataggcgaattcgagctcggtaccctttataattagtatttttattattgttagatgataaaacatgattaatactttgtgtgacttgtctttttttatttttttcataatttttttaaataagacggacggtcaaacgttggacacggaaacccaaggtttgtctttttttgggactgagggagtaagttggaaggtttttcgatcactaccttatttttataaaatattatatatgtgtgtgtatgtcatatgctatatagaatattctttgttgttgtttttaggaaagtacaaataccccgctaaactttggatagaagtttgtctacactctacactttaaaaccggatattcaacccccaaaacttcactgtactgtccatattaccctcttaaagtggttttagatggtggtaggggtgaaaacggggcgggtatttcccgcccgcccgtccgtgatcacattatttcaggacaaattcgggtacccgggacttttcacggatatcgggtccgaataggtattttttgacggatacaagatcatgttcgggaacgtagtattcaacggatttagattatccggtaaaaaatccgggtattacccggatagttatacggatctcttacccctattatgtttttgtgaggcactttttggtacaatatattgattctactatgatgtattgtaccctatttattttcaaaggtcctaatagcctaatataatcgtattatggatatatggaattgttgaatagttattgtctatgtgatatataagattattgcttcgacttgatatccgaataaatatttgtaaccgagatagtgtacgtatccattttggtacgtattcgttccgtatttttgcccgacattatctgagtttgtatccgtattcagcactatctgtgtccgacccgattccgattataaaatatgggttaggatatgggaagggtaaggtctgaccgaacacgacccgttttcacccctagatggtggttttgcatattcctaaagtggctttatatggtggttttgcatattttttggaagcttaaacgaacaactttgaataactaataaaacatatttgcaaatcatcagttataagttatcaatttatccttatatagtgagattatactattattatgttggtacttatttgtaatcagttataacttatcaatttatccttatatagtgagattatactattattatattggtacttatttgtaagtgaaagctaatagagtaaaagatagatttaagtcgaaattttaatatatatgtctaacgtgtgggtcatgtggtcaaacccatctaacttacatacaaattttcaaaactaccttaggggtataaacggcattgcaaagtttaggggttgaatatccggtttcaaagttcagggtgctagacggatttctatccaaagtttatggggttatttggatttttttccttgtttttaatgtaaatcaaccacttatatgtcatgcaaagagactacacaaaaatgtccataatcttttggaacttttagccggtcaatcaattattcataatacatattaacatatgtaagggcattttgggaaattttaaaaaggtacgtggttgaatagctagaatattgttcatggacttaggcggtgttcttaggtaagggttctctccagcacggaaaatggagcgatggattagtgcacgattagttaagtattagctaaaaaattttaaaatgggttagtatgattttttaaagtaactttccacaaaaattttttgcaaaaaatacaacgcttagtagtttgggaagcgtgcgcatggaaaactagggaggagatgatgggaactagaagagccgaacacagcctaatggtatattatagaaaggagaaacactggcaaattgttgaactaggggaaactccatgacatggaataggttctctcttcataataagaggccctccaacaacaaattccacacttttgttcaccgtgaataactcttggcaccaaaatgaacgcattaattaacatatagtatcatttacattagccgcattaaattgagatgtcggcttcgtaagcaagaaaaataagcgaatcagtaacacatatgattaattaagaataaagtattataatttttttaaaaaaattgattctaaaagaaactttggtatataaattttttacgaaaaacattatttcgtaattcggaaagcgtacaaaaactgctgaatcaaataggcccttacaccccttcttgtactataatctaattatgatacattacgaagttagcgcatcacatgcttactcagttattgttgttaagtcgatttgtgggacaggtaagttacaacggtctcaagctggatatactatgcgttctctcaccaccagcattattggtaacatcgtcatggcacaaacaagaacactgcatacatatgcctgtactccccttcattttatcatataagtatttagaaaaaaaaactaagatagagagaaaatattctttttagtctctgtagtagtcaaattttaaattttaaataacttaaattctctactaagcatctcatttagtggtgacaacggggcacatcaaggaaaaccaggccccatccctaaccccgatgggtcctcggaacccggtcggggacccaggtgaaggagagggggcatacatgtagggaaataaggtcggaactcgttgacaacgagttagggagtgtgagacagtggtaggccggcctgttgagagaaggagacgcaactgagcataacagagctgcgaagccgaggcagtgaagctcaatagaggtgggcgagctaggaggcgcacttcttcgacaagctagaagcagtgaggaaggtgatgctcggtgtgttgtactaatgtgcgagtagcgagctgggaggcagagaattgcgcatccaggaggatgggtggaatcacgtgatgtcatgagtgaccaattcgcgagcttcggggagctcaaattttgactttttgagaagcatatggtgaaaatgtagaagagctggatttctcaacttctgttcttttgttaattttttgtgtactctattactactatatattattagaatcttggataataatgcggatagtttggtggagtctaagactctataaaatcgtagttgctagaagctcctttaaacatgaccatttttatatgcggatcattagctctctcatttgttaaaatatttcaaattaaactaaatgttctttttttcctacattatataccttaaagacaaaaaatggtagtggctctgtttttaatttgaagagaatgggaacaaggagtacaaatacttaatttgttttaaagtaattgtcacctaacaacactaatcctcaaaatttgaccattcacttgtttttttagaaaaataaatacttcaaaggatacaataataccaaagtgtgtagcattatactaattcataatcataaacataaaactttcatttttttaatagtggataatcccgcactttgtttcaagctatgaaaaacttaaaactcccatcctcttaatttaaccattttaataagagttgttggtgataaagttgaattaacacttatttggaaataatagcatattactttgcgattataggcaagagtctccctgccgggaggggaactaattgatgcagtctatccacgaaaatttgcatatgcaccatcgtaaaagagtggattcgctggaatgccatcacttagtggatttcgctaaaatgccatagtcaatcggagggcgttccgtataatgttgttttcatcctattatataaatagaaatgattttgcactctttttagttgtattctactggagttgcccttggacctggacaggttgttcctttttcttttctccatcgaaccaaacttgttattctcacgtttttcttcctctcttggctgaggcagcgagccacgtacacgccaacaccgccccaccttaccgctgccgcaacaagcccatggatggaagggatcgttgggtcgaaagatccacacacctcctccgaagacccaaaagaaaaaaagaagtcctaccacgtcgaggcaacagtggagaggaatcaaccaccgtcatcgaggcaagaaacaaaaaggagcaacattaaattgattgaggaaacgatgagacgacgatgaatgcgagtggcgaactaggaggcagaggtggcaagcggctcagcagagagtgatgcaaggattccttgacgtccccgccgcccaagcgccagactcgaccacccaggacaacttgccgccccggcatgcctggccgctcacccctgtgccgcccgctagtcactgctcaaccccgctctggaggatgcacccccgtaggaggatgcgtcccagcttgacgacaggggagcatgagccgcctccacgacacggcggacttcgatggatgctgaggcggggtgccgatgcggctacggaatagcgggatgcggtgcactagtgggccacacactcctacctcagctcgttgggaaaacaatgacgagatgaccagttttcgagaagagagaaaacatggagccatgggtagtgagaaatagagtcaaaacgatatgcaaatacttaaaaggatgaaaataacattgtatcgaacacccatgaattgatagtggaattttagcaaacctgatgatggcatctatctattatattactaaaacagctttgaaaagaggcaccacgttcgctgtggggctagaaattcttacattaatcgaagaaaaagaaaaaaagaaaaagaagagtccaagtagaagtccaatttaaaaatagctgaaattcggaattaaaaataagcaatattgaaaaaagtttccatataaaaacccaatacgagtttaatcaaaattcaaaataaaaataaaataaaatccaaaattagaaaaggaaaggagagtccaggtagaaatacaatctaaaaataactgaaattcagaattaaaaataagaaatattgaaagaatttttcatctaagaacccaatacgagattaatcaaaattcgaaataaaaataaaataaaatccaaaattagaaagaaaaggagagtccaagtaggaatacaatttaagaatagctgaaattcggaattaaaaataagcaatattaaaagaagtttccatttaagaacccaatacgagattagtcaaaattcaaaataaaaataaaaaaaataaattagaaaaggaaaggagagtccaagtaggaataaaatttaaaaatagttgaaattcggaattaaaaataaggaatattaaaagaagagtccatataagaacccaatacgagattaattaaaattcggaataaaaataaaaataaatccgaaattagcaaaagaaaacaaaagaagagtttaagtagacatacaatttaaaattagctgaaatttggaattaaaaataagcaatattgaaagaagaatccatataagaacccaatacgagattaattaaaatttcaaataaaaaataaaataatatccaaaattagaaaaattaaaacagagttcatgtaggaatacaattttaaaacaactaaaattggaaataaaaaataaaaacattaaaaagtacacaatgcggtattaactaatttttttaaaaaataaattatgaaattagaaaaagaaaaataagatttcaattaggaatataatttataaataactaaaatttgtgataaaaataaagactattaaaaaataagaccatctaaaatacatgacgagataaattaagtaacaggcctacaaaggagtagagtggtggcggttgagacgacgtataaaaattgttaataaaacaccaatagaatcctaatgacgattaaaaggagggatgtcaagatatgccggcccagtctttcggaggtgctcataggggtagggtgtgcgtgtgtgcattcataggggtgagtgtgcgcacgttgtgagcgcctatatttgtactgtgtttctaaaaaaaaaggagggatgtcaggcaggccgtaaagcaaacaagtaaggcggttgctgggatttctagaaagtaaaaaaaaataaaccccattgataatcatattcgatttttaaaatctcaatggcaataaaaaggagaagcagcgggcggggtgtataagagtatagttgcagagccgccgacggttaatgagacttctagaaaataaaaaatgaattccaacgatagttatgttcgatttttagaatcacaatgacaataaagagtaggcggcggacgggctatagaggggcataatggcatcgtttgatgggacttctaaaaattataaaaaataaaactacaagtctaatttttaaaggttcggaacttccaaaaagtaaaaaaaacccaatgataattatattcgatttaaaatctaatgacaataaagaagggaggcagcggacgagccgtagaggagtacaatggcaaagccgctgacagtttggcgggacttctagaannnnnnnnnnnnnnnnnnnnnnnnnnnnnnnnnnnnnnnnnnnnnnnnnnnnnnnnnnntgtaacttgcgagtcatgtcatcgtg

SEQ ID NO: 24467 - DNA, 3650 bp, Oryza sativa
  unsure (1)..(3650): unsure at all n locations
acatcatacatccgcaccgcggacggcgctggacagttacaaccgtcaatggtgacgacaccgcagcagccgatcggtaaattatccgatccgctggggtgcccgggccccgggccgtatcagtagacggatctcggccgaatttggtacggatctcggcgaggggcgtccggatctggtacggatctcgagtaattctcaaggagggaggggtgggatggggaggcagcgcgcttggcgttttgccacgtggattgtacgggggggtgggtgcggcccccgatcgcggcgttgctttcagctcggatctagctgatgtgcgtcctgcgcgcgcgggcgcatgcgtttttgtggtggcgttgtggataagtcggggttttgtccgcatttgctatggctggctggtatcaattgggcttgcgtttgtggattgcagggggaggaggggaggggaggacgcgatggaggcggactccgggaagctcttcgtcggcggcatctcgtgggagacggacgaggaccgcctccgcgagtacttcagccggttcggggaggtcaccgaggccgtcatcatgcgggaccgcaacaccggccgcgcccgtgggttcggcttcgtggtcttcaccgacgcaggcgtcgccgagcgggtcaccatggataagcacatgatcgacgggcgcatggtaaatcatgtggtgacctgacccccccccccccccccctgctctttcctctgctagtgaagtattgtgcatttcggtggcaattctgtcctagtgcggctgttcattgtctgagctcaattgtgcataccgattcaggtggaagcgaagaaagctgttcccagggacgaccagagcatcaccagcaagaacaatggcagcagcatagggtcacctggaccaggccgtactagaaagatctttgttggaggcttggcctctaatgttactgaggttgaatttagaaggtattttgagcaatttggtgtgattacggatgtggttgtcatgtacgaccacaacacgcagaggcctaggggctttggattcatcacctatgactcagaagatgcggtggacaaggcactgcacaagaacttccatgagctgaatggtaagatggttgaggtcaagagagctgttccaaaggagcaatcacctggacctgctgcacgttcacctgcgggagggcagaactatgctatgagcagggtccatagcttcttgaatggtttcaaccagggttataacccaaaccctattggaggttatggcatgagggttgatggaaggtatggtctgcttacaggcgcacggaatggattctcttcatttggccctggttatggaatgggcatgaattctgaatctgggatgaatgcgaattttggcgccaattctagttttgtcaataactccaatgggcggcagataggttcattctacaatggtagttcaaacagattaggtagtcctattggttatgttggtcttaatgatgattcaggatcactattgagttcaatgtcaaggaatgtttggggtaatgaaaatctgaactacccaaacaaccccacaaacatgagttcttttgcaccatctggaactggaggtcaaatgggtattaccagtgacggtattaattggggagggcctactcctggccatggaatgggcaacatttcaagccttgggctggctaaccttggccgtggagctggagacagttttggcttgccttctggcagctatggaaggagcaatgcaactggtaccattggtgaacccttctctgcaccacccaatgcatatgaagtgaacaatgcagatacatatggcagcagctccatttatggagactcaacttggaggttcacgtcatctgagattgatatgcctccttttggtaatgaccttggaaatgttgatccagatatcaaatcaaacataccagcaagttacatgggcaactatactgttaataataatcagacaagcagaggtcagtaatcacttcaacattttgctgagctaaacacatattccctatttctttataaccaaatcaatgctttctcacttacttagccattaatgaagcaaataaatcatatactcccctccggttctgaatgtaggttgttttagagttgtgcacaggaattagaaagtgttaaagtgacctcgttgccctattgttattaaacattggaaaaaatacctcatttgttcacgagagtagtggcattcaattagcaaggacataagaggaaaaatccacgggacaagtggctatagtgacttatatttaatgaagagtaaagaactataatgcgacctatatttggaaccggagggagtatactcaagtagactggtgataccatatataaaaaaagacctttcttgggagtttccaatccagcaaaatttagccttaggagttaggacctgataatggctaaattttgcatgagcacaaaagcaatccacattctatatctattattatgctttctatattttcttaaatctatgcctaaaatgtaatttgatttctcaatccacactttggtgtttatctagattctagatgcctttgttcaatacaagattccttcattcgttgcccgaacttaatacttaatgagagttgagcactacacttggacaaatcaacatatgctattgctgatctctatttacatgtcaccacagaattttgaaacatttgtattagctgaggacctaatctcgtagtaatctcttgccacagctaatttgtcaatttgaactgtgatactcttgtcttgcctctgcgtgtgttaaaaacgtggcaataggttaaccatttgttaaaataaaataatcatgtcttagatggtttggtaaattttatggatgcatgtgggtgccagttggctcatattgacctcattccacttcacatcaaacctaataaggtgttgcatttgttaatttatgcatctgaattatttgtatggaaatgaacagaatgggggcaatacgacctacatcactaggaaagcggtagcgcctctgtagttagtcagttgtgcactttttaaaaatgagcagtggatgaagcatttgattgtacgctagtgtgataagctgcccttttgtaatacacgtggttctacatggtccttttatagaaaattgaaaagaactttggtcctatagtttaattaactcggacgcgagtcatctacctatcctgcgcagatacttttatggagctgtaatgttttggttgttaatttggacaattatgcttactggtagcccaattcatcgtcatcactaaatcattcagttggtccaagtctaaatttcagtgtggtgtatggcccccttgcctcatgtatgttattatcatcaaattgagtatctactgctcattccagtcacaaatacatgtttatacataagtgcaatcaaacttttgaaactttgattatcagatgggatgcatgaaatcatttgtaagtaatataaatatagtgcagttgtcggcagaaattagatgaacaaattgtgttnnnnnnnnnnnnnnnnnnnnnnnnnnnnnnnnnnnnnnnnnnnnnnnnnnnnnngacttatacaactgggatgacgacgact

SEQ ID NO: 24468 - DNA, 8215 bp, Oryza sativa
  unsure (1)..(8215): unsure at all n locations
ccctgatggatgctactcccagtctnnnnnnnnnnnnnnnnnnnnnnnnnnnnnnnnnnnnnnnnnnnnnnnnnnnnnnnnnnnnnnagttttcaaacatttcattttgaaaaagaaaaatggcagttcaaaggcctaattaagctattgctttgctcctaatatagtctagcagatcgaacgttatcatgattttgattgtaattaattctagccctaaatttttgggataggtgagcttgtcaaatctgctaatctgggaagaaactggatgcagtaatgaggggtgggggggaacctggccggtgttgccgttgatgaagacgttgctgcagttgaggtcgcggtggatgatgcaggggtcgtgggtgtggaggtggtcgagtccgaggaggatctggcgcgcccacttcttgagcgccttgacggagacgtggcggtggcggtcgcggtactcgcggaggctgccggaggtgcagacctcggtgatgaagttgagcacgccggcgtcgcggtcgagccagaccttgtggaagccgatgatgtgctcgtggtggagggagcggaggaggcgcacctcggcgtggaggcgctccaccatggccgggtcgcggtcggcgagcgcgcgcagccgcacgcggttccacgccacctcgatcccttcctcctggtcgaacccgcggtacaccttcttcacggagccgaggccgagcacgtcggcgtaccgcccgaaccgccccgtcgggtccacctcctcgaacgcctcctcctcctcccccgccgacgccgacaccgccatgcccccctgctcctcctccccccggcggacgccgctggtcgccctcgtcgtcgtcgtcgtcgcgcgccgcggcggagtcgggttggggggcatgcgttgcgtcgcgtcgcggcgcggcggggacgcggcggcgcgacccgaggcggggaaagtggggcgaggttagcagcagcggcgaaatcgggggcggcggctatttatacgcggagacaggcgtagtaggctgacgtggccgtgtgaacgcgtggtgcgtcgcggttgggccacccgcaggtaagcgcctgcaccaggcagagccggtataggagtacaagcctgtgacgtatttgtactcgtactacgtccgtatagcgctacggtctacggcggactggagggttgaccaagcttggtgggcccgcctcgccggtaggagcatgcgacacgtggcacggatgggccatggcccatgggagtatgggactcgatctggagttagttaagccgacggccagtgctctctaggaaggcgaaggtgaggtaggccgggtatggtgcaggtcagaggagactcagaggcgattgtacagataccaaatgctcatccattctccagggattttcgaatactttacgccatactgatattagatgaaaattcaagtaatggagtaaaggccatgttcttttctccaacaaaaattggattaaattttggatactcgtgccacgctttttaaactgctaaacggtacgtttcgtacgaaaactttctatatgaaaattgttctaaaatatcatattagtctattttttaagtttagaataattaaaactcaattaattacacattattataacctcgttttgtataaaacacttaatcttcatcttcatcttcaggatattcaaacactaccaaagtactacaccctcatatgtcccgatatataacaatctaggatagattctaggactataaatctgaacatatgaattagactcgtcttaaaactacgaatctgaacatagtcacataggatatatccaaattcgtagtcctaatatgtgcttgctacatatggggatggagggagtagcctactagctagctaagcagtgacatatgcacaacgtgcagtccgcgtttatcagacggtaatcctacaatcttatccgttggtagcgctgtttgacttacgcaggtcgcgatctgatcgctgtttcggcgtgattcgtctcggagaatgcagccatttggatgcatcaacgtagcaggcggcgcgtgccgattctccgctctgttccttcatttgtgccaagtgttctgctcatgcggtcattcccagaatagaaatgctagggaacacattaactttatctctagtttcgagctaatctgaccaagctcgcagcttgttagaaatgtaggaattcatatttaggcagcaagcctatgagagcgttcgcgaaaaaaaaaatccgttcgaccaaacaggcctcaaagagtcaaaggttgcaactcaatcccatccttggccatttaagacgattgagatcaaaatatacaaatgtcaagaatgggattgaaccgtctccccattcgcaaactttcatgaatggggttaaccaagcaaactgtcaagaagttttcagaggttcagctgaaagaacagtggatttcacatgacattatatttcataaatgcaatttaatgacgatggtcctcgccagataatcaattttggggagaattgaaacccaatattcagcgatattttacatggtttcatatgcctgcatttgcagacttaatagttcagcggttttccaatcactatccttctttcagcatcatgtgcttctctaatatatacttgccttctttgtacttctggtcctcactataagctttctcctgcatattgttcaatgagcacagttacatgatgatgactgatccagaaaaaataaccaacattcatgagagaaatggcatgaacattaaagagcatattcgttcgttcacgcttatggactcatacttgctgacatttggatcaaatgcccaagtgtgtatgacccaggattggtcttatagtccatctggcagtagcaagtgtttagaggtataattagtcatgcatgaaggaacatccagccaatgctcctggaggaaatcatcactacaaatgcaaccaaacaataaaaatctcatattaagttaacaatttgcaagattcctgtggaaagggcagcctgaccatggaactaagggagaaatggaggaacaaattgatcatatgctccttagctgaaaagacccactatggactagatgttcccaaccacataacataggcaacatattgttttttccccaaaaaaaaattcaccaggaaaaaataactataaactacacagtggtagaaaatgaggtgtacttaatttataaagctcagaactatagggtagtgatcgactagtctcggtatatattattaagatctggacagtcccaggtttaagctacgacttgaacactaagcattactacctactttgagtgttgcagaagaatgcattcaaacgataaagtgccgcatggaagctcatgaaacatgatctaacagaaaagcctacgagcatagatgagtttgtagagggagtgatagcttgttagacttctaccggtaatgcaccatggagcatggattcatcatgcatcttctcaactgacaacatcaaatttcgaaaatgaggaaacaaaaaaaccagatcatgtttgtcttgtgtcagaaagcatagccacatcctgctgcccattttgcctcacaattaaggcatatagtattaatagagttttacacatcaaagaaatgataacacgaaagagatccaggaaatagaaagtctgacaaccagtcgatgcccatgaatcataaggtaatgcattggctcttagcaaaaatgcaatctatagccaacataattcttagttatgtgctccccagaaatgcagaggttatgccttggagattcccatacattatgtagcaaactctaccctcctattgtttcaaaagacatgaatgctatatgatcatgctcaataagaaaagttagtcaaatctctcacagtcttctgttaggacattaacttatccagatatagataaagtatcgaatatttaacaggttgaccatcatgaaggcatagaccgtcctacatttgtagtgttcaaatgaattctcactaaacaacatggaaactggcaacttacgtatctccaaccaaggagtcgttggcagcagctacaatagatatcattcactgtgtgcaatccagtcatgagaaggcgatcctccctgggaccaaggctcacgttcaccctggatgtcatgttcactccggatcaacatgtaaacaagaattggttgagagtggttgttcaaattatcaatttgaatgaccaattatgccttaactaatactgtgatgtaaattgatgcaacattaacaacattgccctaattatcatgtttgtttgttggatcggacaaaaataaacgccagacaaggatacttcatttaaacaaacgaagtacatggtatattgcttgcctatttcagaaaacaacatatggtttacatgttcaactgatttcacaaaacataaccttcgcatgcctttaacatccagtagtaggtcagttacaaagatatgaaaaatagactaagaaaaactatataatagcatgttatactctgataccctattttgtgagcagcaatactggactggattgggtattgtggcatacatagtccaaatagaagcaggaaccaaaatcctattaggattagtacatgaacccttgtcctactaggtttaagataagagccacctttgcaacatatcagattgacatagctacaatgaattaagttctcaactcacaccttgctctgttcatcttcattctttaccaagcatgatgttgttttccatcatgtaatatctaacaagagattgtggctaattaatctccaaactatagctctgtagcttaacactagccatcaacatttcggcatttcctatcagttccatctgtgtctagattgacagaccaaaaaaattaagaacaagacaatttatcatgtggaacataatttgcatagctcttattagcctcttatgccctagccacgcagtactgatcaaatccaacacaaccacatcatgaatctacttccgaacgcttgcaatctagcttaattgcaccaatataagataccgccgttttccctcccatcccaaaacaacaatacgcgagaaatccatcattaaacagcactgttacaagacaattccacaattccccgtccatggacacgctaatcctttccaggacagcgacattgccacgatcgcgtcactgtcatgcatagaaacgcaataatcaaaagagagggggaaatggaaatagtggatggataggccaacttacacgctgtcgaagagataggcccggccatggcggccgcggaactccttggacacgatggcgtccggcgacgccgagtccaccccgcagaacttgcacttgaacaccttcggccccgggagcgactccacgaacagcaaacccatcaatcccccccaagcccgatcgaaccaccaccggaggcaggcacggaaatcttcccacccgatcgaatcagcaagcaagcgctcaagcaagcaaaaagccgtcaaatcccgggaaccccaaatgaggggcgggagaggcggcgattgggcccgatccccatgcgccggccggggagggatcgaccgcgtcggcggcggaattcgggggcggatgattcgatggatttaggtggggggagatggtggattgggaaagcggaggcgacgaggaggacgaagggaatggccctcttcttctctgtcgcgattgcttctgttttcgggctgtttttttcgtctttcgctcgcctctttccgaatttatagggggtgaccgtagatagcttgccttcgtacgcgacggcacttttcttttttctttattttgtcatttcgtcgtcgccggttgttttggggttggttggtggaggtctggaggatcagtgggcaaagccacatgcggaaatcaaaccaaagattgggaattgaatcgatcgataccatcgccgttcggcgatagtcaaatttgaaaatatactgtttatttaatttttttctcaaaaatattcgtgatacaatttttcttaaaaatataacatcgatatcccataaccgttctgtgaaggcgtgacgtcgtggacgatatcgcgcggtgaaaatgtctcgcggaatgtgagactgaacgctctcacgaaatcaaacagatacactgaccaatatctccagtaattaatcactcaattaacaattaactaataataattaatgataaattatcttgatcagtgatttaattaattcgttaattaatggctaattaaatcatcatggcaccagtatcgctccttgcttcagcgataccgaacggtctcttcgcactttcatggcgcgataccgcctgcgacgttattccacgttattttcgcgtaacgcgtatgcgagaccgacggtatatttctgtagaaaattttgtatcccgaatattcctgagaaaaaaaatgaatgaacaatttaattccattcggcaagacgctgcggattttcctggtatattgccggtttagagcaggttttctgatattttttcctaagtcaaaaaaaaaatccaacctagttagtatgggatgtccagatctaggttgaggtttttttactggacagagtaggtaatcatgtactccctctgtttctatattaattgacatttagaaaaagattgatgttaaacttttataactttaaccatcaataactttaaaaatatttagtttaaagaaattagaaaaacatatatagatatgtctttcaaaacactataataaaagtaaacatgcatttatttattgtatatattataatagaaaaataagatcaaaggtatatcttgtaaagcgtgtcattgtccaaagcgtcaattaaaatgaaaccggagagagtactatctacagcccataaaaaacaaacataaaattggatgtgacatatatctagtccaaattcgttgtattaggatatgatacattcaatcctaagtatttttaatggagagagtaacattaatttacaatagattgtacttgtttacactactcccaatacacttggagtatgtcaatccactgctccctccgtcctaaaaaaaggcaaaccctaggtttctgtgtccaactttaactgtccatcttatatgaaatttttttataattcgtattttcattgttgttagatgataacacatgattaatattttatgcgtgacttgtcttttttattttttttataattttttcaaataagatgaacggttaaatgttgggcatggaaaccagggtttgtcttttttttttacggagggagtactctctttctctctcatttattgaagtatgtgtgaaaattacctggcttctcctctttctctcttttcttttctcctccacatcatcatacgaatacgagtttaataataataaggggccggctttgctcttagcataactcaggtacaccaaaacactgatgggtccacctctagagatttcttttcttttctttttcacattcgcgtcctgatcacaccgtgcaatgcacatttttttcctgttcacagcacaggagataaggaacatataaaccatataagtggtgtctataaagatagaaataacatgttcccaaattctactccatccgtcctaaaatataagaaattttgagtttcatgagttacatcctcttatccagattcgtattagatgtatcatatccatccaaaatctctttatatttatatttaggacagagagagtaatacatagtccattaattgctattttctttctataaaccaaaacacccctgcatatgtttcagatccatatgggcaaaaagtaatatatggaagataatggaagaaaaatagtctccatttgtattcggccaaaaagatctagacggatattgcaaattaatttgcttccatttaaaaagaggatattgtttttatgcagtatgcgccaaatcaaattacaaatagttaaatctaggtaaaaataattaacacggtataaaggggagggtcccctttccctcatggagagatcgtcgtcgatgaataccgcctgatctcgccacgttgcttccacagttgaacctgcgctctgttagagcaagtttaatagtatagccaactactacgaaaacgcttataatcggccgtccgatgtgaggcgcatcgtt

SEQ ID NO: 24469 - DNA, 15158 bp, Oryza sativa
cgttttcctttgcgtgacgaacacgttgctctatacggcgaattcgagtgcggtacccggagaagctagaagctgtcgcagcggcttctccaatcgtcgcattcccctctacggctctacccccaccacacactcaccccgcggctgtgtgttgctgcggttccgaccagcggcggcggcggctgtctccattcccagcgttgaggtgagggcttcgtttacccccgttccccattccacccccaccccttaccacccctctcacaccttgctaccccatgctttctccctcaaatccgaaatgatttttgacttttttttttgtgttttgcattggtctactagatgtgaatgtgttctagtaatgacattaattttttttcagaatgtttttaggtataatctatgaggatgcatttatgagattccccctagatgtgaatggattttttttttattattgtctgtgttgcatgtggtctcctagatgtgattgtgctctattagttacattaatttgtcacagaaggataatctatgatgatctattatgagatataattgataatctataatatgagtttgcactgtgattgtttcatatggtggtttttttgttttaccatttttgcactgtgataatctattatgcattttttttattttttcatttttatttgtgtttatgttgtttttttgtgttcccatccatgcatatacaatgttgcagtacacattaatattatgtttcatagtattccctggtttgttttacatagtagtacacacatttttttttgttgcagagcacatgttgtatttttgtctcagactttgtttctgtgtgttttttttcaaggatgcctgattggtgtagtggttccaacttcaagcatagatggggtggtgtgaggtttaagcgcactatgcttcagttggaacccgatcaaaagcaattcatcatagataatgactttgaatcttttctatcgctaagcaatttcaaggtccatagtcgacttgcagaatggattatgcaaaagatgaacccagagatttgtgagtttaggttccgtggcaaggttatcatgtttgataagttgttagtacagaagattactgggctaaatgatggcgatctacctgttaagcttagtggtgccaacagtgaagttgtgaaagagatcaggaccctgtaccatccatattttgtcagcaatagacttggtacaggcatgtgcgagaaattgttgctttctctgcatgatgaagagaagttcttgaggactttcattttgtacctgcttgccaccatcttgtgtcctgccactggcaattatgtgaatctcgactatgtgcattctttggttgatgtccagatgtggagtcagtatgattggtgcacatatgtggcgagctgtttgatgcgggaaatcaagaaatatcatggattctctactaagcaacgagattccatttttcagattggagagtgcctccccttgcttgttgtaagttttttattgtttcaccttgctatatatatttttttattgtttcactgtcatgtgcttgatccaatatttcagcaaaatacatccatttgtctcatttaacgtatatgttttgtttcacacaactgttgtcatatgtttcagtaaataatcagtctagcatgctaattacctatgtatatgtttcagcaaaatatatcaattgtttcatattacacatatgatatgtttcatgcaccgctgccatatgttctagttcatattttttggccaatatgctcctgctaactacctatatcaaatgccttttttttagattgcttacatggatcatttgcaaatgccaacaactggactgcatctccgcatcattgactacagcacaccaagattttgtcatgtcactgatgaggactttgagtatattgttgttgtagaccgttgtaggatgaaccttggctatgtcacatatgggtctcgcccggtatgtttcacaactatgaatgttttagtatatatacattttgtgtttcaccacttactaagactatgtttcatctttttatttcttcagttccgtccacagaatgagatcccatatctagcccaagttcatgttgttgctggtgggtctgaggctgagaatgctagggttgcaagggctgaagatgttccaattggtgctggtcaagatggtgtaggcattggggctggtgttgttgttgacagaaaacacgaggcctgggagatctgtttaactctagtgcaggtccaaagctcgccttcgaatgtatgagcgtgccagttgatttgatcatgtaatgaacaagaaatagaagcaaagaaatcacagttaaatctataaatgatagccgatcggctaggtgccaatgacatatcatttatctttgagccgatgttatatatgcatcgatcggcagtcattaataaataaggaaggactgaatctactcgatcggctgcagatattaccaatatataatctttatatcgatatatacttaaatcaagtgattgagatagatcggtcgccatgccgagacagtataaatcacttagatcgaaatatatattaataatgagactatatacgttcatagcatagccgatcagatagatctagcatgtatcggctaatactccgataccactctatattaagatattaaagcgagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattctaatcacgactcataagatcaaacttaactgatgcagctataaatatgaaaagaaggacaatatctagacaatcaagccgttggatatgtcatagagtggtagatatcctatattatctaagtcaacatcggtatttaacctaatcggctgccttctattgacggatgttagccgattgtaggttggatatcgatattgccaaggattatgtaggatatatgataactcgacgaattacataaacaagattagagtgtcataaaaatggaagcactaatcccgagaacgcaagccgccataacaagttttacctcttgttgaagatcgaaaccgatgcagctcaatccgaaagcaagaactcgtcgaaataaaactaaagcaaaaaagggtggcgatgcgccgagattgtattgaacatgtgtgttaaaagttacatagggctcgggcctatttatacccgaaaattacaagatatgtccataacggacacgactactatctctaacaaactctaagataccataagtctttgcggcagacttttgcccaagcatatctctaaggaaattacctaaaacatcctaattaatatatacaattgccttctcaggactctatccatgtgcggcaatcaccttgaaacacctcaactcaacccgatgtcatacaccaagttgcattgtcggaatcggctgcatcggcttacctagcccgactcagacccagccgatcctaatcgtagccgatctggactccagccgattcctgccctgtttctgaactcgatctccgcctccgactttgcttcgatctaattttctttcccgatgctgatattaccaaatttggttgttaacagttgcccaagatggtgttgctcaagattctgcttcattgaatgaagggatcaggctattgttttagagtcatatatgtatctatacaaagcttcatggaagcctttctttgaagtatacacgggcaggagctgctgatctgcttctgttgtcacgtgccataagcaacatctatgaattgtaccggggaacacctttttaatcgctgctctcattgctttatctcggtctgtcatcactgaacctggcttctgtccattcattgctcgcatccatgttttatagacccatatgaatgtttcagttgtttcatcacaaatcaaagcacatccaagcaatattgtttgcaggtggttattagttccaacaatgggtgcaaatggcatgttgtaacggttagtcattaaggttgtgtcaaagaagacacagtctttatagctttgatacagtttccgtgttctgccatccacccaaaacagcgccttcaacacgttgtcctcatcatatcttgcagcatagaagaaggaggggttatctgcttgagttttttttttttggaaataatcaatagtcattgcaacatctttgagtgaaacttgttgtctcaattttgtcctcaaatttgagacatctttagcagtgaaagttagattcctcacaccaccgtgcaaatctcctaacaacgccaaaatctgcgatgttgcaatgtttcgatcatgcaaagtctttagaaaattcatagtcttcatttgagatatgcctgtgagatctgtaatatctccttcttccaaggcgcttcaccatcggatgcgtgtgttctggttggaaagcaatgactctccacttgttgtctccattttcagatactttacatttcttcgatgctttttccccccgatgatgcctggctgtttctagatgatgcaattcttgttccaaatcctagcttataagcataagcgttgtaaacatttcttgcctcttccactgtatcaaactccattccaatgtatggaacaattggtggggaataaacaacatccttttcttcttcatcattttcagatgcatcttcatccaattgttcatcaatttcaacagtcacagcagccacatctgtgttgtcaacactttccacatctacaacctagtacacaaaaaagtttcactaagttacatactgtgttttcaaaacaaaatatttcccccctacatttgcaatgtttcaaatccaaggacaactcaccaagtcagtttcatgcccagtggattcggataatagcacatcaaggaagccaccagatgagcttggtgcttggacatcgatctgtaacattttgttttgtttcattagtttgtacagttatgtttcagcaagttaaggattattgttcaagtcaaattccagtccaaatttatacaaaagttaaaattaaaaataagacatgaatataaatgttgcatgagggaagacattgtttcacagatctatgcttcaattttttattgaaactttgtcaaaaaaaaaagtaaaacaagcaaaaccctagaaattttttactcaccaaattcattgcattatgaattggggttgttcctccatttgcactagatgagctcggcggaaaatccctctcaacttggtgtatcagatgagccatggcggcggtggcggcatgtggtgtggcggcatgtcggcgttgttgtaggcttcgtcggcgtcgcgaggaggataggggcgtgggggatagggtcgccggcgccggagagaatcgccggtggcagcacagcgccagtcgcgccaccgaaatctcccctcgagctagcggtcaacgggcagacacattgaatgaaacagttaatgtgtccaggtgttgcaacggcgggggcgtcgggcgcgagttgtttctccaatcggacggctggcgcgcgcgtgctgcatcggacggtcgcgcgaggcgtccgatttttcgtctcgcgccgtacgtccgacgcgtagcgctctcacaactactagctccaaatcatctatagccaatgtaatagccaattcatacaatagttgcttactacattattaatgcatggtcccacctgtcatacacacattgtgtcttggagttcatgctgcagctggctacagatatgtagcccgttgctcttctctcttttttttatctctttaaaatgtgtttatagctgacttatagtctgctattgtacccagtcttagcgtccccgacttcaccgtgtcgctgccaccaccagaccgcgcccaattaccgtcccccacctcaccacgtctaaatctgcttgcaccatcgttagacttgtgcctcatcgtcgtccccgccaccacatgcaggcaatggtatgtgctgccatcgctgctttaatagggttagggttgcataatataaagcacaactactttttttgatgtttcataatataagacatatatgcatgcatacaattaattagaacctcttctctattaaattattacttttttaaatcctccaccctcaagatctctaattctattggatgcatgcattatatttattatgatgattcaaactagtagatgataataattgtttcttagtctttgggttaaggttggttgtgccttatattttggaacatagggagtataaggaagtgaggtagagtgttttggtacttcgaatatgcggaagttaaaaaacgcttcaacatgcgtaccacacgtactacgtgttataattcatttttgaaagtgttccaatgacacgattaaaattacaaattataatggtattttgaaaataaataatcaatttataatggcacgatcaaattagtccttaactaaaaagaacacattagacacacccggaagaacaacagccaaacacacagacccatcaagtcatcagccccttggccattggttgctacggaagacgatatgtatggccaagcaacaaggggagtaacaatttccaaacgacaatttggacaaatcgtgagcgctagcgtcggcctttttttttttttcaatctcatctcgttgaccgtggattatcaacttaattataaacataacttaaatgtgtagatgttttggtaaatcaactttataaaatagcttaaaataagcagtttgaataatacaattttttttagaaaaatgcaatttttgaactatggagcaattaatacagtgaataatctaatgcctatttgatttagattattgaacatttattgttacggattatctactggttatatgggtagattaaatattttaagaaatgaaccaagttgtataggaaatgtaatataatggaattttttagaagctgtattttctaaataaaaccattgagcaaataattcggtgaataacattaaaaaaagcatggacttgtaggtttgagcaaccaaaaagaattccgctttcgcaagcttggatgatcgaggtggattttctcaacccgatactcataaactaggactttttggagcaaaatgtctcgtgacaagagagtttcaccattcatggaggaggcaacaaagccaacaagtacttgaacacatgggggctcggtttaaatagcctccgcaccagtacacactgcacaattcgttggactgtatctaatgaccaagcaacaacttgcaggcggatctacatcgtttctgggtgtaataactcgtcaaattttctgtggcatggttaattagtgcacaaaagattcggtacaagacttgattttattcctcccgtgttttcaaatagtatttcatccatcctaaaacataaacattttcttttaaaaaaaagcatgctataaactattagaggacgatacttagtagtctcaaatgcatgcggtaaatatgcgatccaagatgtttccacccaatcgataaccatactatttagtatagtactaaaatcgttccagttttattgtactcgtaacaattatctttttaaagttagatacatgtattagttacggttgattaaaaagaaaaagtatgtgaaaaaaaataaatggagattaaaataagaatagttataataggttgagatgagagagtggatggataaatatctttacttgtgaaacaaaacataagcggtataggtagctttattttaaactagccacataagccacgtgttgcgtggctcttaagacccgtttaaaagatgtgtatatataggtcaggccaacggtgccctgccgttgagatcttcttgatgggaaaaattttgaaagtttgctcaagaaaaaacaaacgtcatatattatgacaatagagtattattgtatgataaaggaatactaacttgtttctccatctattctaaaatatataaggcatttttattttgagaaaaatcaaaacataaaaacttgtctaatgaatggattaaaagtacaggattggatatgtgattaatgttatgactttttatttgatttttatatcattatataataaagtagtattgttagatttttatttagctatttttatatggcatcgattctgtaggtattgataataaacaaaagaaaacagtagtagttaaagtataatattgaaaagattgtttgagaagataattatatctatatgtatctcaatacattttaaaataaagggagtaatttttacatatgcatacctggtaaaaaaattagtacaaatacatattagtaatacagatgttccaaaataagttcattgttcactcatcctacacataccaatacaaacatcaaaagactaaaatatcattactttatctcatcttaatataactatttatcactttatctacttccaatgcaattattctttactattataaactttgatataattattactaaaaatcaatttattttgagataaatgggatgagctaaaaataatcttaatatacgacagaggaagtacttaataaaaatgcttaaaagaagacttgctacactgttacatatgcatattaacacacataatgtaagtagcctatttgtctgcttaaccaaccgatcactgatcacatacggaaataaatggaggaggtactacagtatttctcgcctccgaaacaacatgttagtagaaaataggaacccgtcagctctgtaccatcttccaacggctcgtctgcttgtagaccagcctgcagatcaattcctacggaacaattgaatgggctgggcacggtcgggagggatgtgggccatgtgctgttaggcaacaacgggtatggcccaatgcaagtacacgagtgaaccttgaggttgtatggtccaatacgataagtggctgatggcccaagacttttgtagattcctcgaagtttttcttcgatttttccctgccagatcattctctctctctctctctctctctctctctctctcaggcgtgttcttagctcattcactgtgcaagtttcatttgagttttaatctcggtaaatgagatgccatatagactaaactgatgacatgccatgaattttattaaaagagataaagaatgaacatataaacaaaacttggtttatacagttacctatgcttgaagaccgaataaaacccaattgggactgaattattttatcctatgccttaaaagatggaaatgaaaccccactgtgaccaaatagtttcataacaccattcaataattaaattatatgaatataaaatcacgaaaatgaaattatgcatttgagacatttgtttcatatttttagattatgtagcactataggaaaccacaagatgaaactcccactgaaaatggacatagtcagatttaatttacattgctgccaaataaggccatgtctgtttccgcttaaaattattgtaatctatattattgagctagattactataagctagattataataaaccgatatagaataagttgttaactgtttgtttctctgaattattagttgtttgttagttgttagccacccaataatctaaaaaagcacctttagagtggattatcagattatagaaatcgtgcttatagattataataatctatcataataagctatttgtttgtttcaatttacttctaacaatccagattataataatcataaactgaatcaaacaggacctaaatctcttcaaatgacacgacatctttacaaatgagagacgtctaaaattgttcaattgcatggaaggcacatacacatatcccactatagatataaatcacgcccctctaaaaaatggaagccatatatactatttcttttattcttacactaaactatggtcgtaattttaaaatatgaataaaatcttatcataaatgacaaaatatctatgacagggagtattaggcaccagcattcaaatatttcccttctatatgacgaaacaaatttaaccgcatgtagaaagtaaaaaacattcgcaatatggcctcttgcattcaatttagattcaccactcctcaggttctcattcaatttcaaggagatcatggggtactctgacaggcatcccacgccgaattaaaaacccaccacatttatcttgtttcaccatatttcccagccacacccaccaccccctacacaaacaacgcaaacacctcactgacagctgggaccaccaccacgtgggggcccacactccagtgacgcatgaagccaaaccactcggtgccccgaaaccgccaggcaccgcagccagcccgggtcgctgtcgtcactccctgcccccggatcccaccaccggtttcgtgccccggttgctcacatcacaccacgcttgcttcgcttccccttgttccaactcgcgtactacccctcccacccccgtaattacgctcacattgcaggggtggaagagtaatttcaggggccgcaattaattaagtcaacacgaaccgcagcctcccagcccacgctaccttggctacaggacgaccccactttccccaaactgcccctcccctccccaccccgcaccatcgcctccaaaaccaccaccacctcaccctccttcctcttcactctcacgagacagcttcccacgcagcgcagcgcaaccgcagcaatggccgattcgccaaaccctagctccggtgaccaccccgcgggcgtcggcgggtcgccggagaagcagcccccggtggatcggcgcgtcgcggcgctcgccgcgggcgcggcgggcgcgggggcgaggtacaaggcgatgtcccccgcgcggctgccgatctcgcgggagccctgcctcaccatccccgcgggcttcagcccctcggctctcctcgagtcccccgtcctcctcaccaacttcaaggtgagctgtgtacctccgccgcgcgtgtagcgtagctatcacccacccatcttctcgcgcctagttactgcgggatctacgaatttcttcggcgcccgcatcgtgccgggggattaatctgtgtcgggggggaaaggagggattccgatgcgcgcattagctttatgcttctagtttatgagacatttgcaccgcggaattggctcgtggcgtcggaataatgcgcttttgctgcgcgctttcgcatttctggtggtgccttgcggtttctggaactgacttttggcggggttcgcgcggatatagttgtttttgctctgtttctccttttggggcgcccctgcgccgtcaattttctgtggagtgaggtgggagctgttgtttgtgcgtttcgggggaattattctgtgctgcacacacttggtggctcgggggaacaaatcatcatgtggcatttttcttgttgcggcctcaaagggccttacataaggaaacgcccccttggctttggctgctattgtgctggtggtgtgcatgctaaggaatgctgctgtttcgtaagggaagcaccaagcactgcaagagagttagtttataggcttggtttagaaatgattgcttcactgatatcgagtgctgggtctggccttaggtgttgtattggcggttctgattcttctcggtgaaaacccacaaattggaatttacttgctgagcatagagtgcttgtttgcagcttcatatcacttgctttctcttggttccttcgttactttgccgaccttcttgatgtttccttttccaaaacatagggatgcttggcaaacaggttttaattaaatgaagaatttatgaaggtaacatttagttgacaagtgtttctggataatttttcatactagaggcataagtattgtactaagcatgacataaatactttctgcaagttactgttcaacatgtacactgtaatactgttgcgcattgttgaatgttcaaaaaattatagagattatgcttaccttgcttgcaaactaattatcaaaatttccctgtttaggttgaaccctctccgacaactggtactctgagcatggctgcaattatgaacaagagtgcaaatccagacatacttccttcgcctagggataaaacatctggtagcacccatgaagatggtggctctcgagattttgaattcaagcctcatctgaattcatcctctcaatcgacggtatggatcctttctttgagtgattacctggtatcgtgtaattcttcatttgtgtatactgtatttgagagtttgaaaaaatttccatagaaaataataacatttgttgtttacaaatggtcccgccaaaacagtggaatttatattggggatgtacataaaaggagtgtaaagttctaatgtgcttatgctaacttcctttccatgatctaaagttgttaccttacggtatgctatttattggatctatattgcattttacttggtaaatctatctgaggttccagcttttgatatttaagttttcctatgtttaattcaaaatattctcacgtgaatcgcaaacctcaccaggagtacaataaattcgttttattattattgtaggctgtgttatttctagtccatggttcggtgtcttgaaatttcagtgccaaaattgggatggatctggttacatcttcaagtctaataaatgatcacaccgactttattgtgtgatttgattatagcagggtcttgcaacataaatacaagctattaattgtgaaaggagaaatgagatctttggtgagatcatgagaatagggtataacagacacaatatttccttgctaggtgagacttgagtggtgctagtctggctgcaaatttatagaagtatgtgaaaatttgaggtcagaatacaagtaattgaatggaccaatctaatgagttctgtagctttagaataattaatgttaacataaaaatatgttcatgaaatcaggtccttctgcattttgttgttaaccgaattccacattcttctttagttctcacaagtacagacaagtatcttgtaatggtggattcttttttggaaaacaaacttcattacatattttgtgtgatccatctatgccttgtgcccttgttacctttttttccctacaccttgttttctcttgtacttagttttgcattgtataaccttttgctgtactcgtgtcttgtactgtaggcttctgctatcaatgatcccaaaaagcatgaaacttctatgaaaaatgaaagcctgaatactgccctgtcatctgacgatatgatgatcgacaatatacctctatgttctcgtgagtcaactctcgcagtcaatatttcaagtgccccgagccaactggttggaatggttggtttaactgacagctcacctgctgaagttggtacatctgagttgcatcagatgaatagctctggaaatgctatgcaggagtcacagcctgaaagtgtggctgaaaagtctgcagaggatggttataactggcgcaaatatgggcaaaagcatgttaagggaagtgagaacccgagaagctattacaagtgcacacatcctaactgtgatgtaaaaaagctattggagcgttcgcttgatggtcagattactgaagtggtttataaagggcgtcacaatcaccctaagccccaacccaataggaggctgtctgccggtgcagttcctccaatccagggtgaagaaagatatgatggtgtggcaactactgatggtgagggttttatcctttgttttaaaaactgatgctggatccctctggtttggcagcttgacctcctgcttcttggatctgattcccccccttttttttgtgaattctcttgctatttatgtcatctctgaacttcttattgcttctcaagaatttcttgcagaattatgattcatattcctttagattcttaaaaaaatgaatgatttgacatataaaacagcgaatgaacgtatagcgtggtggtagagcctccaatagtggggacgccgagtcaccgacctaagctcgaacccaggttttgcaccaaaaaactcccctgcatgaggttgagtgcagcctggctgtgcactgcgtttgggtggttttttttctcaacttagttgaattccacgggccattttaacctgccaatcatttttttttgtaacatacaaaacaaaatttgataagagttttctgagctgtatttgcactccagtacatcactgctggtatatttttgccagtccatacaccgaaggaaaagtcgtgtgatatggatgaatgtttttgttgtgttcttttatgcgatttttaaatgttatgtttttatatgcagacaaatcttcaaatgttcttagcattcttggtaatgcagtacatacagctggtatgattgagcctgttccaggctcagctagtgatgatgacaatgatgccggaggagggagaccttaccctggagatgatgctgttgaggatgatgatttagagtcaaaacgaaggtgcagttcatttgaacttgttacacactagggcgagaatcacccatttatactactgaatgtgttgtttacaactgttcaaacaggaaaatggaatctgctgctattgatgctgctttgatgggcaagcctaaccgtgagcctcgtgttgtagtacaaacggttagtgaggttgacatcttggatgatgggtaccgctggcgcaagtatggccagaaagtagttaaaggaaaccccaatccacggttagttgttattttcttcatctattgctcctagtaaattctcctctttttttctctgacatgtcaacagatttttaacagtaacaacaaaatgttcaataatcttctggtcatgttattttaaatcagaaagataagatttttttgccttatacatatttgtaaaacatgtgtgtcggattgtccggtgatactgctggggagtaaggctgtaggggcttaatgctaagactgggatgcccggcatcactta

SEQ ID NO: 24470 - DNA, 8799 bp, Oryza sativa
  unsure (1)..(8799): unsure at all n locations
cggctccctccacaacgagcacatcatcgggctacacaaaggtatgctcgaccggacggcgggcgtgctcaacttcatcacgaaggtatgcacttctggcagcctccgagagtacagcgaccgccaccgctacgtctctgtcaaggcgctcaagaagtgggcgcgccagatcctcttcgaactcgaccacttccacaccctcgacccctgcatcatccactgcgacctcaactgcagcaacgtcttcatcaacggcaacaccggccaggttcccccccacccctcattactgcatccagtttcttcccagattagcagatttgacaagctcacctatcccaaaaatttagggctagaattaattacaatcaaaatcatgataacgttcgatctgctagactatattaggagcaaagcaatagcttaattaggcctttgaactgccatttttctttttcaaaatgaaatgtttgaaaactgaaatggtattcaaattttgaattggtagacggtggttggagggagtataatttattggctgttgaaatgtacaccgaccggggcatcacggcattcgggggattagcgggtggctttgccctttccgcctcttttccgtgatgacctgtagtagtagtagctctcggtgtgtgcatgagctgcacctttcgaataaaggaagggaacacaagtgagatgcacgctgatgcgctctttaatttcacactagttttcccaccccttcaaatcgatcaaatcgcgtgggcgtcgcgcaattttcgcacgccatgcttgctttcgcttgtcgctgtctcgcgaatcgagtttggattggtcgtgtggctgacgacgacgacggctcgatcggcctggatcggtcgatggatggatgcaggtcaagatcggggacctcgggctggcggcgatcgtggacaagacccacgtggcgcacacgatcctgggcacgccggagttcatggcgccggagctgtacacggagacgtacacggagtcggtggacatctactcgtacgggatgtgcgtgctggagatggtgacgcgggagatgccctacgccgagtgcgacagcgtcgtgcagatctaccacagcgtcacccggggcgtcccccccgccgcgctcaagcgcatcagggaccccgagctccgcgccttcatcgagcgctgcatcggccagccccggaaccggccctccgccgccgagctcctccgcgaccccttcttcgccggcatcgacgacgacgatagcaccggcacgctcggctagcctgttaaccagctgggtagtactagaaattattgtatgtgaattcgattggaaacaaataaacgttctaaacgaattaagctccagcgagtagcaaatgtttataggttcatgtctcaccggcgctcgagctgtagcctgtagctttggatgtggttaattagtggctagtactgtagtatttattgtactgtttgttctttggtttgtactgatttgattcatgagcttcaaagaaatggaagatgaggagctgtatttggctttggctttgcgtgtcaaatgtgtcacaatcctttcaaaggatggttgtaaattaaaggtgtgagatttccatgagctggatgctggagtttatagttcaatactaaaatcagatggatgtagacgtgagacccaatcaatatctgagatatctcgggcccttttcctcttttgcgctgctctttttttgcttcaagcctcaggaaacacgacggggtacgtagcgtccgttgcaaacaggctgtccgacaacctgtacagagaggagacggctggcaaacggatagctcaattcagttgaaggaaagcattttccaccaaaaagcgcatacatgtcttctgcagttctgcttgtgtggagtagtggtagagcttgcggttatcatgttgccgttggacatcggatacagtggcaatgccattgccgtatccatgcacattccacaaattttggtgctcttggtcaagttcgttaggtgatggggtgttgtgtgtggggcatcgcatctgctgaagaatcattcgaactcagcctgttcgcacctatggattctgaaggacttatcctgctgtatctttgtttatcctcaattttctggatgtcagcttgttcgcacctaggagtatgtgttttccagtatctttggtcaattgtaggcattctaaaggcagatataaatgatttttacgggctcgattgggaggcctaaaatcctaatccgatccatccacaagggttcaagctcccagactcccagtccaaccacagggatgaacacgggggttctgggcttcccaaataggcctcctacatcttagggtagggtgccttgggttgtcatggatacatggaacatttcaagattatacacaactttttttatgagttgtatctataaggaaatttggttgatatagactaaggaggggcataatcttaagggaactaaagtcctttaccttacttgggtagttggactaaccaagacagtattattgacgctaggtgtactcatacaagtgcattttaatggcaaggaaactaatgacataaaatccttgactggattgataattgacttgggtagatgtcctcaaaggttttacaaaaaggaaaaaaaagttcaaaccccataaactattgcaacagtttgaattatcccgccttccccttccccaccaatcaaaccaaagaaccataaattatgaaccctaaactctttaatctggtcaaattaccccctaacacaacccagagcattttgatccctacatgacacacatatgacaataatttgcctgatgtggtattccagtcagcaactagattaaaaaagatctagtggcccacatgtcagtcaatgtctatttcttctctttccctttctctctctctaaccttctctttctctctcacaaaaagcctatggaagtagacttggaggtaggggcttgttgcattgacagtgtacttgaaactcgaaggaagcctcaccatgacaccggtgacctagaacgtagaggcctacggtgacgagatatgcctcctctccctctgttgtggccagatcccctaggtgaccaccaccattgcaacttgtgtcaatatcgataccttcagcgccacgccactgaccttctctcttcgtcttcctccttctccaaccttgtcaccaattttcaatagctcgcccaatgacggcatcgacctcaacaggagagctcaccatcgttgtctcctgctcaccacataccaagctccgccctgacgatatccgcctcaaccagaccaccacccacttctcgacctctagcacgtgcttagcgaaggcaagatctgcctccccgagctagcttgagttcctatatcgtcacctccacaagcttttgcagtggtggaggtggcttcacattcggacgcagctttacattctacaatgtcggtggtaagcttttgcacgggttagtgtgtgcttcgagaagagcatgggatctgcaccaggcggcacctacctacgttgcagaggcaactgcttccacacacacaaaggagatagatgacatgtgggttccttgatttttttttcttattggattgtcgcgtgttttatctcgggtcgaccgaccaatttgtctagtgtcaaaagttgaagggtgtgaaatgtatggcttcgcagttcgcgggtaatccaaactatcacaatagttgactgggtaagttggactttttccttataaaataagttgcattttgtgttgtatgtgtgcatgtgcgtcttccatataattgtgaaaaaagataaattacatgagaagtgcatgttttgcgaagatttctagttatgagagagctcattcaatcagtgcgagaaatacataaggtaattgactatatattgtattactgaagaataaaataaaacattcctttttctgaagggctataagagccgtcccaatacatacaacacaaaataggttgtatctaatccatgtaatctaagacaccattaaagaagttgttcgcctagtgcatagttgaacctatctaatcaattttattacccaatcccaattaatcacctaatgtctagacacattggaaacatgtctcaatactataaatttttgttggagtctccaggtgttcgacacggtcatatgcctcttctgctggatgatctggaaagaaaggagcacaagagtctttgaagccttcacccactagttactgtaggtcgcagattgcacaattgatgagcggaggacatggaagatggctggactaggtgcctagcatagcacaacagattggtaacctgaagtgtagcattgtgccgacgagcccaggtcatcaggcactttgccttggttttatgacagggctcgcttcgcatctcagtctcacgcccgatatgcttcatcctctgtgttttggctgagcatttacaaagtctataaatttttaccccctccctccttaatacaagttcggtcggcattctttgtcagcccagcgaaaaaatagttttgttggagtctttgtggttgtatttcgtaccattacttgttcttgcatctctttgtactaattgtagtgcaaattttatagtacttggcatgctatttaatgctatgaactctcaagtgaggtgaaatgttaactgaacaagtaataaatatcgattgttgtttgtccaagcgttttgctcttttgccattataaattttgattttttttacgaattttactatgaatttatggaacaacagagagagaaaaatgaaaaagtagttcaattataagcatacatgtcctactgtgaaactttattttcatccaagcacctggcggccccatcggttggctttttttctaataagccaaaacggtttattagggaataaaaataaatttgtaggtaaaacttttatatatgtgttctttgtaatttaaaagccaatgctgaaaaaaaatacgttgaaaatatcttaaaatcaatcttaaaattaagtttgaaaattcaaaatttagcttattctttggcttattgggccatccgatgagagcctgggaatggtataaacatagaattctatcactataaacatatacaatgaaacgacgaaaacagtgggcgaaacctttcgccagatcaatctagagtaaccctttcttttttttaactttaacctctgaccctctgagattgacagttcgatacgtaacgtttgccaattggagagagttcgtccattcctctcttgcattgtttctctccgtttcaacgacgcccttgggtgctttaatgcgatcaaaaatcaaaatgtgagtcacgggcgtgagaagccttgcagacccggcgtctccttctccgttgagctgaaacccaagcacgatcgagtcgccagtaaaaatttctcaccaccgatctcgatgcagtcacgagccacgaaaagaattcgggagatttcaagttttcaacgcatcaatgagaataagaattgtgggggattggcttcccgataccccccaaattccagagcaaaatattactggcatttgacgcccttaaattccccaccttctgcagcgtccgatgcacgtcaacgatttgattattaccgacattctcctttatcaatggcaatcttgccattgcagaacttagattcagaaatgcgctgaccatgccggtagtgtgatcgcacataaattacagcactaatcagctaagcaatcacacgaatgctatattctcttattttttaggttcctttttttttaatctgatagctacttctgaacgtcaggagaatacaaaggtgtcaatttgtcatggcaacgcaattgtcaggactcaggagaaacaaggttttctggcgaccacactgccattgcttgctaccgaagcttaaagaaaccatttcacagttccgagtccgaatgggagtctctggcgtgcatgcctggtgaatgatgaaacgcccgttgaaatgaactgacagtgaccttgattaatagtttgataatactatacttcctactatgatattcagagctccgtccgttcgtcaatgtgcacgcttgttttcttttaatctaaaagttgtgtggaagagcatctatctgcccaacttatgctaccggatagtgtacgatttggtcattataagtttctctgaaaaagaagcccatctagagagattagcagaggacagatagtctaatcataggagatgcttagtctcgtggcagttattatatggagattgttacctccaagcaactctttcagtccttcgctttggcgatgctagattgctaaccttggacgttttacgcctaggagtagcacacaacaatgaccggctgttctgcctgttcagagctctgaaagcttggtatgaccccaggcgcaaaaggatccagttttctgccatttggtgagaaatttggacaccccaatcagacgtcaactgtacactggaaacaccacactaattacttacaaaaccgagaatatatacacacatcttttcacacattagacattcacaccaaatggaaagtgtggcctccatttgtgacacatgaaatttttctcgatttctccgataatcgaactgattcatatgaaaatactgtatttttttccagaacacgtgcatataccaaaggccagatggtgcctgaagaggccataagccattccggccattagaggcaggttagctcgagcttaatttgcttaaactagtgctggctccctcggatctttacaaggctgcctccctgtgccctgtggtggcgaggagagagcagtgcagtgcagaggagaacgcacgcgcgcccagggaataaggaaacttgcacgagggggtggagggcgatccgatttcccagccttaaaactggggttcaactccaacgtcccccattcgtgcgccctcagccattgtaccccttttccactcctcccgatgttccttcctccctcactccaccactccggttttatactcctcctatctctctagtctctagtctctactggtactagtactggtaatctgagagggatggagccggagatggaggtggaggtggaggtgaatatgtctccgtcggcggagaaggccgccgtgtttagcccttactcgagcccgagcagggcgatgctcctccagaggagggtcgtttcatggtacagagtgttagagcttggaattttggagcccttgggggttctgatggttgggttggttgttgatctggattggattggattgcagggccaaggagaccggttcgccggcgacggtgagcgtccacgtcggcgacaggagcttcaacctgcacaaggttaggagagattgtgtgaagattaattagggattcttggttgggatgaggaggaagaagatggtgatgagtgtgtgtgatcttgtcgttgcaggatcctctggtgtccaggtgcgggtacttgaggcaggcgattctccggtgcggcgacggcgacggcgaggtcgtcgagctgccggcgagcttccccggcggcagcgaggcgttcgaggtgatcgggctgtactgctacggcgacgcggtggcgctcgacccgttcaacgtggcggcggtgcggtgcgcggcggagttcctcgacgtgtccggcctctgcgcgcgctgcgacctgtacatcaaccaagtggtgctgcaaagctgggacgacgccctcatcgtcctgcagcgatgccagccgctgctccccgtcgccgaggagctcctggtcgtcagccgctgcgtcgagtcgctggcgttcatggcgtgcatggagatcctcgaccccgaccgcgacgagcagcggcgcgagcgcgaccaggggggccctctcgccgccgacggggcgcgcggcctcgccgggcgccggtgggacgccgagctcgtcaaggagctcgccgcgcgcgacctctggatcaaggacctcgtcgccctccccttcgagttcttcaggcggatcgtgctggcgctgcggcgtcagggcatgaaggagaagtacgtcagccccgtcgtgctcttctacgccaacaagtgggtgctctccaagaagacgcacaagttcatggcgagcacggacaccggcgacggcgagaccgacgccaacaggagggccaccgcgatcctgcagggcgtgatcgacctcctcccactcgagtcgtcggcggcgaccggcggcgccatcccggtgtcgttctacttcgcgctgctggcgcggtcgatcaccctcgagctcagcgacgagagccagacgaggctgcgcgaactggtcgcgtccaacctgcaattcgcccgcgtggacgacctcccgctgccggagccagagcaagacgccggcggccaatccatcgccggcagcccggaagtgagggcgatggagagcatcgtcgcgagccatgtcttaatgcaaagaagaggcgcggaggccgtcgcggagctctgggatcggtacatcgtccagatcgtcggtgacccgaagctccagccggaccggctggccgagctcatcggcgtctttccggcccgcgaccggaatttccacgaccatctttacgaagcaatcgacacatacattgtggttaagacgatcgatcagagcactcgggcgtgcacgagattattgagtacgttaagctgtcgcgctaaaggtgtgaacctgtttgattctggcatcgcaggagcatcccggcttggn

SEQ ID NO: 24471 - DNA, 3776 bp, Oryza sativa
  unsure (1)..(3776): unsure at all n locations
gcgctgcatccgtnatgatgtacnnnnnnnnnnnnnnnnnnnnnnnnnnnnnnnnnnnnctctccctgaagcagacgctgcagcggcacaacaccgtgaagaagagctcgtcccggaaggaggcgagcttcaggatggacacggcggccacgccggcggcggcggcggcggtcaggcggcgagcgccggtgtcctccagcagctgcattggctccatgcggtggggatcgcagcggcggtgcgcgagtaggatcctgcgcatcttcgcgaggctggccgtgttcgggagagggagcaggtcgtcgtcgtcgtcgtcgacgtcgagggggaagcagagcaagtgcagggcaagtgcagagcagctcagctcagtggcctgtagaacgaagcacgcagcgagggactgagcgagaggtaaaaaaatgacgagacatttttactacacacgtggaaaagaaattgcagatcatactgtaaaccctgctatgtttacaaaaccgtacggttactgggttatcacgtgaccatgtggttttcacgataaccacgtggttaccatggtaaccgtcaaactgcgggtgacggtaacccataccaaaggtttgatgaactgtgaaccttggctacgagtagtagtgtggtagtagtatgtgagcagggtactatgtagtctgtacatattgctgttgctggcaatgctgaagaattgaagagtagtttgtagttactgtcaggtggcctggtcagcactttttcttaggtcgaaaattctgaatatctgtatagttcatcggtattaaaaaggtttattttccttcaaaaaagttgtttctgatgggagggaactaattcgaaaaaaaaacaaaggaatgcaagtgtaaaaaaagttgactgaaacattgaaaaaagaaggagatgtccgcccaaatgattatttagaaaaacatgaatatggggcttgttcattttgctaccattttcaaccttatcaagttttggcattgccaaattttggtaaggttgtcaaattttagcaagatttcatatgtacttattaaaatttagcaacaaattaaatgtagctattattttaggtaactttaccaagaaaaaaaataagattgtaaatagtagcaaagtgaacaagcccgcccgtgatcctacgtggaagtgacgagaaacgccgtctccgatgataccatcagaagtggcgaagaccatagaagttagccatgtaagattgccctaattctttgtaatggacctcttacaatattgggcccaaaagggtggcctgctaagaactcattaggcaaaagactaggaaaatacaaaaatcttcttgtatatgtccctttcaaacgatagagatgtaccacttgtatatcgaacccataaaacagagatttatcacacattatggtattggagtttctctctccttatcccaaaggtactgttgtcctaaacaataataagaatgtttgatatgttaaaaatatgtactggaagtaaaaatacattgcgtggttaaaatattttggttttgtttttttttcatttcacaatggttagatggttagaagttgctttcagaattttgcacatatttgagagggtgtagtttacaacaaaaatttgcaacggatgctgtccctctcaagaaaagcccagcgttgaattttcctagcattgctgatgctgaatacgtggtctcaatccgaagaaaaagatggataggcgcagacgtggaattcagcaaacctactattatgccggcgagctataatagttggcaggttagatttgtattttaatagattactagtaatatgtccgtgctaaacgttacggtgcaattctatttgtctttaataattattaaaatttcatgttagcggaaatttttttatatgatatgtgtatttgaactttaattcaattcatgtcgtacattaaatatacttatttaacgtaaaataaaataatatgatattgcatgggcacaataaatctttacaagaattaagtttatataatcacttcagtatataatacgctattatgttaaaaaagtaagttattttattatttgttgcgggaacaaaataaagcattatttgcgatctggaggaggtgcgggagagaggctgcagtggttggcgatttgacggaggggaaaggaaaccgagcggtgatcccgcgtgcgtgattatttgtgatccctaatacattgcaggggaaatctgttctgggctgcctactcaaaggcagaatttttccaagccaatctcattgtcatccaaagtactactgccaatgaactgacaaaagaattgatgaaccaaagcagtgacatacttctagacaaacaacttaggcgaactgagagagctcccatggttatagcatatggaaactgatcctacaataaataaaataatttacattgtaatataagaaaccaacttttctgctacttgaggtttagaaactgaccttgaaaccacggttctggtttgatccacctgaacatctcacggttatccataagtacaaggcaaatatgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtagtcctacacttccagttgtaagaaggattcaaactaaagaaaaaccacccttccatttgtattcatgctttaaaattgtaaaattttatcttatattcttttctttttaccaatgctttcatacagtttggggatagacggtggagatgagacgaacatgggttgggagacgccgcagcaatgtggtggtggcggtgcgtgtggcagcgccggtgggtagtggccacggaggagatcggcgtggtgtcactggtgttgtcctcgacggtcggtggcggcacggagatgtcgagggtgggcttcggcggcgccggtgtggccccccgaggtggaggttgccggatgttgtatcaataatccctaatcctatacagcaaaataagaaaatcatgaggaagattacggtggtgcaatgtttcatgaagcttattgcactttgcttaaaaatgaaccatcttggtacagaattagtcaaaagcttactgaagtcataagttcatcttgaccaaatctgtcaagaatccagaaacaattggattgtcctaacatatgcatggtgatggtgatttcattaatcaaggaatgaatctctactatactgataattgacatagatggtgcatcatcttaaatattctgtcattgccagtgaaaatcgaattttaaggtttgacttctgaaatgtgtaaatcttaaataaccagatactattgttctttggagatgtttagacatgtgcagacagttatgcgttgttcatagacatagatactttgttnnnnnnnnnnnnnnnnnnnnnnnnnnnnnnnnnnnnnnnnnnnnnnnnnnnnnnnnnnngatagtcgacgtcatgcgg

SEQ ID NO: 24472 - DNA, 719 bp, Oryza sativa
  unsure (1)..(719): unsure at all n locations
acgatacgcagtctannnnnnnnnnnnnnnnnnnnnnnnnnnnnnnnnnnnnnnnnnnnnnnnnnnnnnnnnnnnntttatgcgaaaacttttatatagaaatcgttttaaaatatcaaataaatgtatttttaaaaagtttgtaataattaaaatccgattaatcatgcactaattgtgttttggtgtatctggaatatttgtccttcaacagacactagaaagttacggcacctcacaaaagggaaaatggagttagaaaaggaaaaggttagatgagtattcaaatagtctgaagttcaaaaccaagactttccataatacttttacagaaacaatgacaaatgttactgaagcggaaacatgacactcaataaacagtaagctggcatcccatttcccatccaaggaagcaagaaatgtaagaaattggaatttataagccccagctagccagctttaaagtctcaaacaggtaaataatcagtgcaggtaatcagagaagcagggatataactcaaaactatgttgaacagagcccgagagaatgcatgacaatgttgagtacacaatggcaatgtttttttctttctctggatgacttgccacataagaatttttcggcagtacatgcaacagttttgcagcctacaacagtaagaatgcttgacatccatccttaaacagtaaacactatcatatcgacctctgaatcttgg

SEQ ID NO: 24473 - DNA, 2585 bp, Oryza sativa
cctcctttttcgcagtgtgacggggaaggctagttaattaaatatggcgccgcctcaatttttataattcaacgtcgccgctaaaaagagaaaaaatcaaaaccttttggttccaagggctccgtttaaaagaaccaaagcttgcgcctgctttatttttagattctgtatgttcaaaaagcagtttgggggagaaaaaccgaacattgagggtttacagaattggaaggggccaaaaaaaaaggaaccccaaattattatgaaattagctgcaattaaagacccccctgcacccatattggatccgccccgggcagacacaacacactgtgtgttgactgcacaagagtgaaattaagtagatcagcgccaatacaaatgtatatatgtatagaaacataatctaggataattgtgtccagtgcaaaattgcatgtatcaaattcaaaaaaaaagaatatctcggtgtaaaaatagatgggaaaattccgctagtaatgtactgtgggataatattaaccagaacaaaatgcctcgagaagctttgactgggctgttccaaggaaaaaaaaatctcaaacacgtgttttctagtacagttacatgagagcgacaaatactaaatactagtattcactatcttcggaagcctccatatctcctttaggttctaggtcctatgtcatactccctccgtttcaaaatatttgacaccgttaactttttagcacatgtttgaccattcgtcttattcaaaaaaaaattatgaaatatgtaaaactatatgtgtacatgaaagtatatttaacgataaatcaaatgatatgaaaagaataaataattacttaaaatttttgaataaggcgaatggtcaaacacgaattaaaaagtcaacggtgtcaaacattttgaaacggagggagtacataacttaatactaaaaccttaatcgtcaatatttttctctacacgagcgtcacataaatattacaagaagtcaaaatactaaaaccttagtggttcatgataagcatgttcggtatgaaattcctgattccgtgagataattatttagcgcctagctagtttgcttctctttaggtagcgtcatcttccaagaatatatcctatactcctacttgctagtaatatttggcctagacaaacttgaagagtcaattagttgccatttttctaagtaaagaaaagtgaaaagtatacttttaatcctattaacctactactaaaacttaaaatttactgaaaaaccagcggtaacaacaactagatgatacttttttttattttactagaaaaaatgcccatgtgttgcaacagatgaaggctattttagtcttattattattattattattattattattattattattattattattattattattattattattattattattatacggttcagttagagtgaaaattattgtgggaatttgcttggatatttcttttagaaaactatgagctacaattaggagtctatctctcatctcaagttagcatgcgagtttttttttaaagtatttcttatacgactccttctgtatttccaaaagcatcccaagttagtgtgcgagttttttttaaagagatttcttatatgactccttttgtattttcaaaagtgatcagacttaaaagcggactcaaacacggatctatatttccaaaaacgaacgaacttaacaaccgactcaaatacgaatgatctaccaaagtaacggtaaaaatatctttaatttttataatagtagagagataactggtatataaaaatcatatttttactgacccacgtataagtgacctacgacatacccctccgtttcgaaaaaacaaatctaaaaatagatgggatcctacccagtataacgaatcattccattctagaaagaaccaacctaaaattagatgagacaatatttaaaactaccaatttggacatgcgaatgccgtaatctattactactactactactactgagaggatacttcatccaatcatccgtatgctagcagcagcagcagctgagttttttcttccccctcgaatagcaagcagatcagcagcagatgagtggctggttagctggacaggagtcacaggacactcgagagggatagatacccttttctgctgggccccacgttcgtttgaacacggggcgcacggtggggctataaaacaataccttatctcttatatgcagcattttataagaagttaattaaatactataaggccatatctcacacattgaattacatacactctataattagttgttaaattatacaatgcccctctctcattatataatgtaaatatcaaacatgattcaataaacatataattatgacaaaaaataatagtccaaactaacgtatatgtataaacaatttatacgatagaactacagaactacccactatcgcatattatgcaaagggaaaaagagaccacaatctcattcttttattgtggagaataatcgatggcatgacattaatcttgcatacagtaaatcaaaatcaccctaaaaaatttcacg

SEQ ID NO: 24474 - DNA, 1734 bp, Oryza sativa
  unsure (1)..(1734): unsure at all n locations
ctgagatgagtnnnnnnnnnnnnnnnnnnnnnnnnnnnnnnnnnnnnnnnnnnnnnnnnnnnnnnnnnnnnnnnnnnnnnnnncgcgggtgcgacatgcgaggctgctctgctctgtggaagttcctcgcatggctcaaatccagcactttgctttgcttctttcggtagcttggcgattcttctaggcatatcgttgttcatctacgcattcgtgagcgtgtttagcgacgcatgcagcggcttagtccccgttgaatcgtggtttggttgaagccgtgaagttaatcaccgagagagacggaccgcgtcatagcagcgcacgagtggtagctgagcaaggtagatcttgaagcttttgaccgctgacttggagtgaatttttttaaggtgggtgttcgtaataatcttgtgccgggacccgggggtagttgcgctaaacgggtcaaagtgtcaaactttgccctctgttttggtgtcggaaaattatgggagagggggatactttacgacttgatctacagccctctgttttgttggcacacggattggtcgaaccttcttgtacgatgggtgtacggtacccatccattcatgacgttgttctacggtcagcgttacggcatgctgcttgattttgttcacttgtcggtaggactaggatgccaaaatagttggtggtattgcacaacctaatttcttagttgtttcttttttgtttcgtcttttattagcggaattaacatgttttcacatcataatgatgcttgtttagaagagctaaggtttctgctcgtcttagttttatttggcagaaaagaatgcatgtatgacatttgatcccaagttaagttgccacagtccaacatgtactttggcatgcccgctttcttcagttctgatcagatactcagtattgttgtaggatagattctatgtagttttctggcgatcttctttcgttagatacagtagattatctcaggtatctgagatttgagatattgtggttttctcaacattaaatgtttgagaattcatagtgggtggtttcttcaatgaaacaacgtcagaaaatccatttcaattaccgatattgccttgtttggttctgatactacttaaaataattgcttccagtagttcagtgccagatttacttgagttggtagctcagtttgtttatgttctgacttctgatatctactggttcattgcagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccacagcacccttgccacccttatagggcaccttcagacacccacgttgtgccacatcattatggcctaaagtcacattcaccggatgctggttatgaaagccaggctactcctaacaagtacacattggactcctctgaaggtgctggttgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24475 - DNA, 2524 bp, Oryza sativa
  unsure (1)..(2524): unsure at all n locations
cagtgccagtagtctgataatccacagcccccatgccagcattatagggcacctcaaaacaccatcgttgtgcaacatcatatggccaaaagtcacattcccggcatgctggtaatgaaagtcagggctactctttagcaagaacacattgacatcctctgaagcgtgtcggttgtatgagacatgattctccttccagtcaaagtttcacaaccagaagtggtagccctctatctcaggaagacagccactctgactcgactgatggatctcctgtaggcgcctcctgtgtcactgaggatcctaatgatctgaagcaaaaactgaaggatctcgaggccgttatgcttgggccagactcggaaatagtcaacagccttgagaattcggtggcaaaccaactttccttggagccggagaagtgggtgcgcatgatgggcattcctagaggcaacttgaaagagctactgattgcctgtgctagagctgtggaagagaagaatagctttgctattgatatgatgattccagagctgagaaaaatagtttcggtatctggtgagccacttgagaggttgggagcctacatggtagaagggcttgttgccaggcttgcctcctctggcatttcaatctacaaagctttgaaatgcaaggaaccaaagagctctgaccttctgtcttacatgcacttcctgtatgaggcctgtccctacttcaagtttgggtatatgtcggcaaatggtgctattgcagaggctgtcaagggagaagacaggattcatatcatcgacttccatatctctcaaggggctcagtggatctctctccttcaggcccttgcagccaggcctggtggaccaccaactgtaaggatcactggtattgatgactcagtgtcagcttacgcacgaggcggcgggctagagctggtcggaaggaggctgtcgcacatcgccagcctgtgcaaggtgccctttgaattccacccacttgctatctccggcagcaaggtggaggcagcacatctcggagtcatccccggggaagccctcgccgtgaacttcaccctggagctgcaccacattccagacgagtcggtgagcacggcgaaccaccgtgaccgcctcctaaggatggtgaagagcctgtcgccgaaggtactcaccctggtggagatggagtccaacacgaacacggcgccattcccgcagaggttcgcggagacgctggactactacaccgccatcttcgagtccatcgacctgacgctgccgagggacgacagggagaggatcaacatggagcagcactgcctcgcgagggagatcgtcaacctcatcgcgtgcgagggggaggagagggcggaacggtacgagcccttcggcaagtggaaggcgcgcctcaccatggccgggttcaggccgtcgccgctcagctcgctggtgaacgccaccatcaggacgctgctgcagagctactcggacaactacaagctcgtcgagagggatggggcgctctacctcgggtggaagagcaggcccctggtggtctcgtcggcgtggcactagcgttgtgactttgtgaggtgatctgacgacgaacttcccttgtaaccatcttggctgggggctttagaaagctatagtgatcatggactggtaagggtagctgtaacaatggtgttgtaatggtaaggtagcggctagggtcaaactcgaaaatgggcaaaatgctgatgaggtgtagaagtgtagtacatgtttgagagtatatgtttcagtttttcttttaaatgtcttgtagtaatgttgtggcacactaatgtctatgatcagaattatcatccactataagctaaaatatccattggaatgctggcaagtagagctgaaaatgtagcatcatgtttcaaccgggacgaatccaacggtccgagcattcgtacgtgttacaggtatcacatttgcatatctttactgccaacggcattgtacatatgcagtgagatacaaagctttgtcacaaaagagaattagacaagctcacaaaaccaaatcaaccataatccatgttctatccacattccactgaaggcgaagatagttaaagaaaaccaaattctgatgatctaattaatcttaacgggttcactgtacaacgaatatagggccagtgccacatacaagtatacaacaaggcctttgccgctccagaagacccatgtggtgtattttgctgcagcccacaggtacagctctcgcctccggttcaactgatgtgtcaatgataggagcatctttctgaagagaatgtcaatacgaagcattggtaatatatgattctcgagctataagcattagtatagactctcacggacccatgactaaattgcccgcggtactgtagcataagttagccgaatggtccatcggtgtggctttgaaaagtaaaccttcactagggttttcttctctcngaccatatatatngctagcttgcattgccgccataagcggcattg

SEQ ID NO: 24476 - DNA, 759 bp, Oryza sativa
  unsure (1)..(759): unsure at all n locations
tcatccactataagctaaatatcactttgaaatgctggcaagtagagctgaaaatgaagcatcatgtttcaactgaacgaatccaacggtcgaagcattcgtacgtgttacaggtatcacatgtgcatattttaactgccaacggcattgcacatatgcagtaggatacaaagctctgtcgcaaaagagaattattcaagctctcaaaaccaaatcatccataatccatgttctatccacattccactgaaggcgaagatagttaaagaaagccnaaattctgatgatctaattaatcttaacgggttcactgtacaacgaatatagggccagtgccacatacaagtatacagcaaggcctttgccgctccagaagacccatgtggtgtattttgctgcagcccacaggtacagctctcgcctccggtacaactgatgtgtcaatgataggagcatctttctgaagagaatgtcaatacgaagcattggtaatatatgattctcgagctataagcattagtatagactctcacggacccatgactaaattgccggcggtactgtagcataagttagccgaatggtccatcggtgtggctttgaaagtaaaaccttcattaggtttttcttctctcgaaccatatatattgctagctgcattgccagccatagtcggcttgnnnnnnnnnnnnnnnnnnnnnnnnnnnnnnnnnnnnnnnnnnnnnnnnnnnnnnnnnnnnngtagctgaccataaccgc

SEQ ID NO: 24477 - DNA, 6455 bp, Oryza sativa
  unsure (1)..(6455): unsure at all n locations
agcgtgnagtagatagacaatctnnnnnnnnnnnnnnnnnnnnnnnnnnnnnnnnnnnnataaattgataacttataactgatgatttgcaaatatgttttattagttattcaaagttgttcgtttaagcttccaaaaaatatgcaaaaccaccatataaagccactttaagagggtaatatggacagtacagtgaagttttgggggttgaatatccggttttaaagtgtagagtgtagacaaacttctatccaaagtttagcggggtatttgtactttcctaaaaacaacaacaaagaatattctatatagcatatgacatacacacacatatataatattttataaaaataaggtagtgatcgaaaaaccttccaacttactccctcagtcccaaaaaaagacaaaccttgggtttccgtgtccaacgtttgaccgtccgtcttatttaaaaaaattatgaaaaaaataaaaaaagacaagtcacacaaagtattaatcatgttttatcatctaacaataataaaaatactaattataaaaaaatttcatataagacggagagtcaaaagttggacacggaaacctagggtttgtcttttttttggacggagggagtagggacgtatactcaaacttctatgttgtataaggaggctacacaaaaatatttctaattttctaaatattctagtaggataaataaattgtcaaccttatatgtttataagggcatttctaaaaaaacatgttccaataatatattgtagaaacattgataaactaagactaggttgactgtaaatgacgtgtcagattttagagctactagtagttggctatattattaaacttgctcttagctatttcatttctcataagagttaaatttagaagaggactataagtgggtcccatcaaataataaaaacaatatattagatattccctccgtttcataatgtaagtcattttagcatttcccacatttgtattgatgctaatgaatatagacatatatatatctatctagattcattagcatcaatatgaatattggaaatgctacaatgacttacattgtgaaacggaggaagtatctcatatgcatagagagagagcgtaaggagagaagtgagagattattattttatcccttatggctaccgatatgcatatggagagagaacttactatttatcatcctctcaaatatatttttcatttccgtttgtcagctgggcccacgtgttagcccccttctcattcgttgagtttgtggacccgtgtggacccagaaaggaggctaacatatagctatggactaccaataaactatatgcggtttatgctatctactattattacattgtggatgtcctaagaggtgatttgtgtattaacagtgtagtaggctattagatttgttgtaaatgatatattaaattttacataataattaattatactattaaatatctactctatagttcaacaaatactttcactcattcttccgttctttcattcatcgctcaaggttcagatcatccgcctaaaatccgaacggtccagatcgatcctgcctccacccccctcaatcagcgcaccgctcccgcacctccgccctccgccagaacaccgctcccgcacctccgccatcaccgctccgctccgtatcagccgccgcgccgtcctctgcatcgcctgtcctccgccaccccgccgcacgaggtgctcccgtcgccaggtagccgccgcgccgtcatctgcatcgcctgtctccaccgatcccctccgcacgaggtgctcccgtcgccaggtcgccgccgacgccttccgcggtgatccgatctgccatcgaatccccgccgccggctcgtcctccaagatccccatcggcctgtcctccgcctcctcgccgcacgaattcctcacgtcgccaggtcgccgccaccgatctgctccaccgatccccgccgcacgaggtgctcccgtcgccaggtcgccgccgacgccttccgcggtgatccgatccccgtcgcctgtccgcggtgatcagaaatttcatcgcagcgcctccgccagggcagagcagttgagaaggtatgggcgtctgatccaaaatcccagacatataccatgtgatgttgcaacccactgaaatcccagatagaccttgaacactcaagattgacatcaccacctcttgaatgttacaccatttacttttatgcaatattatacaagcagttgcaaacgacggccattccgttaatcttgtgatcataattgttatgacacccacacagtcttttgtttctatataagaagatcaatgacatattcatctgtcatggcaggtagaatctccaattcaaggggctctgcgccttgttcctcaacaagagaaggtgaattttccaactgcaactgcaaatctttcatcaggctgtcaagtaaacatttgtactggattgaagctgcacctacattatcctgttgcctggcatattcgtgtgtttacatggggttgaggtagccagtgttgatatagatatatgcaaactagactcgaggatgctgaacatgtttttttttttacagttagttcagaaatatttaggtttcagcattgaacgaggttgggtttttcttcccattgaacaaaaggcatctgattacaatttttctaaaaaaaattatttaggaagttctttgctttttttttcctcaacaagaaaagatggttagcattgagtcataaacttagaggtacaagttgctcaactgctaaggtctgttttatacaggtataatggcaggagaaatgtcaccaaaagaaaattctttctgttgattcacattattttccagttaaatgcgttcatcatttacccatttatttggatcacgtgcattgtcatttgctgtaatttactcatgtcccctaggtaactatattaaacctaccatctttccgaattgaacctgtttcatgtgtagttttcagtggtcacctgttggttgcttccattatatcacacagatttccaatctgactggtaatattgtgagatcatttttttttgtgtgtcatgttctttttatcagatgtgtcattgctgtacagaattaatatataattctcatgtgaacccgttggttgttgttcttttattagttgtgaatttactaaagaaaacatccaaactgaatgacgttggttactgccaaactgagatcaagaaatacatctactccagtagatgataagtccacctattggttcaatttaaaaaatctgaatttggcaaatttaagaaattggttcaatgtacgagcagcatcatatttcaattactgacatactcgactgcaaaactatttcagggctaaactgaattggagaaagatgttccgaagtactgtgataagaattcaaatagtgtgaagtgcaggaaaccaaggaggtatcgcttactactaattcgctcttcaacataacctggtgcttatatattggcatggttttgtacaatatatagtaatcaagattcaataatccgagtatagaagaaaccttgctgcacaaccatattgtggtgtattataacatttaaattataatattgtttggcgacatgatagttaattgtacccatcattcacgtggtcgaatctgctcttgagttattcttttagtcctgagtttaaacatggtgaggggaatgtaaatgcagtggaggaaatcgtgtatttaacattgccaaattcaggtgccattggcgattaacatcctatgttttatttggtgcgacattaattttgtctagccacttacgatgtgaaaaaagagttaacaatgtaattcagctgtcaaggttatttcggtcgtcctaacgtgtcttgtgatcctaattgttagaggataggtcctttttttattacttggttttaaatgactccgtaccgttaggcagtttggattcatcattttgcatatcagccataataagctttaggctcctatttcagaacatttcaccttgattggatagatgttttgagttttatatgaaatgccactgttcttcgagaatttgcctcaaattaactgctaagtttgggttgtacatgtaccgctccaaatataactattttcctattagtaattataaaattattctcttgattctctgatgcctcgaaatattaattagtattttgcaccccgcaatttccaacagggatccagtccctgttcgctgccgcccctcatctccgcatccacgccgccagatcgccgtcgctcggattctggtacataacgtcgccaatctgctctccgctgcacaactccattgcatctctcgccagtctgctccgccaacacgctgttccacctcctccgcctcaagcgccaccacgaccaacacaaatcccctacgccagttaatttttaaaaaacattgaggtacatatcaaattaatttttattatgtagtcatgtgctcatactacatactcatcaaaaatacataaaatgtaaattaggtgcgcatggacgcaaatcgggaggacggtggagctcgcaaatccctcggagatataacaaaccaccgtcaaggtgtacatataatggatagttcgttgtgtacaacgcaggtcttgtccttttcagtatgactatagtgttaataaaaaaatgcaggtcatgtggatcaatttgggctatccaatgagtctcagcgtaaaaaggaaagaaacttcaaacaacgtatatatcgtgcaaatctggaggctaagaagaaatgtagtacaagtcctatgcaaacaacgcatgtgtcagagtatgaagaatgtgatagtgccgaggtcaatgttgctgaaattgccacctcaacaaagagggaaaaaaataacagctatctacgtgagtggcgtgcaagaaatagagcaaagtcgagtgttgttaatagcactgtaacatccgtcaatccaactcaagcaacaactacatctgaaataaaccagagtgaagggggtgtggtagggacaagtgaactttctgcaaagaaaaagagagaggatacaaacaagtatcttcgtgaatggcgtgcaagaaagaaggccaaatcaacagatggatgcaatactgtatcttctggcacgccaatgcagtcaactattatgacccccgaagaacacaatgaagatggtgctgttcagcgatcttcaatctaccctatagttaaacaaatactttcactcattctttcattcatcactcaacgtccagattatccccaagagatctaacgtccgggatagcatccgccttccctcacccctacgcccccgaaattgtcgcactttctttccaatcgcgaaatccatctcctccgccagttctctcgcccatcgcgcctatgcacgtcgccgcccccgtcgtctcccggcgctcgcgcccccacccgccgtccagaccgcatcgcccactccgccgtcgcacgccgcacaccacacccgccctgccaccccgccagttgtcccctccactcaccactccgccgttcatcgcccttctcgctggtctcctccgcaccgcccccgatcttcaccaggaactccgcctcgtcggtctcctccgtgccgcccccaatctccggctcgtcgactgtctccgtgcaaccaccaatctctgctttcagaacagtgtcgccccatcctcgatctgattcgccgaaattaaggtacagaaatcatcctccctccttttttttaatccacaatccagtactatatatatttcctctccccccatcagtcgccgctgatttgatcatacgattcttaatataatccagaatcaatcaaaagaaaaaaaaaccgaaagcatcgttttggtatctaaagaattcatgtttttagataatgataactaaagtatctatgtctatgaacaacgcataactgtctgcacatgtctaaacatctccaaagaacaatagtatctggttatttaagattttacacatttcagaagtcaaaccttaaaattcgattttcactggcaatgacagaatatttaagatgatgcaccatctatgtcaattatcagtatagtagagattcattccttgattaatgaaatcaccatcaccatgcatatgttaggacaatccaattgtttctggattcttgacagatttggtcaagatgaacttatgacttcagtaagcttttgactaattctgtaccaagatggttcatttttaagcaaagtgcaataagcttcatgaaacattgcaccaccgtaatcttcctcatgattttcttattttgctgtataggattagggattattgatacaacatccggcaacctccacctcggggggccacaccggcgccgncgaagcccaccctcgacatcttcgtgccgccaccgac

SEQ ID NO: 24478 - DNA, 732 bp, Oryza sativa
  unsure (1)..(732): unsure at all n locations
ggagactcagcatgtctnnnnnnnnnnnnnnnnnnnnnnnnnnnnnnnnnnnnnnnnnnnnnnnnnnnnnnnnnnnnnnctgtagatcatacacagcgtatcggttacacgggtcaacaaatatagggccgaggtgacatacaggcttacatcatggcctgcgccgatccatatgacccatagatgagtattgtgcttcttaccacaagctcagttatacactgccgtttaattgatgagcgaatgatacgacacatgtgactgaagagtatgtccctacgcatcataagatagatatgattctcgagctataagcattagtatcgtctctcactgacccatttataaattgtcagtatgactgcaccataatgtaactctacatttcatacatgtggctcatatagtaagactctgaactagtatttgttaccacaagacgtatctattgctggatagggtcatagccaaatttaatatcgtcgttgctgaatgacgcacattactgtatactgtaaaccatagggtgaattatattctggatctggacagatactatcgactgtattaggctcggggcttcaatgaggtgtggactgtttgcatctccgaatatctagctgttggtgtgactttaacccgcctgtaaattttggatcgacatttgtactaggttatatgcttttataatgccagctaatacattttaggtaccgatcatcgtatgctacc

SEQ ID NO: 24479 - DNA, 761 bp, Oryza sativa
  unsure (1)..(761): unsure at all n locations
cgcgcgttgttgtccgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctcaagcgcatcagggaccccgagctccgcgccttcatcgagcgctgcatcggccagccccggaaccggcccttcgccgncgagctcctccgcgaccccttcttcgccggcatcgacgacgacgatagcaccggcacgctcggctagcctgttaaccagctgggtagtactagaaattattgtatgtgaattcgattggaaacaaataaacgttctaaacgaattaagctccagcgagtagcaaatgtttataggttcatgtctcaccggcgctcgagcttgtacctgtagctttggatgtggttaattagtggctagtactggagtatttattgtactgtttgttctttggtttgcactgattngattcatgagcttcaaagaaatgcaagatgacgagctgtatttggcttttgctttgcgtgtcaaatgtgtcacaatcctttcaaaggatggntgtaaattaaaggtgtgagatttccatgagctggatgctggagt

SEQ ID NO: 24480 - DNA, 758 bp, Oryza sativa
  unsure (1)..(758): unsure at all n locations
gcgcatggacatnnnnnnnnnnnnnnnnnnnnnnnnnnnnnnnnnnnnnnnnnnnnnnnnnnnnnnnnnnnnnnnnnnnnnnnnnnnncaatttataatggcacgatcaaattagtccttaactaaaaagaacacattagacacacccggaagaacaacagccaaacacacagcccatcaagtcatcagccccttggccattggttgctacggaagacgatatgtatggccaagcaacaaggggagtaacaatttccaaacgacaatttggacaaatcgtgagcgctagcgtcggcctttttttttttttcaatctcatctcgttgaccgtggattatcaacttaattataaacataacttaaatgtgtagatgttttggtaaatcaactttataaaatagcttaaaataagcagtttgaataatacaattttttttagaaaaatgcaatttttgaactatggagcaattaatacagtgaataatctaatgcctatttgatttagattattgaacatttattgttacggattatctactggttatatgggtagattaaatattttaagaaatgaaccaagttgtataggaaatgtaatataatggaattttttagaagctgtattttctaaataaaaccattgagcaaataattcggtgaataacattaaaaaaagcatggacttgtaggtttgagcaaccaaaagaattccgccttcgcaagcttggatgatcgaggtggattttctcaaccgatac

SEQ ID NO: 24481 - DNA, 751 bp, Oryza sativa
  unsure (1)..(751): unsure at all n locations
cgcgcgtgatgaatgatagatacatagcgagccacncnattagtcttatnnnnnnnnnnnnnnnnnnnnnnnnnnnnnnnnnnnnnatattatttgctgatgatgaaacatactacctcaaggcgtctctcatataggaaagtggcacggtttgagaagaacgtcaccaagaggttctgttcctgagacagtcaagaaaggaaatgattatcctgttggacccattgtgcttggatttttcgtctttgtggttgctggttcatgtaagctacattctttgtttatatatttgtggtgaatggttgagctatttatcttcactcatactcttcataactcagaatgcctttaccaacctaaatagattttaactattttgacccttagttcttgtttttatgggtattgcttctgagctctctgcaggactaaactgtgctaaattgcgaaagtgctaatctagtactattatcagttgtcgtgtatgggggtagctgaagtacacatcattagttctgctttaagatgttatcactttgtgggaaagtatctatgtgtgttctgttttgatcttaagatactcaaatccttttcaaagaataagaaactcgattcctgctcttgatgagtccaaaaatagactcatggtttactccacaaattgttgttaactggtggcagtaccacacccatggacattagctactaatctcgtgacacgcgataaaaccttatatgcttataaacttcn

SEQ ID NO: 24482 - DNA, 732 bp, Oryza sativa
  unsure (1)..(732): unsure at all n locations
acgcgcgttgatagatcgactnnnnnnnnnnnnnnnnnnnnnnnnnnnnnnnnnnnnnnnnnnnnnnnnnnnnnnnnnnnnnnnnnnnnnnntgctgtaatgccagcgcacactacctgcacctaaaacataccaccgagcttgtggactgtaaagctgcgtgctgatgtgaagcacctgcaccactgcataagctggagaaggtgacgatctcggcaccgtaagctcctatgggtgagtcagagactgatctctgctgaatacgtgctaaaggtcaataatttggatgtgagctggttcacgcctatgacgatatgtctgacattgtctttggtcgagcgtgagaatactaagggcagatctactgattggtacaggctcgaatgggacgacctatagaataatgctgaccatgcagaaggatgcaggataccaaaactacaggtcaaccacatggatctacacgtgtgtatttgactcccaaagtagggtgctacatcactatagtagagctgcctcgcactgagtggatgcaggaacatttaagactatgcacaatatttttatgaaccggtgtataggaagtttgctgaatttacaaagcagggcaaagctctagggactaatgcacttaccttcatgggttttggctaacaacaagaattttgacgctagaatcgtaaacaagaaatttaatggccggaaactagcactaaaatttttatggaatgc

SEQ ID NO: 24483 - DNA, 755 bp, Oryza sativa
  unsure (1)..(755): unsure at all n locations
gacgcgtgaacatcgaatggcaactatcannnnnnnnnnnnnnnnnnnnnnnnnnnnnnnnnnnnnnnnnnnnnnnnnnnnnnnnnnnnccctcttagcttgtagcttcttaattacttatttgccacttttgcccatgtggcatgccaacgtggcagcgcggtgcaaaatatccgtgggacccactagcgaatacacaactgtcccctaacaccctgtgttagatcagaccagccgtccccttgattgacggagaacctcagttacctgacgggtggaaaagaattcttttcgagggagcagatgggacaaatacgctagcatacaacgggggaaaacccagaggcgaaagaaagatgcaaaggaaaactacctaacacacaagatgcactggacagttgaaaacaagcatagacctctataatgcaggagtaaacctacagatcaacaaacccgtgcgtcatctataacgcaagagagggtaactcctaatgcaagagaaacacctgcaggaaccggatgaggggcgaagtataacggatgacggaataatgagtgattgaaataccctttaaaaagagaagatatgttctagcgtggttaacaactccaagaggaatacgactctgatgagtaaaggagaccaaaaaacgatttctggagcaacaatggacagaaggaaatggcacttaaaaaacatcgttgtaacgtaacagggcctgctgttaaaaaagtcggaacaatcacagaataat

SEQ ID NO: 24484 - DNA, 1212 bp, Oryza sativa
  unsure (1)..(1212): unsure at all n locations
aagtgtcggatatctactcgtacccnactgaaggaagcataaaagaagattttcgataatcaggcgtgtaaaggttggaacacgccgaagaaatgcaaccctgaatagatagccctgaacttttgctaatctgtggcaaacggcagtacgtaacacctgcagaagcaagattttatttatataaaagaaatatgaaaacccaagctctatagagtttttacatgtagtcagacaaggctggaaatggtacttcctatcatggtatgctatagctcaatgatcgagagtttaactaactgatacaacatatcataactaatcagcaaccaagtcagcaaagctcagtaacatattaaactctagcataaaatgcagataaatacttggaaatgtagataacaagcacaatatgcttagtccatgaagtagaatacacattcaaggtgtagagcatagatggccatacaagttattaaattcagaacaatattatcagaatgtcaaacaaaaacacccacactaaagagaaccatcgaacttacagctgttatcatcaagccgagaagatgatttattccatttggaccaatctttttaagcaaaatagcagccagaaattgtaaggatttcaacccatttttctttttccttgtttttaccaatttaccatcaacaccattttgacaaatgctctgattacccgtggtctgtgtacttgcatcactatgagaatattcttcctgacgtttttggcgccgagctgagtgagcatatgctaaagttccacccgcaagtaacgcaccagaaacaactgcaagagttctcctgttgatgtttgtaaagaacaaggaacatgagataagaactaaatgatcgacttactaaaatttagaaagacaatgttaaaacagcacaccttctcgaagacaaaaggttgcgtccgtgctctgtcagttgcaataactgaagagatggcattgttgctaagaagacaccaaaatataaccgtttagctctaagaaaatattgaagattaagaaagaccgcctctgtgatgatacagcatcaatgtattaatttcaacctgttaagattaataagcagaaaaatgtatatcatataatngcccaaaacggaatgcattgcanacttgttgtaaaaaatgaagtagagaaaacatgacangcaagatggatctaaaaatgggcagca

SEQ ID NO: 24485 - DNA, 957 bp, Oryza sativa
  unsure (1)..(957): unsure at all n locations
ggcggtttgtgancttatatnnnnnnnnnnnnnnnnnnnnnnnnnnnnnnnnnnnnnnnnnnnncttgcatgcagttagctacctaaagtacgaaacaatgatcatttacattgttcttggttttacagcaagatgctattgctgaatatgaactgcttagccaaaattaggaacactcaagaccatccaaattacacaatcatcaattgattcctcagataaaagagcattgactaaccaaaagcagccatgattcaaatcaaagcaaaagtttagtagataaactatagacaggtactcaagcatcagttcacaataggcatagctaactttgaaatttaaagatttgcgattatagaacaagttaaccacacatcagaacatatacttacaaggaacatatactgatattaactctctagaaaatcacggtatacttacaaggaaaactccctaagttcttcagcaaggctatcaatttgactgcaatcaaaatcaagatcttttcgatctttagccatctttgagatctttctgagtgcatcaccaacagcctggcagtccttagcttgcaatactggagtagacttcacctgatctgaaattgaaacattaattatattgaaaacgtcatctaaataatgtgcttacatatctctacttgtttctaccctaaatggtgatcttgtatctcaacggtcgataggttgcattacctttaacttcaaaattagcaagtttcacaatgatttcatttccattcttcttgtaatagtatgtcttctcaagtgttaaaaaaagggttttttttttcccccccaaaatttggggggggggggtttctttcccacagagcctcagcatcttcaatccatcaaaaacttgactaaaacaacaatactattacatgactntatatatcttaatgcatttacgtaaagctgcaacaaaagaca

SEQ ID NO: 24486 - DNA, 1000 bp, Oryza sativa
aaaagcaacaacactgttgaggtcaaggaaaattgagctccccatcatctgacttttacaaaacttccaacctgaacttgtacaaatttttcaacacttgctgcaccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggtgcctttggctttcttcttcttcttggtgtgatcgattaccaggccaccaaattttccatctcgggcaatttcctgatttttgcccttcaactcaagctctggattgttgccttcaccggagaacaccaagtctgcaaatggcatttctgtgtcatcaattccgtcggcgttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggccagtttttttttcatgggctttgagttaaatatgcgtaggttgggaactaatttcttaacctgagaaaacatccagagttactccagaattgcatacatacagaaaggcagaaaataaacggtattaccttctttgct

SEQ ID NO: 24487 - DNA, 1103 bp, Oryza sativa
  unsure (1)..(1103): unsure at all n locations
ctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagatttttttttatctcacactcgattctcacactcaaatacacagcgcattctgtggaggagcagcggtgtttttgagaatttcactcgtgctttgtgagagacactgctgttntttgagattcgcatgttaaaatttaaaaaaaatttttggggaaaatttttgggggggggggaggtttttttttttttggctttttattgaggaatggggatttaacggccatatgggatttcttaattgcttttttgctttttattatatctatcggatttaatctaaagattaaaaaatctgtgtgaa

SEQ ID NO: 24488 - DNA, 1213 bp, Oryza sativa
  unsure (1)..(1213): unsure at all n locations
atggtgagnccnnatgtaanttctctttcgccgactttagaggatccccagttaacaggtgtataccagacatgatgttttttaattcagggacaatatcagacaagatattgtactgaagaatgtgggctccaactaaaaactactcctaaatggttttcagtgtccagggaaacagcagaaagacagtcaatttagaattttctttatttatagacatgatgtatcagaagatttacatctttgcacccttcgacaaagtttacagatttaagaatctgtaatatagacagtaactgttctttagtttgcagatgtcagaagttaattacccattaaaaattagcatcatagtatatttgaacggcataacttcaaactcaagcatatgtttgcagagagtgcaacagactggtagtagattattgagctgatacctcactggcttggttactgagaataaccattgaggatttgatgggtgccccataaggccataacttatgatggggaaaacttctcgttattgatttagaatttctgagagttggtaacttcttaattttgagatctctcagtggctgggatagttagttttaacagtgggtacttaatatttacagtggagaaagcctcttttgtacagatccaaccccttatagtctggtttctccctactgtctctcatccaaaaaaaaaaaaatcgagtaaaatttacagtgtactgagaacttactgctttgagatgtctgtagaagctcttcgagttcaaacaccctattaataccaccggacagttcaaggaattttttatgtaactcaagaatatcaccaaaagctataaagctttgtgacaccacagatgccaagaatcgaagtgcatgtgccaactctcctgcaatccgaaattgagaacttgttgggaaattctatgcaaaaataatatcatttggatttgaaaaatttatcaaccttgagttgaagtcaaagctcggtcccccttgtgttccaaagcatataacaaactaagcccccatgtcacattgtgagggtaaagccctttgggcccttttttttcccgggggttttccccccaaaacgaaatatcaaaaataccatatagccatctttttctcagaagagtccttgagtggttaagcatcgttgtgaatttancttnnaccattnnatttacgataagcccnnaaaccna

SEQ ID NO: 24489 - DNA, 7372 bp, Oryza sativa
  unsure (1)..(7372): unsure at all n locations
ccgtgcactganatttgactagcgcgctcgcgacccaaaattaaatcgtgattcatgcttttgtacgaggagttgctacaaactttgtcaatgttatgagtgtattttagtttttataagtcccttttggaaacccttttagaaaataaacttagatttgatgatgaaatatgaatgaccatgatgtaggatataaaggtatcatttatgcatctatgttttgctactattgacttgctgagtacgaaagtgatcacccttgctatataacccctttacaggaattgctctttgcaagtataagatggagttgaggtggccttcagactcctagggacgaattaaaggtagttctaactattactctgtgcgatctctgatggtgggctattttttggcaaaacaagaatttgttaaataataattcacagctggtacacttttatctacagtggtaaaagtgtgggggcaccacagtattgtaattatccttttctttaaagctttctccatcctccaactggatacatcagacaattctactaactctaatatctgcgaactcaatgactataagataagctttatcgcatctaatgcaaagaacaaaagaagtttaatttcttacaacagagcaatggacaatgtagccacagattgtaaactggctcatgggttggggttccttagaaaagttttggcaaccgatttgccttgaatgtttggtgatattccttagaagctgattcgtttgcaattgaactgtctatgaacatctggatttctgaaataaggaagtacccttctcctaacgggtgaatgaactgtagttctctcaactctcttagccaataaggatgctctgtaagtcatgttaaattaatggagcctttctcatgtatctgaataattggtcatagtcaacatcttttcatgtagtgttagtgtaaatgttgcatctgggctgccacttcattttctgaaacatagttgattgcaacgtggtagtctatcttcacttcttcagtaaggttgttttctgttttagttagttatgtagttcttaattacctactttttgttcacttttatcagttcaaacagtagtcttggattgtgctatggtttgtctaggtatgtccatatcttaggttcgcgctcgccatgctattaccttaacatgctctactgctcttgtttgtgtatcgtatggagtcctaatttgaacttttggcgaccagaatcgttgtgggttgtgggattagtatttcattatttacttgattttctgagtctgtttacttactggagtgttgagttggtgcaatagcaagatgagttgctggattgaattcacgcacctatctttgccctttacaccttgaaatatgccattttgtcatggatattgagttactgcatgttgaattcattcattccctgcgatatcttttggtttagataccttgatatgctatcttgctttcagttactaggatgttgaatttattcacttggtgttatgtctttttctttagatacctcaactttatcatgctgtgctatgtgtaaccatttgtcaattttggtcatttgtatgatgtgggaaaacaagccatagttgcaaatttgtgctgacttcttcatagctgctactgtattttgtgtacactaggcaaaaactctgaaaatatctgcttgatgtatattgtatgggtccgacctcagatctttgttgcggctagcagtgcggttatattaataagtgtatctttaggagttacctatagaattagccgaccataagtggttctcctgactacacttgatgcttctaaagatatgcattgttttgattgtgtatgctcttctttctaggtgcttatcaattgccagaacaacaagaagttactaggtcgtgtgagggcatttgatagccattgcaacatggttcttgagaatgtcagggagatgtggaccgaggtacatgcaaggcgttatctgaagttttgaacttttgttccagttgagtgtagtgctgttttcagtaataacatgtgttactcttgctgcaggtaccaaagactggtaaaggcaagaagaaggctcttccagtgaacaaggacaggttcatcagcaagatgttcctacgtggggactcggtcatcattgtgctcaaaaacccgaaatgagttatctatatagtcttgtgtcgaggattgcctctttgctacgtcgctcttagcaatgtccaaacgcctttgtctaagagaactgggccagaatcagctatatttgatagttgagtgttggagttggagttgttatgacttatggatttacctctcttctaacttgcatcgttagcatctgtttgaatcatcaatatattagctgaagacaatttggaactcgactggttatgttttgtgttgatttctcactttctgaattgctagaagcactgccttgtatcgcagtatggcagtatgtgaattgttatgaggcaatatgtgcacatgtgtccagctttcccgcttcttaattcgtaactagatggcataaaataaacaaaagtgcacaggaaaaatcaaggaatggagattttaatttgatggtaaaagggaaatcaaggaaaggagaatccatgagaaactgataaaatgaagtcgagtggcatgggatccaaacccacgagggatccaaagaaaatatgattttttgaaatattttttttaaaaatatgaatttttgaaatattttgggtgtacctgtcgatggtgatggtagcaggatcaaagttgatacggaggccttccaaatagggtggatgacgagccagctgggctcggcacggaggccttccaagttccaacctttacaagtaaacaagttgcaatgggcaaatgtcatactgtcatcaactgattattttgaccgtcgatcacacaccagtatggcttatatatacacgctccaaatgtcatactgtcatcaattgattactctgaccgtcgatcacacacacagccaccagtactgcctatatatacacgctctctccagtctccagagagcctcatgttgcatatgcagtctcattaattacatatgcggggcgtcgctgttcatcaaggaggacatgaagatcacggacgtcgaggtggagatcctgctcggcatcctcaacctctactccctcgtcggctccttcgccgccggccggacctccgactggatcggccgccgcctcaccatcatcctcgccgcggtcatcttcttcgtcggcgccatcatgatgggcctctccgtcaactaccccatgctcatggccggccgcttcgtcgccggcatcggcgtcggctacgccttcatgatcgcgcccgtctacaccgccgaggtctcgccggcgtcgtcgcgcggcttcctcacctccttcccggaggtgttcatcaacttcggcatcctcctcggctacgtctccaactacgccttctcgcgcctccgcctgcagctcggctggcgcctcatgctcggcgtcggcgcggcgccgtccgtcgccctcgcgctcatggtgctcgccatgccggagtcgccgcggtggctcgtcatgaagggccgcctcgccgacgccaaggtcgtcctcggcgagacctcggacacggcggaggaggccgccacccgcctcgcggaaatcaaggaggcggtggccatcccggccgacctcgacggtgacgtcgtggccgtgccgaaaagggccggcggcgagaggcgcgtgtggaaggagctgatcctgtcgccgacgccggccgtccggcgcgtgctcctgtcggcgctcggcatccacttcttccagcagtcgtcgggcatcgacgccgtcgtgctctacagcccgcgcgtgttccagagcgccgggatcaccgacaagaacaagctgctcggcacgacgtgcgccgtgggcgtcaccaagacgctcttcatcctggtggcaacgttcacgctcgaccgcttcggccggcggccgctgctgctggccagcgccggcggcatgatcgccaccctcgtcaccctcggcttaggcctcaccgtcatcggtgaggacgccaccggcggcggctgggccatcgccgtgtccatcgcctccatcctcgccttcgtcgccttcttctccatcggcctcggccccatcacctgggtgtacagctccgagatcttcccgctccacctccgcgccctcggctgcgctctcggcgtcggcctcaaccgcgtcaccagcggcgtcatctccatgaccttcctctccctctccaaggccatcaccatcggcggcagcttcttcctctacgccggcgtcgcctcgcttgcttggctcttcttcttcacctacctcccggagactcgtggacgcacgctcgagcagatgggcgagctcttccgcatccacaacatggccggcgacgacgactctgccgccactcgaccgccgtcgccggaggaggaggagaagatcaccaactacgtggagatggcggcgccgtcgtcgtcgtcgtcgacggccactagcagccatcatgcaaagtgagtgatggaattaatgaatgaatgaatttgtgggaaaagccatggattatctcatgcaatgaaagagactttagtggttagattaattagtattagtagttggaagatactccagttaattcagatggctttcattttgacgcgttggttttgtctgtactaattaagcatggaattattggattagtagttcgtctcttactcttacgtgttgtgtgtcgacgtgtgcctttgtaaccgttaactaatgctgctgtatatattgagtcaaagcacgagagtagtatatctatgcatagttgtcttgtttgatgtttgcttgccgaactatactaaattatttgtccaagattgtcgaacaattcgtgttaaacatacgtgtatacccaggaggctagctattttgtgtgtgcacctggtcatctgaaatattctaaactcttaaggagactcctcttattgtttaagtgtcactcgaataattatggaaaaaacttaaagaaagaatcattaaggtagattaatttgtgatatattacttcataaataagcaacatcaaatttaatttctacaagttaaaaaaaggcaaatttgattgtatacgtaaactatctatagtttaatttgttttatgttgcaacttgtaaatttaaattttaacttacatgttggtggagtgatatatcacatattaatttatcttattttttttcttgtagttatttgcatgatatgtaaataacgagaggatgtcagtttaaaatccactcccttctgtgtgctagtatgttctatcgctagaaagattactaaatcgattaagggtgtatttggtatagctactatggtggagaggagctgagaaagcggcgggaatatgccgctccatgcttgtagtgtaacttttggaagcggtgtggtagctttacctatgttatccaagatcttggaagtgcttgatatagctttagctcccacgagataagaatctcggaattggagtcgtaccaaacgtacgtgtttacagataattcatgttaatataatacgaattcaacactaatttggttgtactcgatcggggtatatatatatatatggtttggtccaatccatacacatccagggtttacaatttcggcttgaaatttttaaaatttcgggaattttgaacccccggtacgaaactatatttttccgaaaatttcaatacttgtgaatttagtaacatctgttcaaattctatcaattttttttgtcaaacttcaaatattttctttctgaaatttcggtcccccagttaatttgtacacgcaataaaccctacacacataattatagattggagttgaccatgtcctcacgataggtaaaatgaatattttgactaaaagtactactccctccgggctgataatacttgtcattttagataaggatgagatcaaactttagaatctttgattatgaatcatttttaaaatcattatctttcaaatatggtgattacatgtatagaatagtcttaaaaagtattttaataaaatcatatatttgttaatacttttatacatattataacagaaaataatggtcaaagttattttttggagactatactcttgtccaaaacaacaaatattattaacccggagggagtatgtgcattttagatggctagctaaatgcatgtgtttgctaattgctaaaaaaatatactataatattgtataagataaataaaaatatttctcataaaatgtgtcacgcattattctgctataggaaatatgtgatttttcatttagattttaattattttttatcattaagaatcggctaattgctaaatatggaaatcaagtaataaactgtttggtttggaaacatcaagggtccatagctcagtggtagagcaattgactgcagatcaataggtctccggttcgaacccggatgggccctcggatgaatttttatttttttttctccggttcgaacccggatgggccctcagttgaatttttattttttttttgggagtacctatacatctttcgaaagatttttataatcgtatcacacagatttttaatctttagattaaaatccgatagatataataaaaagcaaaaagcaattaagaaataccataatggacactaaattaccatatcctcaataaaaagaccaaatccaatacaaaatttaaaatttacatgcgaagattcaaaaattacagtgtaacttacaaaagttacagtgtaagtttcataaattacactgtaacttaccagaaaatgcactgtaaatttgagtaagaaaatcgagtgagagataagaaaaaatctttcgagtgagatatagcaaaatcgttttttttctccggttcgagcccatcctctccaaaatgatttatgtttatttttttcctcaactgatttacattattttgctcaactcaactgatttatatttttttgttcaactgatttacctttattcaactagcaaactggtgaacaagatgtgatatttacgattttttttacctcatcttatttacattgttttcctcaattcatttacctttatttaactactagcaaactggtgaacaatgttgtgatgttaggggttanaaaaaaaaaaccccaaaaaacccggggttttttcccaaaaatatggaactatgtactaaccaatgaaaattagtcgccttttcgttgggctatataaactgcatcgcattcaagaattgaaaaacatctttcatcttacggtgaacca

SEQ ID NO: 24490 - DNA, 4200 bp, Oryza sativa
  unsure (1)..(4200): unsure at all n locations
accaaagttaaaaaaaaactacccttaaaaatatctcaaatcaaatttgaaaatttaaaatttagttttttttttgccatccgatgggagctcaaaccccaaaaaggcatttgcgccgccagccgtttagtacgaactgggtcaatcaccatccacccccggcccaaatgtctctggttcggagatttcttctccgatccgctcctaagtcctatcgcacgaaacgtgatcctctaacgtattgccctctaactttgagaggatgacatatgagcctcacagctggtggacccacatgtcagccacccacatcagagggcggtatgtcagaggagcctcttcccctatcgcacgtactaccataattgcgaaccagttctttatcgcagtgatttgattttcgtctcctgtctatacaagtacacatgtttttttttcgatgggacagacagggagctcctgcaattcactatagaagaagagagttgatccagtttataagggaaaccggacccaaaaaccttacaacagcacggttaattaaaggaaaaccggcaaaaccccgacattgacaaactgaacctaagtacagttgtccaacaagagataaactcctaaaacgaagccttcaggaaggtcacgccgacagaacgacgtcatcgtccgatcctaacgaatctaggttttcacccagagaaaactcttgaagtggagttgaacgagggctccagtagcaaacgccttcaagaaagtgaacggcgcccaagggcgtcgccgttgctagcaccgagagcggagcaagactttcgccttggagcacccatcaactatagcatccacgacgggagctaccaaatgtcacctacacaccgagggtacctgcaatatgcacatcacctgcacgacggccggacgccaaaccaccccgtccccactcgaggacacgccggatctgggcaagggagccagatccggccgtccccctcaccaccaacgccggccgacgcctagaggggcgccggaggacgccagtggccgccgcggggtgcctgcgtgctcacgccaccgccggccgccgccggatccgcggcctccaccaccgccgtcgccacccacaaacaccaccgggcgcactcacctcagcagccaccgtcgcccgtccccgccgccaccgccgcctaccccgtcgccagcccatccccgggtggctccccaggccgtccgagcgcgaggagacgaggagcgccccgccgccgctgtccttgcgaccgcccggtttcggggggtggggtagggggaaaaggggcggccgggtcgcctcccgagccgcccctggggagaaccgactcgggggagagaacggtcttaactctgacaagtacacatgttgctacaaggctagtagatgtcatcaataggtctgggagaagctaaagttggaacaggataattaacttacggacagcgaatctgcagatcaaacaagtcgagtatcttgttaccgattgtgaaccagttgtgaacaatgatgcgatgatatcgtcaaagcaacgtcgtatcaaactacatagtccatcaattcaaaaacttagcaaaccttccatttcattcagatgtagtacatcctctttcgcaatccgtccaagaacagctctcgacaacaacattcagctcagaaaaacaacacacgctgattcaaaaaacaggaaacataggggtcgggaaataaatctccgaaccccaaagagtcgtttgggccgtatatgcaacagcaattgggccagcccacttaggccatcgaatctgccgggtcggccgaaggaaccggcgaccaaatttcattaagattgggaggaataaaatcaaagtacaagtagttttcgcttgcaacgacaggaggctgtcgaattagactgtggcaggaaccacagcccggcaaactaaagaactggaacgtcaacactaaaaaactaaaaaactaagatctgcaaatctcgaaatagcctgcttctttccacactaagatctcttctttgatagcctctgctaactggttagggcttctcgatctttggtcgaaaacacgcgcatttctttccttccaaatctgccagcaaatcagcatacaagcgctgtcgaagtttgtcctgtagcacttccgaaaacatgttctggcctgcaaccaccactctgtcaggcatgtgttttcgctcccagggatggggaagtaagcgctgatccattgccgcatcagtctccacactgtgatggtatagtcgcagttgataaacagatgtaagcagttttcaggttcttgttggcacaaagtacagcaatcagcgtgaggccatccccttttttcaagattatcagctgtcagacagcgtccttttacagccagccacatgaagaaacgtattcttgccggtgccttcgcttgccaaattaattcgctgattgggcagagttcttttgccaagaagaatacactgtaggctgaggagcagctgaaaggccatcgaatctgtcctacgactacggcccaaatgcctcttttgggttcggagattttttttccccgaacccctccaccaacaataacatcaccgataagtcagtactttttttcatcagttcatcaagcatgaaaccatgatccataggcttcatgctgaaatgaattctctcagtaaaaaacatcatttgggtaagtaataaattcaatgtggaaacggaatgattttggatgagagttggagcaggataattaactgacggacaacgaaatttacagttcgcttgtaaaacacgaagagtagtatctcgttaccaattgcgaaccatttcttaacaatgatttgatttccatctcctttctacaagtaaaaacatattgctacaaagcaagtagatgtcatcaacaagtctgtgagcagctaaaaattttgattctggatttccttcttattcctaccaaaggagttctgatgaatgggtagtcaattaactacttactggacaattagcatgtaatatgttgctctcttgtttccattttgattaatcaatcagttcatcccttcctgacattgacctgtgctctcgtcatgctccatgccttgagctgcgacaccttcaccgtgctactgccattgttgaaggcgtacatgtgggtggcgccgtcgacgaccgccgccgggtacactctggccatgatgcacgccctgccgccgccgccgaagctctccaccgccgaccggtcgatctgcacgcacgccggcgagtcaggtttcggactgtttgttcatttcacttcctagatgtgttgtgttgatcgtgcagatgcagagtcactgattcattcactcaccagagttctcaaggagatcttcttctccttttcaaggtcatattcaaagaagcctccatatgctggtgtgtacagtcctggtctcaacgatgatctgcacaagtaaaaatgatgaacacaatgttggacaattaactgtcagacaaaagagcaagttcagacttttcagatatcttcgttcttttttttagtgtttactgtcaaaggttagatttctacaaatatcatttcacttttatcagtgcaatgcaaatagggagttcttaagcatcaacagaatctggatgaagaaaaagcattaaccttctcagatcagagcacaggagaaccatgtacttctgctctgatttgtaaaccctgaagtgcacagtagtgtgctcgtccatgttatcagaggcaagaacaacaagtccaaatggccccaagccgccatgaactgatgcatctgcttctcggcaatgcttctcggtgtccaaaagccaggaagggtcaaaaggatcagcagcatctatggatgtcagctcaaaatctatctccacatctgcctgcttcaagaaaatggtgtgccatattagctacagtgtctgcaaaaaaaaaacataatacttttgttgaggtaaattggaactagcctgtaaagtatcagttcccttgatctcaaacagatcacccttcttgagttgtaagccttgatgactgacttcgtttcttagaagcgattcgacctcttggattggccattgcagcaatcgcttgccatcaccatctaaccaaattgtctggggattgcctttatgaaatgacggggtncaagatgagactcaccacat

SEQ ID NO: 24491 - DNA, 1562 bp, Oryza sativa
  unsure (1)..(1562): unsure at all n locations
cggcctgaanccctgctgcacccatgattgtaattctgtaatcctgtagtatcgacgtaactatttacattgatggagacagtggcaaacgagcaaaatgaaatccctggatgaatctttagagtagcacaagtacaaacccgtgcatctgctgctagcgatgagcggacacgcttgcttgtggtcgcactcttagccctctcctccagccgctggccaggattatccatactgttctgagcccccatcctcagggaacccgacccactccctgatgacctctcagtcgcacctccttcgctcctctgccgcctccgcgtgacaacgttcctgtacttatccagcttctgaatagaatcctgcagcgacttggttttctccctgcacaacatttcaccggttgcgggttaatgagcaatgcagattgaagcagtagtgtgcagtaactagtaagcagcatgtacttggctttggccgacgactccacgacgcccccacggatccgcttgagttcctcggacgctatggaagggagtggcttggtctgcaccagcccgaacgactgctccgcctccacggtgacgccgagcacccgccgaagctccgtggcgcgcgactgcttgtggtcgccgacggggaacgactccagggggaggtactgcgccagcgggggcggctccgccagcgccctcggggttcccgccccggagagctgcgggccctcgcggaagctcccgccaccgccgaggtcgggcctcgagctccccgccatggccgcccggctcaccccgcgtctcccccaaaatccttatctcagaggcatgggaattccaccggtggaggcggacaattcgacttgggagcgctcggaattgaacccgcgggcgtcgaattggggccgaagccttgggcgatagtggattggcgagccggggcaaaaaccctaaccctagaactcgaggtcgccggcggcgagggggcgtgtggcggctgaggggggaagtcggcaaaaagaaaaaaaaaatgagaaagcgggtgccgagtctggtcgggtcgggtcggggtcgcggctgcggacaagttgcgtacaccacggccacgggcaccatgggagattgttgacccatggtcaacacctagcttgggattaacaaaattctgtccaaatcgccacaacttgtggttgtaatttggattatcagtgtataaattcttaaactgaaatttcagtgtgccagtattcacaaggatagatatagaggatttttttttttacaaacggtgccagacagtgtgttcctattaaatatacttcacgatatctataaaatagaacctctatgatagtaagttgctttgaattgtttcgtaagtgtacatagtacttgaattggtaaatattgatccttattcaacttagtacttcaaaaccatataacatagaatattctattacttaaaaccatataacatagaatattctattcaaaaccatataacatagaatattctatgtatagatggcttgggagattcaaagctaatatcttcctttctcaatg

SEQ ID NO: 24492 - DNA, 5915 bp, Oryza sativa
  unsure (1)..(5915): unsure at all n locations
cgctggcnttttgatgtgcttctcgctctcaatggagatacatgcacgttcggacataccgtgtcgtgcacacagtggaaactagtatttggaatacgtgtactatgctaatatgttagtattattctgtgcgatggctttgttgtggcaataataatgtgcgtcaaaataaataaatttaggatatacttttatgtgtcgccgtataaattttgatcagtcaacgtttttttttccaaagtactgtagctaatcaaggagtagttaataatccgatctgccggtggccgtgagacgggtggtataacaaaggttgtccgcatgtttattttgcgatttcaaagtactataatcatctattttgcatgtcatgaatacggagcatcttgtctacatcttgtgcgcgatcacgaggggaaatttaaaaaccgtgctgctaatattaattgccacatcatatgatttgattacgctggtatttgttgggcggctgacagagggatttattattaaacaaggaaaaagctcatttgacttccttaaatatcggccgaatctaatttgtgccctttaaccagaaagctggataagaaaactccccgaactattaaaacagatacaatttgactccttaggtgggtttgcaagcggttttagctgacgtggcacctacgtggtactgtcgatccggtcttcgtcccacgtgtcgtcgacgcgttgcttatgtggaactagagtaaaacaaaaggcaaaattttgtaattttgtaggactgacatgtcactcacaaacacacacaagtgggacccatcgacaatgtgggccccacatgtcattctccctttccttcccttcttcctcctccttcccccctctctctctcccttatctctctttctctcccccggcctcttttttcaccttgccccgagcggcggtggggagcgatggtggggacggcgatagggagcagcggcggcctggccacctctccgtcggcctctttttctttcatattttcctctcctctcacctaaacaccaccggtgtgcacacctgcattggcaagctctcctaaacaacacatctgcaaaaaatggcacaagcttaataatttgagctgtttgtagattcgtaggagacaaacatgccgaattgcgcgtatgtattgatgaacatgcgctggtatcaatggcgttttacttgatggctggaggtggtgtcaaagctgcgggcgtggtggcatcggaggtgaaggtgtgcgacgtcgtcgtttgggaggtgagaaggcaaggcttcttggaggcagaggcggaagcggtggctgtggtagaggcggttgcgggggaagacggggatgagccagtgagctgttggtgctcacggcggcgagcggtgggcacctaggtgctcttgacgtggatggagcaaccgaagccgcggcttttgcaacacgtgcggcaatgttggtggccacagtctttctttgcttggttaccgcagtcctagcacatcgccgcggcgccggagccaaacgatccgtcagcgatgtccagcatcgggagggggttcttgaggtaggggaaggcgctagcgctacgtgatgaagcttctctccgttgacccgttgaactacgacgacacccccatcgaagggatcaggaagatcctcgaggagttgtccggggagaggatcatgcggtcgtccaagattcccacggccaaatggtcaattggagcgggagccaagtgaatcgctccagaaatttatactcccttcgtttcaaaatgtttgacaccgttgactttttaacacatgtttgaccgttcgtcttattaaaaaaaattgtgaaatatataaaattatatgtgtacatgaaagtatatttaacaatgaatcaaattatatgaaaagaataaataattagttaattttttttaataagacgaatgaccaaacacaaactaaaaagtcaacggtgtcaaacatttagaaacagagtactagcgacttagcgaggtggagtggcgaaaacgtggctccacgtcctactctgaaaataattacagcgctacccgtcccctttcatcgaaattacaggaaatgccatcgcattaccttggatccagccgaaccgtcgcgccgcccactcgtcgactcgggccttatcgcgaggagaaaaaggggagacgagcgaggcagcggcggcagagccagaggctgcttcctccctccttctctcggtgcgacggtttaggcggcagcgcacggtgacggcggcagcacggcgcacggcaactggggcgacgcagcacggtgacggtggcagggttggagcacggtggcgagcagagcaggggaggggatcctggtgagcttctgattcatctctctctctctctcccaccccaccggggctacgtctgtctggaatttgcttgcgttcgttaacccctagcttcttttctagttctggaagaagctatttcacgagaaaatacaagtaacagtttattgtttgtttcccccaaaatttgggagttcaactgaaccccccatgtcccaagttggatccgcccctggcgctcttatccccctttgtttgattaattcacagcacagctcagtgctacaactccttctacttattacagtaatccatcacccattaccagattaatctgaattgcctgcatctacgctgctgttttggtgttttgcagaggacgcagattctgagagtacctcgaagttaggatgggtagcacggagaaattcagattctgcattgacaggggcggcacattcaccgacatctacgcagaggtgcccgggaggagggaaggctacgtgatgaaacttctctccgtcgacccgtcgaactacgacgacgcccccatcgaagggatcaggaggatcctccaggagttctccggggagaggatcccgcggtcgtccaagattcccacgggcaagattgattggattcggatgggcaccacggtggccacgaatgcgcttcttgagaggaagggtgaaaggatcgcgctgtgtgtcacccggggattcagggatttgcttcagattggtaaccaggctcggccgaacatattcgatctcaaggtgtcaaagccgtcgaatttgtatgaggaggtggttgaggttgatgagagggttgaacttgttggtggtggtgatggtgagagggatgatggtttatctgttaaagggatctcaggggaattggtcagggtggcgaagccggttgatgtagaagcattgaagcctttgttgaaaggtttgcttgacaaaggaataagatgtttggcagtggttttaatgcactcatatacttatcctcagcatgagcttctcattgagaaattatctcttgagatgggattcaagcatgtatcgttgtcttcatcattgacgccgatggtccgtgctgtgcctcgtggcttgacagccagtgtggatgcttatctcacaccagtcatcaaagagtacctatcaggattcatgtccaggtttgaagggggaggtgagcaggtgaatgtgctgtttatgcagtcagatggtggtctggcaccagagaggagattctccgggcacaaagcagtgttgtcaggtcctgcaggtggtgtggttggctactctcagaccttgtttcaacttgagacatcaaaaccgctgattggatttgacatgggtggtacatccacagatgttagccgctacgatggaagctatgaacaagttctggagacccaaattgctggggcaataatacaagctccccagcttgacataaacacggtggctgctggtggtggatcgaagcttaagtttcagtttggagctttcaaggttgggccagattctgttggagcacatcctggtcctgtatgctatagaaaaggtggtgagctggcaataactgatgccaatttgattctgggaactgttattcctgagtacttcccatccatatttggtcctaacgaagatttaccccttgattatgacgctactaaaaaggcatttgagattcttgctgttgagataaactctcaccgaaagagtcaggatccatcagcaaaggacatgacggttgaggagattgccctcggttttgttaatgttgcaaatgaggcgatgtgccgacctataaggcagttgaccgaaatgaaggggcatgacactaagaaccatgctctcgcatgctttggtggtgctggtcctcaacatgcatgtgctatggcaagatcccttggcatgtctgagttacttattcatcgctactgtggcatattgagtgcatatggaatgggccttgctgatgttattgaagatttgcaagagccatactctgctatttataatgttgattctgctgcagaggcatctcgaagagtagatcttttagttaagcaggtgaaagaaaagttaatagagcagggttttggagaggacagcatcaggacacattcatacttgaacttgaggtacgagggaaccgatacagcaatcatggttaaacaaccagagagggaatctggaagtgattatgctgatgagtttgtgaaactgtttcagcaagagtatggcttcaaattattaaacagaaaaatactcatatgtgatgtgagggttcagggagttggtgctacaaatatcttgcagcctcatgaactgacaccagtatcaaccaaacctgtgccagaaagttcatgtcgaatttatttttcatacggatggcaggaaacaccactttacaagcttcagaatttgggctatgggcatgtattgaagggtcctgcagttataatgaatgggaacagtacagtgatagtagaaaaagactgtaaagctatcatcaccaagtatggtaacataaaaattgagataagtgctgctccaagcagtgtagaagtatcagagacagttgctgatgtggtccaactttctatcttcaatcatcgattcatgggtattgctgaacagatgggtcgaacacttcaaagaacttctatttctaccaatataaaggaaagactggacttttcttgtgctctctttggtccggatggtggccttgtcgcaaatgcccctcatgtccctgtgcatttgggagccatgtctagcaccgtgcgttggcaactcaaatattggggtgataatctccatgagggtgatgttcttgtaacgaatcatccatgttctgggggtagccatcttccagacataacagttgtcacacctgttttcaatgaaggtaaagttatcttctttgttgctagtagaggtcaccatgcagagatcggtggtatcaccccaggaagcatgcctcctttctcaaaaagcatctgggaggaaggtgctgccatcaaagcatttaaacttgttgagagaggtgttttccaagaggaaggaataattcacttgctacagtcaccgtcctatgatgaacttacaaaccataagattccaggaacacgtaagatccaagataatctttctgacctccatgctcaggtggcagcaaaccagcggggaataacacttatcaaagaactgataaatcagtatggtttgatcactgttcaatcttatatgaatcatgtccaaaacaatgctgaagaagctgttagagaaatgcttaaggtagttgcatcgagagttgaaaaggagaatgggtcttgtgtcatcgaagatgaagattacatggatgatggttctgtgctccatttgaagctcacccttgattcaagtaaaggcgaagcaacctttgactttgaaggcaccagtcctgaggtgtatggtaactggaatgctcctgaagcagtaacagcggctgctgtgatatnctncttngnngggtggcgagccgactantagaatntatagaacg

SEQ ID NO: 24493 - DNA, 9987 bp, Oryza sativa
ctcctgtgaagatcctaattcctaaaggctctttcctttctccaaatgacaaagcttcagtggttggtggtaatgtattgacctctcagagagtgaccgacgtagtcctaatggctttccaagcatgcgcctgctcccagggttgcatgaacaatttgacatttggagacgacaccttcggttactatgagaccattggaggcggttcaagagctggggcgagttgggatggtacaagtggtgttcagtgtcacatgacaaacacaaggatgactgacccagagatctttgagcagcgataccctgttcttttacatagatttagcatcagggagaacagtggaggttctggtttccacagaggtggtgatggccttgtgagagagattgaattttgccagcctgttgttgtgagcattctttcagagagaagggtgcatgctcccaggggactgaagggaggaagaaatggggcccgtggtgcaaactatctcgtcaagaaagatggtcgtagagtttaccttggagggaagaacactgttatggttaatgctggtgagattcttcagattctcactcctggtggtggtggttttggctctccttgatggctattcttgtggacgatcatctacctcgcttctgggtattgtcatttctacttctttagtcctacttttatccacaaataaaacatgcagaaggcagaaacttgcacaaatattgcctgatacagatccaaactgtcattgttgcttctgggacattggagctgaataaggaagcatgttgcttgtttacctcactgttgttcaacttaataatgtttttttttgataaaggaagcttttattaatctcagacgattacatcaagttgatagaaccatactaagaaaactcccggcctctgcataactaggatgcacacagccaaaacacacaaacccacaaaagagtttgtaacaagagaaggaaagcagtaaaaatcagggagcaccaatcttcaggctagaccgccacccatgtccctgggtaaaacattccctgaccacctgctccaagcgctaacacgccgctgcaaccaaatcccgtgaaccaggcttctgaaggatagcccaggtacgaaggaagtggatagttaaaaaaataacctgtaaaggagaagagatttttcttttgtcaaacaccatatcattcctgcaaagccataatgaccaacaaatagtggctgcccctaacaggataagtgacttcaagtctttcctaattccccgtagccaattaccaaacatattggatacaccacgtggcgggaaaagccctgtagccacttgtataatgcaccacacaaaacgggcaaatctgcactcataaaacaaatgtaatattgtctcatctttgtgacaaaagcaacaattcttacttccttgccaattgcgcttagctaggttatcccttgtcaaaactaccccacgacgtaaataccataggaagatcttcactttaagcggtatttttaatttccaaattactttgtttatgttgggcaaatctgaatgtaccaaggcaagataatgcgacttcactgaaaactctccattttgggttaaattccaatgaaacttatcttgatcctgagtaagaactaggttagcgattcgtggaagaaggttattccacgccactaattttggctaatgttttgtgttaaaaaaaatagtaatgtggaatcatttatctttttaacgattaactgtattggttgtctctgcacagcatggcttttggtttcctctcctcatgttactgttacataagaaattactcctaccatactggtgtttacgctgcacttggtggagactcaagctgttgtttctgtctaagcaataatgtcatttgcatatagatacatgaggtgtagcaaatctacagaatcagaggtcaggaactacacaaaaaacaatcaataatataatcacgataaattatttgatatgagtattgagaacaatacaatgaaaaaaaaaactatgatgcacagattggtataaagctagtagcctaataatttgatgcattttgctattaattagttctatacgatggatttccaacgcaaatgcatccccaatgttaaggtgagaccacaccctgttgaggcacagtagcatatagacggccgtctaagagatccaatacatgctttgcatgaatgtctagtttaggttctgtcacctctgaatctagtggatacactctttctttggcaaggcagctcatctagtggactccactgaggttgttgggcattttcagaaggtgattcatcaatcttcagactgtaataagattataagaacctcgcaagtggatgtgctgtcagctgtttctaactagtgaattttcaggttcttacctccagaggcaagttctgtatctgctcaatcgccattggtgtgattgttgaggttataatcatgttcccaatccagcaccggtcatacggagatggaatcaacaatgttcttgttcttctgagaggagggataccgatcgcaatgcctactgttctgtcagtcacacttgcaataggttctcatcacctgtctcaacaggtgtgtccaagatattgttgtcatgtttcttcaattaacagacagtatatcacatatcattactaaaattaattaatttttggcaaggtgctatcactaaaaggatgacagccatagaagaaatggcaggaatggatgttctctgctgtgacaaaattggaactctcactctcaaccatctcactgttgacaaaaacctaattgaggtagagaactttaataaaaatatgtggtatatcgaatccatcattattgagtagctaggcaacttatgttccatcctttgtgtaatttcaggtttccggtggacgccggcatgttcccggagcacaagtacgagatcgtgaggatcattcaacgggagggccacctgtgcgggatgaccggcaacggcatgaacgcgctggcgctgaagaaggccgacattggcacagccaacatcgcacgcgctagcactgaagaaggccgacatcgcgctcacggagcccggctgagaggcacacatgctgagagcgcatgtgcaatctgtgatgagaccaaagcgtgtggattctgatgtaattcgatcggctcagacagtttgatttgcttgggtttagcttcatggcgttgtatcttcagagttcaaagtaaaattactatagctttttgcatgcaaaatgtcagaaacttatacggaacatgtcggttttcttttaatgattagagatgatatatgagtttgcacctgataattgaatatctcttgttacctccattggagtatttgctttgtagcagtactagtcttgttaacaaccagtgaacttggtgctatacttaactgcactatgctcatttggatctttcagatgatataaccaattaatctaccatgatggcattaatgaacaatcaggaattcagaatactgctctgtagacaggatacaatggcacacctggtcctacaatatatcaagcaacacctgtgattatgtactgatgaaactgactttctttctacttcctccttccattcttctctcccttaggtgctaggcgaacaaaataaatacaatttgagatgtaacaggaaaagctagggtgctgtttctgtcatatgaaagtcttggtcttggtcgtctgctcggcgcggcgaagaatctccatcaagcattctcttcggtgtaccttttccttttgtatctccatgacaagttgagggacctttgatgtacttccctaccaaaaatcctctgggccgtaagtgttccatagacgaaaaaaaaaagaagaaaaaaaggaaaaaagaagaagaaaagcgtcgtggtgtcgtcgtcctcgccaccggattgtcccgccgacgtagcgccctcctccgccgcgcatgccaactggactagtcaaccacggcagggtaggcgactagactagactagtacgcttctcttctcgccatttgaatgaatgccaccgccgctcgatccgatcctggcctgcatgctcaatctccgccgcgcgactgctgccgccgccgtcgacgggctctggttctccttcttctccaccacgacgactgcaggaggagccatggaagaggagaaggcagcctcgcccgtctcccggcacatcatgccgcatctcctcaacatgtacgttcacctgttctctgcttagctctgtgttgttgattcggtgacgaaacaagacagaaaaaaaaaaaagttgcacgcatatgttgcagatacggatcgtgcgcgacggctcgggacttcgagatttacgcggcgcatgccacattcgaggacccgcttatgcgagctcatgggtacgtctacgtttgtttcctcaccatcgatccatcatatctcttcttctttggcaaggcctttccatcccctgttctccgaaagaacagtgtttcgtggctgcatccatgacttgacagattggtgatggcacgactacgctcttctgggaagaccggtggctagatggttcctgcatctgctcactagcaccggcactctatgatcgagtacccaagcgaacccgacgacgaaggacggtagcagaggggctactcaacagagcttggatccgcgatatatgaggagccctcggattgcaggccatcgtagagtatctcaatctctggtcgttgttgcgggagatagagctctcggatcgccaggaccaatttatttggaaatgggaaagttcaagcatgtactcctcccgctccgcctaccaagcattgttcctcggtcgaatcccgttccaatccacgccgatctggaaatcgctggcgccgccacgctgccgttacttcagctggctggtcgcactcaaccgctgctggacggcggacaggttaagcatcaggggcttgccccatcccagcatgtgtgtcctatgcgatcagtacgaggaaagcatcaaccacattttggtcgcatgcccagaatcaagacagctctggtggctactgctctcggcaatcggttgctcggaattagggctgtcaacgagcctagctcgagcgagctcgtctgcctaagctcgagctcgacacaagctcgagccgagcctattgcaccttcgagcttttaggcaagctcggttcgagctcgttcgagctcgagctcgagctcgagctcggtgccgagctcggccataagtagtataatatatattttaataataatctcttgataagtctaattattttctagttaatcacactaataaaagagtagaaaatgattaaaataaatatattgtgctaacacatgctaatttattgtgtaaatagatacaaatatatatatttatctattagtttattatattaataaggtgaacatgcaatatagactgtacacagccaagctcggttaggctcggtagaagctcaacctcggttcggtaaagctcgcgagcttttactcaagctcgagttcggctcgtttggagctcgagtcgagctcgaatcgagcctaggacgagccaagcttgagctgctcgcgagtctcgagcttttttgacagccctactcggaatgcttgcccatcaatgaaacctcattccactcctagttatgtgacaagagggaaaccttaccgagctctcaacggcgaggtttcaataccattgctactctcgcaacatggactatctggaaggagcgaaataacagggtgttcaaccagaagcacagaagctggacagaagtggcaagggcaatggcggaagaggcagcgctgtggcggctcgccaatactgccataccggccacgcctttagagcgctcaggtcgcaacattgtatcgcgagattagggtttaatgttcttgggtgacttcctataatcccgtctcctgctgtgttttccctttaacctgtacagacttttactcctcttaatacaaagatgcgcttcttacgtattcccgaaaaaaaaaatatcccttcttctctttcattctttctttcattccagggttaagcagatcaaatcggccttctacacactccccaaggtaacatcatatctgtcatgttccacctccacacaaccaaaacttatttcaaactgaattctctgtaatatactatgcctgtatgattcatcagttattcggtgaatccaaaatcgtggagtacacaattacagaaaacgaaaccgcgcccggaaaagtcgaggtaactaatcaacccaaacttcatcgacagtgtttgactatcatgctgatcactaacagaggaattaacaatcaatcgatctgtttcagatactgatcgacaacaagcagcactacaagttcctgggcagggccatcgacctggcgtcgctcatcacgctcgacgtcgaggacggcaaggttgtgaagcaccaagactggtgggacaagaagcctctcaagaacagggacacggtgagcttcccggtggtcggccggctggcggaggcgacccgccgcggcgccatgctgctcactcacgctctcatgggctgcggcaaggacccataggccatcgcctccgacagccctacaagtggacaatctcgctacccgtataaaaatatgtttaatatagtttattctctattcactagtactacctcctttcctaaatatataaagttggtttgtttaattttaaacgaatcaacgtcatacaaataacacggagggagtacattttaggtggactgtaaattaaagattgtactccagatgagtatgacgtttttttgcctcatatcactattatgtaatatcatttgtatctactacagtacaatgtttgctttacaataatgaatgtagtactacgttgtatgtagcgcaaattagtgcaagaaaaattgtggcaggggaacactgtgctaccactgtgctacaccctgcaagtgaagtctctgcattgtttctttcagagaagccgtaggctgcaatgctgcacctgaatagaatttgccgtgtaggtgaatgcgtcggcaccgacgactgcgtccacgagatccgagttaaaggcacttgcttttactttgcttgcgctgtaaattaattttcgctaaagcctaaagaggtcgtagtcgtagtagtaaaagatcacaaactaaagagctaaagtgttgtgtgcagtgtggtgtcgttccttctgcaatgatcgatacacagattaatttcatttctatcttcctgtctaacctcagttcacaaatcaatcagcttgattccttcaatatgcctaatcagccctaatctatttaccgttaatactactcctgtttttttaacaacactttaatctttcttgttttgcacgtataagactaaaaacgaagttattttgggggaaaaaatactccctctatttcaagatgtataacgctgttaattttttcataatatttaaccatttgtttcatttagaaaaaaatataaatattatttattttattgtgacttgtttttatcatcaaataaaatataaccttgacttatatttatacacatttatactaaatctttaattaagacgaatgatcaaacgttaaaaaaaaagttaacggtgtcatccaatttaaaaatgatgtagtactgtttagcattagctttatatttttttaggaaatactactagttccctgacctcctggctactgcatactgtacgtactgaccgagtctgcagcagcagcaatcaactgccatgaatagagatgtttttcatatggacaccgaaatgcacgttatttagcgaccagttcgtcgtgcccttcaatttcatgccatgcaggcgatgagttggcaaaacaccacatcaatcaagctaaacaaacacaacacatatcctctgatctttttcagccggattctggatatgagtcgctggcaactgggccccactctgataacgcaaagtcgaaatcccaaaagtacccctcctcctttctctcccactaaccatcgccgggaaatattcgacttaaagttaaagaagccaacgttaaagacatcaaaaaatcaaaaaagaagagacataaattctctttgctcacagggagtcatctcgttggccatatatccaaaaacacatttcacttcatcgtctcgatcgatcgagcttcgagcagagtgatttagcgagagtgattagttagccgctgacaatgagacgccaggctgtcgtcgagctcgtcgtcgtcgcggcggcgctcgccgccctcgccgccggcatcctcgcggcgtcgctcctcctgctctggcgctgccgccgccgatcagcggcagcaaacaggcagcaaccagccgtcgtcgtcgcctccgacgccgagctcacggtccagagcccgaagaagccggcgccggcccggcgccgcggcggcggcagcgcgctccggcgagcgctgctccgcctcctgttctgctcccgccgccgcctcacccgcgtggagccggccgactccgccgccgccgccacgcagggggaggaaggggagcaggcggcggggcccgacgaggaggaggtgaacacgtggagggatcggtggttcgggccagccaccgccgccgcctcgcgcgcgctctacaccatcgacgaggagtccggcgccggcagcgagggcgaggaggagccggagcccgagacgccgttctacacgccgccggcctccccgccccggctcggcggcggcggccactcgccggaagccaccgtgtgaaggtgaagctagcagctggtgttcgtccacggtccaccgcgacatgattacccgaccgttttcttgttttcttgttggctagtagcaggcttggatttttgttgtcttctttgatttttagttttttgctcatgtcaaaacgacatttttttagccaggttgcatggtgcacaggtacagtgcagttagtactagtgcttagtgtagttgttactacttaatgcacgagcaggatggtgattaagatctaatctcgtatgctagccagcttgcaccagttgatggagttgcataggtgcgcatgttggagacaaatttaatctctttgttcaaacattattcaaattatcatgagaaaatcttaaaaaaagttgaaaattcatatataaaacataaatatacaacttcgcaaaataacatccacaaataatagaaaaagataaaatccaacttatgagttatgaatagcattgctgcaatatatacgtgcgtggatttgtctgtttgatatactgagcgagtctgaacctaggccggcgtccgttttcttacatcgcggagatttccagcgcacgcgaaacgagaaggttgattgagcacatgctcaataattaattaagcattaattattataaacttaaaaaataatttatttaatttttaaaacaacttctacatagaaaagttcgtaaaaaacatttaacggtttaaaaaacgtgctaacgaaaatggaggaaattaaagtttggagtcgaagataagtgttgttggagtggtaaatgttactgaaatctacattgtcattttttttaaagaacttttcacgatcatttgtattgaatttaatttaaaaaatagtagatgaggggagatctacaaggaattaaggggtgaaaatggtcggaatcggtaacatctcttcggaaacgacgctcgatcgaccgtaattaaccatatttatcatttaaattattcaatgtcaacattaattgctgaaaaagaaattagaaaaaaaataaaatttatataacaaaaagggtaacagtgttatgtcgatccgaaatttccatcgcacattttcatccccctccatgcgcatgcgtgcaggtcacgtcagagagtcccgggtcgggtcgaggggcaccactact

SEQ ID NO: 24494 - DNA, 1275 bp, Oryza sativa
  unsure (1)..(1275): unsure at all n locations
catcgatattgatgcagaccaaagattcncacatgatgtggagagttgacccaatgatcttgctggcctagttacggnaatggtgaaccacttgttgacattctttggtaggttttttttttttgggggttttccacaaagtggggggtttcccttaaaaaatattacccaggtggttctttgattaatcaggttttcttagcaagtccactattactctccaggtttacatggagaatgaagattttgtcagggcgaaggggagttgctattttgtacgcatacatgttgctaggtcttggttttctaagagctgtttcccctgactttggtgatcttgcaaatcaagaacaagaacttgaaggaacattcaggttagtgacatatgatttgcggtcattggcaaagttgactttattactaaggaacttccaagtattgaccttgttaatttcacaggttcatgcactcaagattgcggacacatgctgagtcaatagctttctttggtggtggatcaagggaaaaagctgtgagtttttcatgtctcataaatgctgcttaaaatttctagtttccacactataattcttgtgggcaatatgttttttgtgtatacaaatttcttgttgcttttgaacatctggtacagatctgttagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatgggggcttagtttgttatatgctttggaacacaagggggaccgagctttgacttcaactcaaggttgataaatttttcaaatccaaatgatattatttttgcatagaatttcccaacaagttctcaatttcggattgcaggagagttggcacatgcacttcgattcttggcatctgtggtgtcacaaagctttatagcttttggtgatattcttgagttacataaaaaattccttgaactgtccggtggtattaatagggtgtttgaactcgaagagcttctacaagacatctncaaaaaaagnccaaaagttttaaaaaaggggtgttttttttttcccccagtacacttgaaatttactcgattttttttttttggatgagagacagtagggagaaaccagactataaaggngtggntctgtccnaaagaggctttgttatatanctta

SEQ ID NO: 24495 - DNA, 829 bp, Oryza sativa
  unsure (1)..(829): unsure at all n locations
ctcccgcacattaggaacccncgttattctcctcttgctttaacaaattcacagccaataaaanaaagcaatggttgagctagtaggagctccgcttgatccggtaaatgagcgaaaaaaaaaattttttaattttccccaaaaattttcccttaatttccaatgtggtctaatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgattttgtgggacccaagggaaaaaatttttttttttttgggggttttgttttcatcccaactaggtgttgaccatgggtcaacaatctcccatggtgcccgtggccgtggtgtacgcaacttgtccgtagncgcgaccccgacccgacccgaccagactgtga

SEQ ID NO: 24496 - DNA, 898 bp, Oryza sativa
  unsure (1)..(898): unsure at all n locations
ntaaatgctgcttaaaattcttagtttccacactataattcttgtgggcaatatgttttttgtgtatacaaatttcttgttgcttttgaacatctggtacagatctgttagtaattttttttttttaaaaaaccccaaatttggggcccccccagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatgggggcttagtttgttatatgctttggaacacaagggggaccgagctttgacttcaactcaaggttgataaatttttcaaatccaaatgatattatttttgcatagaatttcccaacaagttctcaatttcggattgcaggagagttggcacatgcacttcgattcttggcatctgtggtgtcacaaagctttatagcttttggtgatattcttgagttacataaaaaattccttgaactgtccggtggtattaatagggtgtttgaactcgaagagcttctacagacatctcaaagcagtaagttctcagtacactgtaaattttactcgatttttttttttttggatgagagacagtagggagaaaccagactataaggggttggatctgtacaaaagaggctttctccactggaaatattaagtacccactggtaaaactaactatcccagccactgagagatctaaaattaagaagttccaactctcagaaattctaaataataacgagaagtttccccataataagtattggcttattgggcacccataaaattctaatgttatttttagtaact

SEQ ID NO: 24497 - DNA, 3408 bp, Oryza sativa
  unsure (1)..(3408): unsure at all n locations
cttggatcccattacaaagcaagttttcattacttttggnncnggtgggtcacccgcccaacaagtaaacaaagtctttcacacatctcacttcgccattggccatttcctctccaaaggggggtttttccccacaaatttgggggggccccccccccccaaaattaccccccagcccatggcatcagtggccctttctcatcctcttcttccttgactttttctcctgtgaatctaatcttccctgcaggaatggtgtagaggccacacagagagtcttcctctatccacagtctccaaaggtctcctctattgtcagcaagggatacagaactggatatcacttccagcttccaaagaactggatcaatggtatgtctgcatgttttccatcagtttttacccttttgactttggctgaatccaaccagaaactgtattatccaatttggtgttccttttgtttcttgattcaagaagaacaagctgccctaattagttagtatcttttctagctgcaaaagttaagccgtgtggatgagcttaatttcttgtgtctatatgaatttcatggtatagagaggaggggggaaaggtaggtaggcaactcactgcttgtgtgagctctactgctgattgttgcacacgtttatggtgctgcagattgattttcagtaaaatcgtaatatggttatttctatgtttagattttcgctggaaaatatttaccgctgaaatgttgtatttgtggccgtcttttgacgctaggcatcatatttgtattaacagaacgaacagtacaacaaatgtggagttttctcagataaagctactccacatttgttgtactgttctgttaatactagctccagttagaaaatgttgacctagataattctaagatttgttctaaaaggcctaactacataacttttttttctgaatatttagcagatcttttcttaaacataggctagtaactagtaatcaagcatgtactgattcttgaatttttcctcctgtttgctatgtcttctatattggacaattcttctaaagctgacattctctcttctttttcaaatgttccatgaaatgacaatcctggcaaatttgtggcaattcaaaagatccaaacggtacgcatcttcttcacataatatgcatccaaacaaattgtagaataaactgagacattgcgtgcctaaattatctcaaaatttacagggccaatgtactacaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtattgcctggcaagaacaatggactggacctctctgcagctatcccaaatggcgccaagcatgtcctcaaaatgagcttggattcctgtgacaagtacatgattggggtttatgatctgaaacatgacatgtttgtgccggatactgtcttggatgacagacgattgtggttgaggattgattatggcaattactatgcttcgaagtcattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaagtgaaaaggacactacaatactacatggctaatctatcgtttaggggccgataaaatcctatgtaaccatacagcgaaaagggttgctattaaacaaacgcctatgcaaccccagattaattagtccggcatcgagtgggagataatgatagtagaaaatgatgaaaaagccgagcactgatttaagggttagaaacatataaatttcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcctcctttaattttatactatggaagcaatgttttagccttagcatgtcagtgtaacatactgatcctcattcgtcatttcataaaggcaatccccaggacaatttggttagatggtgatggcaagcgattgctgcaatggccaatcgaagaggtcgaatcgcttcgaagaaacgaagtcagccatcaaggcttagaactcaagaagggtgatctgtttgagatcaagggaactgatactttacaggctagttccaatttacctcaacaaaagtattatgttttttttttgcagacactgtagctaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccatttggacttgttgttcttgcctctgataacatggacgagcacactactgtgcacttcagggtttacaaatcagagcagaagtacatgggtctcctgtgctctgatctgaagnaaaagggggtttttttaaaaaaatttgggggcccccttttttttttcttatccagattctgtgatgctaagaactccctatttgcattgcactgataaaagtgaaatgatatttgtagaaatctaacctttgacagtnaacactaaaaaaaagg

SEQ ID NO: 24498 - DNA, 9704 bp, Oryza sativa
  unsure (1)..(9704): unsure at all n locations
aataataaatccctctgtcagccgcccaacaaataccagcgtaatcaaatcatatgatgtggcnattaatattagcagcacggttttaaattcccctcgtgatcgcgcaaaaaaaaagggaaaaaatttggggttataaaggaaaccaaaaaggaattgcttccgtatttcatgacatgcaaaatagatgattatagtactttgaaatcgcaaaataaacatgcggacaacctttgttataccacccgtctcacggccaccggcagatcggattattaactactccttgattagctacagtactttggaaaaaaaaacgttgactgatcaaaatttatacggcgacacataaaagtatatcctaaatttatttattttgacgcacattattattgccacaacaaagccatcgcacagaataatactaacatattagcatagtacacgtattccaaatactagtttccactgtgtgcacgacacggtatgtccggacgtgcacgtatctccattgctaacgtattattaccactataaatacaaaccggtcaagtttgaagagtcagtccaccatcggttctgtacatagtaaaataaaataaactagcaatacatacaggaagcataaaagatttaattcaaatccaaatccaaactcaacccaaagcttggcaagggttatacacggcgttgatcatgtggctcacacgcggaggagtaaagacacgagactttctgatccgactagaggccacgtgccacaagcatcacacagaacaagaggcacgcacacgagaaaaacaaaaaccaaaaataaatagggagagagaggaaggggagagttttatagcgtggtgggagtggggagaccagaccaggaaaggagacggagacccgattcgttcccaccttcttgccgcccaccgctctccatctcctcttcttcctcctcctcctcctctcgtcgtcctcgtcgccgtctcgtcttctatttatttaggagtatttttttttcatctatctatctggatctatctataccccccgcctccccgatttttcttcttcttcctcctcttacctcgcgtcgccgccgcgggcgtcagcgctcgcgtcccccgtgtctcgtttcgtccatcacaactcgctctccgtgcggcggcggcggcggcgatccccgatcgggcgactccggcgattgcgaggtaactagcgtctctcctcctcctcctcccttctcgaggttcgctcgatttgggcgcgtgtcgaattcgggaggctggtttgctctgattgggcttgtacagattgcttgcttgcttggtttacgtgcgcagccgcagcgtgcttgttttgctaaaagggcggcttggagaaatttttagctgacatcgaccgagcttgttgcgccgccgccattatcgtgcgacgacttaactgaatccgtttgcagttttctgctatgcggcgtcagttagttcagtttcctccgtgcggggggtggggcagggtgcggtacatgggtgggggcgatgaactgtgtggcacatcgaatttactgcagtaatctgacaagggaattgcaattgtaaggatataagggaactgcttctgctgtgattctcaagtgctgcaaccctaggtggcttccgcagtgcccagcccaggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaattggttgctagctgttagggagtatttttcatctgtcagtcagtggaactcaggtctgcagtaagtttgttcatgattgagagcatatagcttatatctcacccaactgctaacttcaggcagataggaacaattacactttattttgttgcatgctatccccctctgtggatctaaagctttgctgcccatttttagatccatcttgcttgtcatgttttctctacttcattttttaacaacagtttgcaatgcattccgttttgggcaattatatgatatacatttttctgcttattaatcttaacaggttgaaattaatacattgatgctgtatcatcacagaggcggtctttcttaatcttcaatattttcttagagctaaacggttatattttggtgtcttcttagcaacaatgccatctcttcagttattgcaactgacagagcacggacgcaaccttttgtcttcgagaaggtgtgctgttttaacattgtctttctaaattttagtaagtcgatcatttagttcttatctcatgttccttgttctttacaaacatcaacaggagaactcttgcagttgtttctggtgcgttacttgcgggtggaactttagcatatgctcactcagctcggcgccaaaaacgtcaggaagaatattctcatagtgatgcaagtacacagaccacgggtaatcagagcatttgtcaaaatggtgttgatggtaaattggtaaaaacaaggaaaaagaaaaatgggttgaaatccttacaatttctggctgctattttgcttaaaaagattggtccaaatggaataaatcatcttctcggcttgatgataacagctgtaagttcgatggttctctttagtgtgggtgtttttgtttgacattctgataatattgttctgaatttaataacttgtatggccatctatgctctacaccttgaatgtgtattctacttcatggactaagcatattgtgcttgttatctacatttccaagtatttatctgcattttatgctagagtttaatatgttactgagctttgctgacttggttgctgattagttatgatatgttgtatcagttagttaaactctcgatcattgagctatagcataccatgataggaagtaccctttccagccttgtctgactacatgtaaaaactctatagagcttgggttttcatatttcttttatataaataaaatcttgcttctgcaggtgtacgtactgcgttggccacagatagcaaaagtcaggcttaaaaaaattttccccccaaaaaatttttccccaaaggggggggtttgcattttcttcggggtgttccaacctttacacgcctgattatcgaaaatcttcttttatgcttccttcagtccacaatatatcagacctccaagtacttgacagggtccttaggtttgcactttaagaagattttgacagatcttgtccatgctgattactttgaggtatgttgctttatgaagttgaaatcttcattctttttgcaccttaaatttcacatgattacacttactgtttatttttttctttctccacgtatataatctactccctctgtttcatattgtaagtcgtttgactttttcactaatcaaacttctttaagtttgaccaagttaatagaaaaatatagtagtattatcaacacaaaacaaacatattatcaaaatatattaaatgctagctttaatgaaactaatgtagtattttagatgttgctattttttttctataaacttggtcaaacttaacaaagtttgactaggagaaaagtcaaacgacttataatatgaaacggaggaagtaagatacttgatactctccaattacgcagtgaacagctatagttaattcgataggctttgttgatagaataattgatgaacagtgagacaaaatgcttgctacaaacagagcaactgaaaaggttaccttattcctgattatagaaaagcaatagcacaccttaaacaaaaaggaggctatttacttaagtcagttaaaccccatagagttaagtcactcctgttgctgaaatgtacaggaaaatagaattactgtttcatcttttcggagttttcagtctatctgcacgaataccaaattttcccttcttctgtagtgaagtttttgtatattacttgggtttgcagctacttctgtagaatcgttgagtcaaatagatatgaaagttattataggtcacattggaggttctagttatttgactttgactttttgtactcaatagctttccatgatctcatgctgtagagttcatcatgtaaaatgtagatcgattagttagctcatctaatttccttggaaaggtatccaatagtttggtcaattgcttgacgattaatgtgttgaactgcatatttaacattacatgccattgattctttttctcccaccttttgtgtgcagaacatggtttactacaaactctcgcatgtagatcaccggatctcaaatccagaacaaaggattgctagtgatattcctaagttctgctcggaactaagtggactcgtacaggatgatctgactgcagttgcagatgggttaatatacatctggcgcctctgctcttatgcaagtccaaaatatgttctctggattctggtaattaactcccccaccccaccccaatggatgcatgcatgcatgcaccctacaacacacacagagtaaagggttgttacgctttgtgaaatataatatgacaacctctcctgctctttcacgtcaaaaaaggaaatgaaacatcttatgacaatggttgaaaagtagtactcctagtttgagaaaactgtgctaccttaatgtttgtttaatatatattatgactactagcttgctcattattatatagattgtcaacactggtaaattgctttcaggcatatgtacttggtgctggtggtgcaattagaaagttttctcctgcttttgggaaattaaaatccatggagcaacagctagaaggggaatatcggcaggtccattcacgtttgagaacccatgctgagagtgtggcgttttatggtggtgagaacagagaagcatcgcacatcatgcagaggtttcaggctcttgtgaagcatttgaatgttgttcttcatgaaaactggtggtttggcatgattcaggattttcttcttaagtatcttggtgccaccgttggagttatcttgattgttgaacctttctttgctggaaaccttaaacctgaatcatccactttaggacgggcagagatgttgagcaatcttcggtatcatactagcgtcataatatcattatttcagtctcttggaaccctttctatcagttcaagacgcttgaatcttctcaggtaaatgcactgtccttgtgtgaaatgcttgccctgtcatgttatttttttttgggggggggggggggtgcactgtcacatgtttaatggacattgataaagtagttgatgatacttgatggttcttatgatgtcatatgacatgtttaacctttatgtaacctcaggttcatattttgtttatttagtggaactataggttctatctatcatcatcactctagttctttgctactaagaaattagttattcactcttaaacttcgtttctggagtacaaacataaaattttgacttgtggtttctaaggaatatattggtgattcatgttttttgtgtgtatcagtactgttgcgaatatgcaatttaagattatctgttgatatatttgagtccatcatattccaagaatatcttgtgcattacaagtatctatgacttcataattccatttgataaatatctttttgctgattaactttctattctcattaacagtggctatgcagatcgtattcgcgagttactggatgtttcacgtgagctatctggggttcgtgatctatctatgaataaaaaatcttctgtagacaattatatcagcgaagcaaattatatagaattttcgggtgttaaggtaatcatgatggggactactagttcttctgtctgtttggtatgaagaattctaataaatgatttgttacaggtggtgacaccctcagggaacgtcttggttgatgatttaactcttcgggtagagtcgggttctaatcttttgataactggtaataatctataccaaaatatgtgtcctcttagtttggatttgcgattgagctattgcaaattcatcatgcttattgtaatgaaaacctgatatttgcacatcactttttaacacgcccaatacaagttcttttatgattgccatctgatgtaaacattagttgacactgggtaactactgtgctgatgggcaaattgtattatgccgagggaaagggcttaggagaagcgactggaatggacttttggaatgagaacatttattgtttatcttgctcccctcgttggcaataactgtcctttatgtagtgataacacttaacaactgtctaaacttttgatctaaagataatattagataccatgcactccatatatccatggatgtaggttgctgtcggatccctgtgatcaaccttaaatttgactcttaaatgtacgcataattatatatattctttctagacattttgtttgtatatgtgtgacactacttgtatgttttggtgctttttcatgaaagttacagccatggaaactaattttataatgcatgtttgctcattttcaggtcctaatggtagtggaaaaagctcccttttccgggttcttgggggactgtggccacttatgtcaggccacattgtgaaacctggtgttggctctaatcttaacaaagaaattttttatgttccccagcgaccatatacagccgttggaacacttcgggaccagcttatctatccacttacagcagaccaggaaactgaaccacttagctatggtggcatggtggatcttctaaagaatgtaatactcataattatccacttgatagattggcatctttagctgcctcattgcacttgtttgtgactattttgtcccaagtacctagaaagtgttactggaaaaccttagtttttttcttcccttttggtaggtggatctggaatatttgctagaacgctaccctcttgataaggaagttaactggggtgatgaattgtctcttggagagcaacaaagattgggaatggcccggctgttctaccataggccaaagtttgccatcctggatgaatgcactagtgctgtgacaactgatatggaagagcgtttctgcaaaagggttcaagcaatgggcacatcatgcataacaatctctcatcgtccagcattagttgcatttcatgacatcgttttgtctttggatggagaaggagggtggacagttcaggaaaataggttatcctcatgatgatttttatctccttatttatttatatataatatgaaatgcagttctaaaaagttcgttatttctcttgtagaaatggctcctttatctctgctgaaccagagtttgatgcattgaactcatcagaaactgatcgtaaatctgatgcacttgctgttcaaagggcttttattgccaacacaaaggtagttattattccatattgcctgttctgttgttattgattttttatgtaccattcttttaacagattttatttgctagggtaatgctttaatgggccccaaggatcattcttattctacacagctcatagccacttctcccaatatggaaatagaacacacagaacggtcaaatctagttccacaattacagtgctcaccaagacctttgccactccgagctgctgcaatgtcaaaaatactggtgagaaacatacatttttttacgcttatcagtaattcagtatctagtatccactattcagagatctcttcgactcaaatttgctgatcgtccacatgaaataattttctgggatatttgtttggcaggtccctaaattatttgataagcaaggtgggcagttgcttgcagtggcattgcttgttttctctcggacttggatttcagatcgtatagcttcactgaacggttggcttttatcttcatgtactggagatagatctgatggtataccttttacttaatatgttttcacaatcttgataggaacgagcgttaagtatgtcctggagcaggacaaagctgccttccttcggttaattgggattagtgtgctgcaaagtgctgcaaattcaattgtgtcaccatcactaaggtaatattggttccctgcaattgaaatgttcctaccaggatgctttgggggcagtgccaggcaaatactccctccgtcccccaaaaaggcaaaccctgggtttccgtgtccaactttgactgtccgtcttatatgaaaattttttataattcgtattttcattgttgttagatgataaaacatgattaatattttatgcgtgacttgtctttttatttttttcatatttttttcaaataagacgaacggtcaaacgttgggcacgaaaaccagggtttgtctttttttgggacggagggagtagataatacactttttttttaaagtaaagttcctgagcctttttaacatatacttgtcggtgggcttaagttttccttatagttctgatatctgtttatgtttgccagaagaatgtatgttctactttcctagtcaggatatttaactattgtgcattggtaactgattttgtgtattcaaattcacggcttgataaatatttctatgcagaaaccttacttcaaagattgcccttggctggcgaattcgcatgaccaaccatctacttcaatattatttgaaacgaaatgctttttacaaggtaaactctactgatagatttgattgtaaacattgttttcttgcactttctaacatttttttctcttttacttttttttccatgaaagctaagcagtttgagtttttctttttcaggtatttaacatgtcaggcatcgatattgatgcagaccaaagaatcacacatgatgtggagaagttgaccaatgatcttgctggcctagttaccggaatggtgaaaccacttgttgacattctttggtgagtttgtcatggtctaaaatattacccaggtgttctttgattaatcaggttttcttagcaagtccactattactctccaggtttacatggagaatgaagattttgtcagggcgaaggggagttgctattttgtacgcatacatgttgctaggtcttggttttctaagagctgtttcccctgactttggtgatcttgcaaatcaagaacaagaacttgaaggaacattcaggttagtgacatatgatttgcggtcattggcaaagttgactttattactaaggaacttccaagtattgaccttgttaatttcacaggttcatgcactcaagattgcggacacatgctgagtcaatagctttctttggtggtggctccccggaaaaagctgtgagtttttcatgtctcatagatgctgcttaaaatttctagtttccaccctatcttcttnnnnnnnnnnnnnnnnnnnnnnnnnnactcgacctaagggactccatnggtcacttgnnnnnnnnnnngataaacgatcaacttcttatacgttatatcaaacaatgaaaaaggtgagaaagagactctcctatagctattacccaccgtcgggg

SEQ ID NO: 24499 - DNA, 9299 bp, Oryza sativa
ctgtaaatattaagtacccactgttaaaactaactatccaagccactgagagatctcaaaattaagaagttaccaactctcagaaattctaaatcaataacgagaagttttcccccccccccacaaattttttctctaaatcaataacgagaagttttccccatcataagttatggccttatggggcacccatcaaatcctcaatggttattctcagtaaccaagccagtgaggtatcagctcaataatctactaccagtctgttgcactctctgcaaacatatgcttgagtttgaagttatgccgttcaaatatactatgatgctaatttttaatgggtaattaacttctgacatctgcaaactaaagaacagttactgtctatattacagattcttaaatctgtaaactttgtcgaagggtgcaaagatgtaaatcttctgatacatcatgtctataaataaagaaaattctaaattgactgtctttctgctgtttccctggacactgaaaaccatttaggagtagtttttagttggagcccacattcttcagtacaatatcttgtctgatattgtccctgaattaaaaaacatcatgtctggtatacacctgttaactatctttaactttataagaagcaacatgtgctgattttaggaaccttctccttgttcaaagctacaaatcagcacatgttacttcttataaagttacatcttaaacagatttgccattgttgatgaaattgtcaaacttgatgttttgccatttgttatcttaatgctacgaattgtagcttcatatgttactgttgtttttctagatgctgccatgccctctaatcctattattgcggcatcggaagaaattatttccttccatgatgtggatatcgtaacgccatctcaaaagctattggctacccagttatcttgtgatgtatctcaaggaaaaagccttcttgtgactggtacatcatctggcagcttttcgtcctagcttttatttactttcatgtttacattatatgttctaatatctatcatgctgttttcttaaggcccaaatggcagtggcaagagctccatttttagggtgctccgaggtttgtggcccatcgcttcagggaggcttaccatgccgtctgatggcatctttcatgttccgcaacgtccgtatacttgtctaggaaccttgagggatcagatcatatatcccctctctcatgaggaggcagagttgaaggttctttcattatacaaatcaggttagtgccagctaactttgaaaaggaaaaaatatctgcctattttaactaatgaatttttaagcactcctttattttgattatggcttttaacaaacttctatgttgaccatttcctgttctgttatgagcaatgtatttgttggtaatgtaacatcacacccttatccttgatgatgtaggtgacaaggcaataacttctgggtcactggatgatcacctgaagacaattctagagaatgttcgattggtctatcttctagaaagagaagggtgggatgctactcctaactgggaagatattctatccttgggagaacagcagaggctaggcatggtcagtgattttgcttcagcttatatttgttgtctaactaatttccatttgttttttatggatatatacctttactaagtgggtaataaatgctttctttcgttttttatggatatatacctttactaagtgggtaataaatgctttctttccaggctcgtttgttcttccactgtccaaaatttggtatcctagacgagtgcaccaagtatgtagcgtatagttttttaatgttctcatttccattttttaccaataaatgcacagctcttataaagcatactcattgcagtgccacaagtgtcgatgttgaggagcatttgtacaagatagcaactagtatgggcataactgtcatcacctcgtcacaagtaagtatcatctagatacccacttatcctaactcttcaaatggtgaataaaaaaaaaacatggttttcatttctatccattttgtttctagttgatggtattttgcatcttaagcttacatctttgtcagaagtgaaatttgggttgatgatgcctttctctcatttattcatttgcagaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaactttaacttgtccgattccagcatctggtacatatctagggcctgtttgggggagttttagattttagattataagaagcagctgtttggtagccaacttctgagaatctggaaaagctctgaaacccagcttctggctttttagttcatttttttcagaatctgtaattacagattctctgaagctgtggactgtttagggcagcttctagcagaagcagtttttgagaaaagctgtagctgggataagctcccccaaacagggcctgagccatacacgaaatggaacaggaatataaatttgaaaattgctatccatccttcgcccgatctttctgataatcgtcggttgattttgtgagaattggacgcaacgtagtgattcgtatgcgctccggcaagcttatcttcttcagtaatgtagtgattctgattcacgatttcgcatgtactcctgcaggctgcgtttgatttatcttattggccaaggctctgtttagatctcaccttataattttttactctgtcatatcgaacgtttgaacatctacgtgaagtattaaatataggataaaaaaactaattgcacagattgcgtcacaggacgaatcttttaagcctaattgctccatgatttgataatgtggtactacagtaaacatttgttaatgatagataaattaggcttaataaattcatctcgcggtttacagacggattatgtaattagtttttttattagtgtccgaacaccctatgcgacaccctattactatataatatttgatgtgacatgccaaaactttatatccttggataaacaccccccaactattccatcgtttttatgagtactatttctctaaatactaaatggtttgtgagctctgtttctcaaactaacgttttgtacaaaagatatttataaggaggtttattaaaaaaaccacataaatttattttttttaagtttatagcaatcaatataagtcctccctccgtcccataaaaaatccaatcctggagagaccatctgttactactatctccgtcccagaatataagaagttttagagttagatacggtattaaaatatgtaaaattaaatgaggaaagattgtgatttgttaagaaatagaggtcgataagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccgtgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggcggcggcggcggcggctttccacctccccgccggcttcgcgctcccaacctcgccgtcgttcgtcatgttccggctgcgctcctccgctcgcctgctgagagaggtgagccagccaccggcggcctgctacttctagttctagggtttagcgggtgcttctcgcttacgatttcagtatggcttgtggttcgcgttgcagctacgggaggcgtcgcggtcgtcggggcgccgccgggaatggctctccggcggcgcagtagcctccgccgcgcggacgacctcgctcctgcaccctctgcccgggctcgacgtcccgcagtgcctccccgaccagctcggcgtccagcccacccgcgtcaccacgctccccaacggcgtccgcgtcgcctccgaggacctcccggtattggatactctatgttcctctgctgtgctgcggcggcggcggcggcggcggcgacgaggctgacgctgtgtgagggtttctggcgcagggcccgtcggcgtgcgtaggggtgttcgtggattccggctcggtttacgagacggcggagacggccggcgtgtcacacctgctcgagaggctgtccttcaaggacacggcgcaccgcagccacctgcagattgtgcaggatgtggaggccaccggaggaaacatcggggcgtctgcatcaagggagcagacggtgtacagctacgagactctcaaggcctacttgccgcaggccatcgaggtgctcatcgactgtgtccgcaatccattgttcctccaagacgaagtcgagcgacaggtgctggactcatggatagactagcctctaagatacagcttattactagctatttgcagcgcactgattatggttgtttggtttatcaggtggcctttgccagagaagaagttcaggagctacagaagaaccctgagagatttcttcaggaatcacttaatctagttggatacacaggtgctcttgcaaatccactagtagcccctgaggagagtctcacacgaatcaatggcagtattattcaaaagttctatcacgtaattctcttgcttctgtatcacatttgacttataaattactcataaatgcgactcaattcatgctgttcgtagtttccaaacgatgctaaaatgcaagtgtagctctatctctatagctcagtgcctcagttaacaaatttatgaaaaaaaaatctattactgaacaggagaacttcactgctgatcgcttggttgtagcagcatcaggtgttgatcatcaataccttttagatgttgcagagcctttattgtctgattggcacaagggctccccagtggaaaggccagagtctaagtatatcggtggggattttagacatagagcagactcagaggtaatatacttcccatcaacactactttgcctattcttttggggtttccttttgctctaaaattgaaaccctgctcattcctctccctgcagatgacccatgttgctttggctttcgaagtgcccgggggctggcttgaagagagagatgccacaattatgactgtagtacaggtatacttaatgagtgggtatttactaaaaacaatctggcctatgttgacatctgcatcccaactgcactttctaacatatatccatgaatatgccaaaatattttgtagactttaatgggcggtggtggttcattctcttctggtggtcctggaaaagggatgcattcacggctttgtaagtaattatctctcgacaaccatttgactttagtaggattgcaaattgctacaatatggaataatgaatatagattagattgtgcttttaatagccgttgttgtgtaattgctgcttttattttgccgttttagttatttcagttcctaaagttttttttttaaaaaaaaggctataagttgaactgttatttctttgcagatctgaatcattctcttgacaaccatttgatagtaggattgcaaactgctacaatatggaataatgaatatatatttgattgtgtttttaatagccatttttgtgttagtgctgcttgtttagtaccctagtttttttggccgttttagttatttcagttttttaagtttttttttgaaaggctataagttgaactgttatttctttgcagatctgcgtgtcttaactaaataccacacggtcgaatcattttcggtatttagcaatgcatttgatagaagtggcctctttggtatttacttgaccacggtaagctcatctttatacattattctgtgcctcgaattaaatagtgaattatatgaaacatgttgcagcttctaccttgagttgttacttcgtcattttatcaaattgtgtgagtaggacttcaaaagggactagagctggcaaagtctgctttttcaaaattttgaagtgccattgcttcagttcgtttttgagtactagaagtttgaaatactttttttttgtttttttattggtccagccttcagattttgttgcaaaggctgttgatattgcgacaaaagaactgattgctattgcaacacctggacaaggtatatatcatctcctgcttgccaaaactgcttcagcatccactgaagctacctgatctgaaacttgatgcgatttgtatgtatacagtgacagacattgaattggcacgagcgaaaaactcaacaatttctgccgtgctgatgaatcttgaatccagggtaattttggaacccccatccccaatacacacacgcgcacacacacacaaaaatctttctgacccttttcacaggtaagtaacctgctttagtgtacttattttaatttgcaccaggtaattgttgcagaagatatagggaggcagatattgacttatggttgcaggtaaggcaatatctttcacacttcattttttagaagtcttccgcacagaaatcattgattcttttctattctgtcaccacaggaagcctgttgaccattttcttcaatgtatggacgaaatgactctagatgatataacagcttttgccaagaagatgttgtcttcaccacccacaatggctagttggggagatggtatatatgctttatgaatttgcgaaaaatatgaatgacacaaaataagaattaatgtgagttcattgactctccttctgcagttgataaagttcctccatatgaatttgtttgcaagaggttttgaagttctccgacacaatgatcagtggtggacatgaagatgggattttgtttacaatgttgtataatccaattctcgctatatttgggccttatcttagaaattgccctcgttatacacatcacctgatgagattagatttttgctatcatcttcaaacagcatatatcttgtgaaagtccaggtcaaacggaggtgaaagttttgcaatatctctcgaagcaagtttagcgattcctcgtcttgttatgcaaacatgcatatgcacttgtcttattgagtgctctgtaaacaattttcacggcgatgatatataggggttacggtgcggaaattgacaggataatggcatggccttgtttcgacaggacattatgttctcggactgactggtttgacttcagttgctaccgtatattttgtgtttcttttaatgtatggcaaagcaaatcttcagaaaaaaactagtacgaaatgttgcgtctttgcttaactacagagttggataataatggatgaaaagcaacaacactgttgagttcagggaaattgagctccccatcatctgaacttttacaaaacttccaacctgaacttgtacaaaattttcaacacttgctgcaccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggagcctttggctttcttcttcttcttggtgtgatcgattttttttcctttttttttccccttttttttttcttcttgggggatcgattccaggccaccaaattttccatctcgggcaatttcctgatttttgcccttcaactcaagctctggattgttgccttcaccggagaacaccaagtct

SEQ ID NO: 24500 - DNA, 8375 bp, Oryza sativa
  unsure (1)..(8375): unsure at all n locations
ccttcaccggagaacaccaagtctgcaaatggcatttttgtgtcatcaattccgtcggcgtttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggcctccatgggctttgagttaaatatgcgtaggttgggaactaatttcttaacctgagaaaacatccagagttactccagaattgcatacatacagaaaggcagaaaataaacggtattaccttcttggctagaccgtctttctcagcaataggatttccctgcaagtttaggttcctcaagtagtgcaattcagaaaggacctaacccaaaaaaaaagaaaaagaatagaaaaaagatagactgagacagtgtaaagatattatgaatgtagaagggtgggagaaaattaatcagatgcaaacctccaaatctgatctcctctcaattaagttgtttcctaaatcaaggttcaaaattttgacattttttgccaggtctgatggaattgtctgtgaatcagacagagttcagcaagatgttacagagtgaccaagtggaatgtaacatgctttcgagcagaaaaaaaaaacaatgtgcaaaagagacccagacatatgctatccataagtccatatacatacagtgatcttgttgtgagcaagtctaagttccttcagttccacacacgcagtgagagaagaaccaattttttctatccggcactgagataaggatagctgaggaaggtaatgacaaaacattagtcatgtaaaacaggaaaaagtgcatattaaagctgataggtcttttttttttgcaaaactaaataatacaaacctttttcatggcctttgccttcatcaaagcatcaccaatagtgaaaataggattcttggaaagaactgcagcagaaaaacattcagaagtaaattaggtggagggaacatcattattctttgcctgttccaaactggactgtaaaacaactcttttgttgggtgatgggtttgtactacaatatgaaaactgaatatggatgatttataagaaaactggtattttacatgcagaaagaaattgcaatgggcaaggatcttaatgttaaggttcccaaacttactatacttacaaaaactattaacatccttttggtttatcaaaattatcggcacaaatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaacaccttttaggctcacaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaaggttattacgggattcatccttttaactattcaatgtttcagatggatttacccagtgcctatgcttgtagagaacacagtaacaccgacatcgcatatatccatacaggtgaaattcaccaagaatctacaccgatgctaaatttgttgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaattactgtagaagagtatgcgtgctagaaataatacttcacagtcagtgaacaaagcgtgtagcattttgaagacaccatagcccacatgacggacatgctcttgttgtttgatcaggctgttggttctatagctaattatttttccttattttgatggtgcaggcttgtgctctgtacaataattggtggcctatgttagcaggtaattgttagttagttatcctcaatcagtgttgtctaatcctcgtcgaccttcaactgacatttgccatacttctgcagctcttatgtatgtccttgtaccgatgccatgcctattcttcggtggtggatctacccagttcttgactagcagagatggtggagggtatggtttgatttgttgttttcgttccagaaactttaccatacatactgtactacttggatgtaaactaacatatgtaaagaatagtttggaataaggaaattccttctgatttgtagttgtgacaaactaatgatagagtgtttatcatttcaggtggttcaatgctgcaaaattcctgactggtgcatctgccatgggaagcattgcaatcccagcaattctgaggcacgctggcctaattgagactggagccatgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcagaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttgcagaattcctaacctcttctccctcttttcaaaccatctttttattataagaaaaaatactttaaaaattatattaatttatttttcaaatcatgcgttaattcatcgctccgttttttatgtgtatggatgaagttaccaacttcttcaaacggtgcgttcctatatgatatttgtgctgtaaaacaagcagagatatttcacatagcaatcgagcattcagaattttatttaccggccaaaaacaggtaacctctgtcctcttctcagctccggcttgtttttctttttagcgtttttaaaatgtctttatgatttataaataacaatccgcctaatcacaacgaagacagtttggccgagtggtctaaggcgccagatttaggctctggtccgaaagggcgtgggttcaaatcccacagctgtcataatttttcttccttctgattgattttgatttttaatcctctggttttttgcgttcccagatatataggttccgtgctcatggattttcgttctggtgaaatttgcaaggattttcaaatcgtttaaaatgttatcatctcagcgatgaggtaataccgcaatacatcgagcacaacaacccggagagaaatgcagaacgtcagtgtgtgtagctatccagtgaagtatgagattttcagtagttcggtcagaaatatattctagtggacacggttttttcccctcccttttcctttttgttcttttttttttgggggggggggggtggggagtggatagagttcagacagcaaaccaaataaaaaacaaaagaaaatcacaagaggattttgttgacagactgctgctgaaaatcagagtccatggtcaaaaaaaaatagtttttctgcaggaagacccctgaagaagtgaagagagaagatttagagaagaaaaatgtacgagagaggagaaagacagaaacattgggagggtaggcaaatcaggaggcgaggaagtagaagaaaccttttgcaaagtccatgggacaagcaagaagtcttatgaaaatatgctaaatgatgcttagctggctcaaatagattcttcaaggtatattatggttgcagacagttccatttttttttcatttagaaccttattttgcataaatttacattaccaagtcaaacaaactaagtcatgctgaaccttccttaagctggtatgctccatgatattgcaacaaagcaaggtctaaatggaaactgaccatcctgttgaagtaaactaagtactgaatgcttagaaaactcctgtttggaccaatccaagcaagtttcattacttttgtactgctgggtcaccacgccaacaagttaacaaagtctttcacacatctcacatcgccatttggccatttcctctccaatggtcatggccccaataccccagccatggcatcagtggccctttctcatcctcttcttccttgtacttttctcctgtgaatctaatcttccctgcaggaatggtgtagaggccacacagagagtcttcctctatccacagtctccaaaggtctcctctattgtcagcaagggatacagaactggatatcacttccagcctccaaagaactggatcaatggtatgtctgcatgttttccatcagtttttacccttttgactttggctgaatccaaccagaaactgtattatccaatttggtgttccttttgtttcttgattcaagaagaaacagctgccctaattagttagtatcttttctagctgcagaagttaagccgtgtggatgagcttaatttcttgtgtctatatgaatttcatggtatagagaggaggggggaaaggtaggtaggcaactcactgcttgtgtgagctctactgctgattgttgcacacgtttatggtgctgcagattgattttcagtaaaatcgtaatatggttatttctatgtttagattttcgctggaaaatatttaccgctgaaatgttgtatttgtggccgtcttttgacgctaggcatcatatttgtattaacagaacgaacagtacaacaaatgtggagttttctcagataaagctactccacatttgttgtactgttctgttaatactagctccagntagaaaatgttgacctagataattctaaagatttgttctaaaaaaaggggggcccccctttaaaaaccccttttttaaccccccacaataacttttttttctgaatatttagcagatcttttcttaaacataggctagtaactagtaatcaagcatgtactgattcttgaattttcctnctggttgctatgtcttctataa

SEQ ID NO: 24501 - DNA, 2580 bp, Oryza sativa
  unsure (1)..(2580): unsure at all n locations
gtcgtccctaggagtttgaaggccacctcaantcnnttttatacttgcaaagagcaattcctgtaaaggggttatatagcaagggtgatcactttcgtactcacaagtcaaaaaaagggggtttaaaaagcgcccccaaaaaaaacaaccccattaaagatgcanntaaatgatacctttatatcctacatcatggtcattcatatttcatcatcaaatctaagtttattttgtaaaagggtttccaaaagggacttataaaaactaaaatacactcataacattgacaaagtttgtagcaactcctcgtacaaaagcatgaatcacgatttaatttagcactgtgcaggcttgtaccgctttacccacagctactctgatttttagggcctttgcattccattcgattgctagacttatcagagtacaagactttttccctcatttccatttactacactccacgacaccatatacgccgggtcgtctaatggggtttatatcatctcccatctatcactatgcattcgatggggttttatatcatctcccatcattgctacgcatttgatggggtttatatcatctcccatcctccctactcatagatggggtctatatcatctcccatctgaatactatgctcttgacggggtttatatcatctcccatcctcctacaactacatacccatgtggagtataataaacttaataaggtactaggcccagcccatcttgagacagatccatggttgatcggtatacatggttctctggtacaagtgaggatcaataatctttatatgtatatcaatatctccatcataatcagtctagcaaataatatcatctatattatatttattttatatgaataatggtttgatgcaatactaagagtaaaaaattttataaaataggtttttaattagagggagcgtatcctatgcacacaggccctcacgtgtacacaccgtgtacaccaactaaaaattatcaaaaaaattctaggaaaattcatacatatactttcaatagtattacatctacgtgcaaagtcgcatcttcaaattcattctacatagagaataacaaaaaagataaaattctgacaaaattgcaacctcaaaactgtcagattttttgtttttttgttacagttaaaatataatgaatttgacgttaagattttaaccctaggtgtaatacaattgaaagcatgtgtatgattttttctagattttttggtgacattttttagttggtgtgcacgtgtgtacacgtgagggcctgtgtgcataggatatgttgccttaattagaatagaaggatcatcatctatcaatatgatcaaagagagacttgcctgagtttctatagttttttaattttttgaggttaataactgcctagcatttgccgagcctgagtatctgtagttgaaatcgaaattatctagtgccgattgacccattttccattctagctttatgaaacttaatcatgatgtcattgttttccaactaattgaaccatgtgccatgaattaatattaatgatttctatttaggatttaattaagtgcgcgtcgtttcaaatatgcacataataaccctgtattaagctgatacccgatgggtgagagggggatctgactattcttatgttcttatgtaacaggagctctaaggtagtttatcccctcaattcagtattcaatttgtcagaacaagcaactcttagtttatcccctcaattcacagaacaagtaaagatgtaccttctaccatcctcgaacagagctaaaagagcatctgaattaatacttttccaccatccctcggacagagtaactgagttaacttaggctgagtttgagtaggaggagattaagaagattgggaagatacgcaaaacgagatgagctattagagcatgattaattaagtattaattattttaaattttaaaaatggattaatatgattttttaaagtaactttcgtatagaaactttttgtaaaaaatacaccgtttagtagttcaggaaacgcgagcgccggaaacgagacaagctcactcacaatcttctcctgccgaacgctcccttagactacttttttcttttctttttctcttctcttctcaacgtctcagttctcacgcctaggcaggaagatgcaggtgtgcggccgacggcggagcgggcgcggctgtcggcgcaacgggcgctgcgacgcgcggggaagaagctggagagggggagaggagntgngtncncgtgacggannaggtgtcntacncaacattttcttcttttcttcctctccaaatcctcgctattcctctttacacgcttctgctagcgcttattataattatttactgaggttttcctctttttattcccttcttagaggtggcttttttataaacaattatttcgtttttttaataatgcgcatatatgccgttcctttgcgcttaaattgcgcgattttatacagatattcaaatcgcttgattaaagggttcttacatagtatctattggaaacctctaccagtgcctaaaaacg

SEQ ID NO: 24502 - DNA, 33406 bp, Oryza sativa
  unsure (1)..(33406): unsure at all n locations
tgaatatatacgatagggagtaaaagaatatgaagatagttttaaaggagatgggaatagggataataaagaagagagaggtaatgtataagaagaaaagtaatggaaagagaaagaggaagagaagatatgaggagatgtatggaagtagaaggtgttagtatgggaagtgaaaagagtggaaaagaaagaaaagaagagtagtgtggaaggaaaagtgtgaggtaagatttaaaaaaggaaaagtaaaggtgagagatataaattagagaatatatattttttaaatataaataatagattgaaaaatatttaaatatataaattaaataaaaaaataaattttatttatnnttantnnnnnnnnnnnnnannnnnnnnannnntnnnnnannnnnannnnnnnnnnntnntnnnnnnntccgcctctccccatacggagccacggtgggtgagcgggcgagcggcgacctcgctgtcgccagccacgccgcctccacagcgccgcgcagatgctgtcattcggcgccctcggaatcaccaccactacgtcctgcagcgcctgcctttgcacgttcggcgacggctggtacagccggagcacctcgttcagcacgcaccccatcttcgtcagcttccccagcgccgccgcgtcgagaaggcccgaccgcccggccgcctccaccacctcctcccgcaccgccgcctgccactccgggtgccccgccagcatcagcagcgtccacgacagccgctcccgctcaccgcagtgctcgacacgggtagcgacctcatctgggcgcagtacaacgcgccgtgccggaggtgcttcccacagccggcgcctctgtacgcgtcggccaggtccgtgacgtgcgccaacgtgtcgtgctgctcaccgatgtgccaggcgctccagagcccgtggtcccgctgctcgccgcccgacacgggctgcgcgtactacttctcttacggcgacggcacctccaccgacggcatcctcgccaccgagacgttcacgctcggcacggacgccgccgtgcgtggcgtcgcctccgggtgcgggacggagaacctcggcagcatagacaactccttcggcctggtcggcatggggagaggcccaccgtcgctggtgtcgctgaagaagaacgtcttgcactcgtccaccagctcccgcgtcgtcagcttcctctcgcgcccccgcgctcgccttgttccctcccagcagcagctacagcaggtcgttcgtcttcttcctcccgctgcagccgctggtgacgccgcgactcgatgatgtcgagcaggagcgcgtcgatctcccgccccagcttccacgcctcatagttggcgcggcacgccgacgaggcgggtggagcggaacagcatcgcctgcatggcctgcagcttgtggaagaccccagcgccggtggcgtcatcgtcggtgccgatgccgaagctggccttggcgatgatctcggcggcgttccagaccacgcccttctcgatgtcgatgcagctctaccccgacaccaccatgtcgctccactcgcccagcatcttcgacgtcgtctccggatggggagaggcgggcgctagccgccgctcccgccgtcgcgggcgttcgcgccggccgcctcctctccccctctcccgcttcttccccgcgcgccgcagcgcccgctgcgccggcagccgcgcctgctcagccgtcggccgcacacccacatctgcccgcctgcgcgtgagaactaccaagatgagaagataaaaagggaagaaaaaaagatgtgggcccacatcattttctctcgctgacatgtgggccccatatatttattttattattttttactgactagtatgccacgtcagcaaaaccagtcatctatactgccttggatccaaattagacggttttgtatagtttaggggtgaagatttctggttttgtggttaaggaaccttgaaatcttgatgttaagttgagggaacttattcctatttacttccgtttgaattttaaatacacatgtactaatatttacagagttaacagtttcttaaagaaagtcttgttttatagaagtaattttataaatgtatttaataaaactaatttcagattatgacttttctgggggatgtcattggactatctttattaataagaaaatatagttacatcatccacgctcataataaagctaggggctggttcattgatccatatacatgattttcttgaaaaaaaaaagacctagccaattcatgagttacctggtttgcctctctattacaatactcaatagaaaccctatcaaaaccattatgtaaattgttgcaatcttcgtatatggctatcgatgccattgtcaagaaacctccatctaacataatgtcaacaacctacttacaatctatctgaataataaacttattccaaaccatgacttggtgctgatggaaaactaatttcacaagtaatattaaatgggttcttgccatgtacaatatttataagctaaagtatataagttgaaatccgtttctatttcgactttagaatctcaataagaagacctaagtaaccatactctatatcccttagctctagctttaaatactatgctttacatatcagatgttttaaaaaaattcttgctactaaaaaataccaaaaagtatgtccattgaagaatgcagcggcggtgccctgaaccatatctcccgcacattaaggacacacgttattctcctcctgctctaaacaaatcacagacaataaaaaaaagcaatggttgagctagtaggagctccgcttgatccggtaaatgagctaatatcaatctatcatgtgtctatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgatttggacagaattttgttaatcccaagctaggtgttgaccatgggtcaacaatctcccatggtgcccgtggccgtggtgtacgcaacttgtccgcagccgcgaccccgacccgacccgaccagactcggcacccgctttctcattttttttttctttttgccgacttcccccctcagccgccacacgccccctcgccgccggggacctcgagttctagggttagggtttttgccccggctcgccaatccactatcgcccaaggcttcggccccaattcgacgcccgcgggttcaattccgagcgctcccaagtcgaattgtccgcctccaccggtggaattcccatgcctctgagataaggattttgggggagacgcggggtgagccgggcggccatggcggggagctcgaggcccgacctcggcggtggcgggagcttccgcgagggcccgcagctctccggggcgggaaccccgagggcgctggcggagccgcccccgctggcgcagtacctccccctggagtcgttccccgtcggcgaccacaagcagtcgcgcgccacggagcttcggcgggtgctcggcgtcaccgtggaggcggagcagtcgttcgggctggtgcagaccaagccactcccttccatagcgtccgaggaactcaagcggatccgtgggggcgtcgtggagtcgtcggccaaagccaagtacatgctgcttactagttactgcacactactgcttcaatctgcattgctcattaacccgcaaccggtgaaatgttgtgcagggagaaaaccaagtcgctgcaggattctattcagaagctggataagtacaggaacgttgtcacgcggaggcggcagaggagcgaagaaggtgcgactgagaggtcatcagggagtgggtcgggttccctgaggatgggggctcagaacagtatggataatcctggccagcggctgaaggagagggctaagagtgcgaccacaagcaagcgtgtccgctcatcgctagcagcagatgcacgggtttgtacttgtgctactctaaagattcatccagggatttcattttgctcgtttgccactgtctccatcaatgtaaatagttacgtcgatactacaggattacagaattacaatcataagctgctctgttactgtaatataacaaattagtttgaactttcaactggtaattgggcatatgccgcatatcagtgtgcgttggcagttaacatggagtagcaatttaaattttattgcatgctaaaaaatggattccaaatgcaattggacccaattacgtggtcatggttaccaatttgagtgaaggaatacatcctgtgagtagacgtagctgatcaggttaatatggaatgtacttaagcatcctttttgcttattttgtaaagagcagctgaagcttatttttgggtcacttttatgtctttgtatctctttgttgctgtggtatccatgtgagcaatattatattattatatatgagagcacattttcgtcattctaaattcaacttagagctacctatgaggcatggtatttctttttgggcgttatcgtacttgttatgtatttactgtgcttccaattttccttttctttgactcttgtgatatatatttcagttagaagggcgtggtaatgttcctacaaggcaaggtcctctggcggacagtgagaaaagttcctctttggagaaggaaaaaaactctttgaggaatgtcaatgctgcatcagggttttctgaagacaaattacggggcctagctcctggaggtgaaggttgggagaaaaagttgaaacgtaagcgctctgttggaactatgctgaacagaggcaatgacgtagaccgagatgttaaaccgttggttcaacatagaccaaacaatgaagctcgcatgcgatctagtgatggtcttccaattaggtaactttcatacattgttgttacttgttaaccttgttatatgagttagtttctgtacagactttagcttcaaatgaaaacatcattgaaacgagacaatgaggtttactatgccacacactataatgacatcataggtggtactcctatgagcattgaggtctgtcatcatccctttaatgctgtgttgacaggcatggagcttctgctggagcattaggaggaagcaagatggatggaggttctcaacagagtaatgcaggttcccgttatctactgaaggcagacatggactccacttctcttccaaatgaaagaagagagcgccatttagggatagacaaagaacgggttttggtgaaaggaaacaagtaagcatagtaattggtggcattattttagcaatatatgctatgatacaagcacactgatttgcattttggaatgcctttaactctttgtgtgattggttacactgatactttgtatacgcagtttcttgtattttatgagtactccttttttgcggggagatgagtcctgttgaagtgttgattatttctactctataccatgaatgagaaatgatgtactgaatcattcttctcttatttagggcaaatacctctgaggatatgcaacctggaactttaaatcctctgactaagggcaaggcatgcagagcaccaagaactagttcccttgttgttatgaattcatcatccactcttcagcgctcatctggaggaatcgatgaatgggaagaaacaccatccaccaataaatcctctcctttgggaggcactgcaaatcgcaagcgtcccatgactgcaagtgggtcttcacctcctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttccaaggggtgtagctagtaataattcacaagttacaccaagaatggataatatttcatctccagctggtctgtcagaaagcgaagactctgctgctacggaaaataagaacaaggataaaatcagtaatagtggtgattttgagaacgagggcgcaaattcagcccataattcagcagacttaattatctcatcgaagaaaagcaggatactgttaaaagaagagcttgaagatggaagtattcgacggcaagggaggagcggaagaaacactatgcatgttaaagggtgtgcatccatgccaagagagaagttggacagcccagaaacaagaaagctgctgaagagcggaagacctgtatctgaaaagaatgaaaggtgcttgatgattggaacttattgaggttgttagttatatgtatcctaatggaactaattaatttctaaattgattcagtaagttgggccgccctccaacgaagaagggttcagaccgcaaagcatcatctcgacactcggagatcctaaattgtgggttaacagatatatcaggtttcctgaaaggcacctttattatccacctaatgccttcgaattctataaggagttaaggatgttaagagtcttgacattaaactgtgtgtcataggtgaatcagaagatgaccgggaagagcttctagctgctgcaaatgctgcgcgcagtgccattggtgtgcaattctgcaaatcaaagtttcctatatgatttgcagagagctgtaattttattggctcatgcttaataggttccttatcctttctgcagttaatgcatatgctggtccattttggaagaaaatagaaccgatgcttactttcatcagctctgaagatttatctttcttaaagcaccaggttggattctgtttgcccttttgactttgcataagttgctttacatttttgcctgtttgggatgaacttccacttaccagaatctctggtcagattacatttttggaagagcttgagatgggcatgtctaagtcatccgatgaacataatttgaacacatcaactaactacagtgggccattatcaatggtattttgcctgaattactccactacagaatttcaacaaaattcttcaacctgtgtattctgttatatctccactctaaacttcatgcatatggactgatatcctctttccatatgttcttttcataaacagggtcaaaattcatctctgcctcagtcaaattcatgtgtgtcattggagcaaagcgaagcaaatggacccaggacaagagaatctattgatattttgtctcccaatgatgaaaacactgcatctcaaaagacacatgcagaagaattgtttggtggaatggcttccttgacacacaaactcttctctgcttttattgtagaagatggtgataattcttctgaatgcaatggaggagatatacttcttgagttctcaaatgacttccttccttatgctgccaacatgaacttagaaaatgattttgaagctagtgcagtaaaatccaactttggatcaagtcctgatttcaagcactcaaaccatagctcagtgcataacagcatgtccaatggttttacagcttccagcaatttgagggcctcatatagtccaaattcaatttgcagtgagaatgcatcggatgcgataaaatttgcagtatatccagaaaatggtggttttcatgaatttgtgccacatatctcacaacagtatcaaaactgtgcaaaaagtacgcctttaccaccatatgaatatcagtatgaccagttgcctgtgcatgacagagctttaatcgagctgcacagtattgacctttgtccagagatggtatggttcctaaaaaccttccattattttgtaaatttgaagaatatatactgctttcctggttataatgttatatgccaaggtgtttctcaaacatctcaattagcatgaatagaagttgagaccatacattttcttctgttgccagtttgttgctctggttctggtgtttaggagactttgatttcttatgttatgctatgaatgtagatgtagctttctatttatttgcattcctggtggggcatatgtaaattcctgttggcacaaggcacctagtgcatcaatggtgaggaaaaatatcgataaaatgtagatcaccttaagaactgcaaaagtagtgtgctgtaatttgcatttttatcttaaccattgttcttaggagctgcgaagatattagcaaaaactttttatgataataaaatatacaccaatacttcgattggaacagaaaaatactgaaattataactttgatctgagtggaaacagctgaggggtttagaggtcttgaggataggaaaggttagtgcaaggggttggacgccaatcagttgctagagtgactgttgcccctgttcaatcatgagttctactagggtgaaccagtggtgcttattccttgagagagagctgaaacaattttggtgcaaatctttgattcttgtacgaatgctccctactcaatattcttgcttgaaaaagaagtcctgacaattttcttcttccggtagccaaagctggatgatggagaggatgaggacattgataaagttattacggagctgcagaaaagactgtttgagcaggttctctctctctctctctctctctctctctgtgtatgtgtgtgtgtgtgtgtaaccttgtaaagtgtataacgtttctagattagcgaagtataaagaactatagaactagggattctaacttgacttcttattatagtgagagctatgattattcagaagtagtaccccatacaatcatcatcatcccacctcaatttggcctatttgaatgataagggcatggccaaaactactgacacaactggtcgtgtggtcttgccaacttctctagcaagttaactgtgttcagtaaaaatctagcatgatttggggtggattctcttgataggagaatatgtcatagctttctcagtgccaagttttcaagcaagcaattagtagaatagctgagtcggtcttgaaattacttatacattgtgcatcatctgggtatgttatcaccacaaatgagattttcgatcacagttcagggcttcaagcgatcctgatttttctgtatttctcatacttggatgatattctttaggcttcaatatcacataaaatttgtatgagaacacctacatttcattgtgatgtttcctggacagtatttcttttgttacttccagatgtattctgggaaattgatgtgctttttctaagagttaacacctatttaacacttgtgctcctcgacttatttcaggtgaatcaaaagaagtgccaattacataagttggacaaagcaatccgtgatactaaaaatatggaggagaggtattaaatattccacccctatacaactttccattataaacacatatatggaagttataacagcaactaaacttggatttcaggagtctggagcaacatgcaatgaacaagctagtggagatggcatacaaaaaactgatggtacttgaatattcttttggttacattaccacttacttaccttttataagtgtttatactttacacagcattataggttatagaaacagtctaatttataccagacgaataagattaacatcttttttgataatcagattttgggaaaatatgctatagagattcagaatggccatcttatacgatctattttcaaacacctaatagattcctagtagctcggttttgaaaggcattaattgttgcttgttagctttacctgtacaactgagtaaatactgttggtctataatgttactttgtactaatgaatacacatacactttcttaatgttgacctgtgcccctgattgcatgccatatttgttctattttcacagggtggccgtggtagttctagtcataagggtggtctcaataaagctgctaataaggctgcaaaacaagttgcattggcttttgccaagagaacacttgcccggtgccagaaatttgaggaaacagagaaaagctgcttcagagagcctttcctttggaatgtgctgtctgcacctttgccaaagaatgatgcaatagatggtaatacacaaactattgaacagccaaacaagttgcataaaacccagttgttatgttacattaccatcaatataattttctctatgcttcaggtggtctcccaggatctgcagataggccaaagcttttaaagcttgacagaagtccattgagccaaggtatttcactgtttctagcattcttcaacaaatcctagtggaatatggcgtgcagaccttaagtagggatcattaatgtactacttgatgtttgttagaactctttcttcaagagagatgttaagcttctgctgatccttttccaggtactacaaaatggaaaaagagtgaccgagaaagggatcaaaacagagacgcgtctttgaagaattctaattcgaaatcaggacgcaattcgtccggcaatgcaaggagtgagcgtaaaactaagataaaaccgaagcaaaagctagcacagttgtcgacatctggaaatgttcttggaagagttacggagccatcaaatttcgcagcacccggccagagagaatcccatgattggacgagtacgtcgagcacaagacctactcaaccagtcagaaacagcgcagctactgttgcccaggataccttagatgctccattggcaaatttgcctgcaatagatccaatggacatcttggacgtgcctgaaggtaacgacatcagttcgtggtttactgatggtcttgatgattccttacaagattttgacttctccggaggcctagaaatcccagatgacgatcttacccaactgggattcatgtaaactgaaccggtaaatatgtacatgttcatattaattttaagtgttgatcctatgttagcactggcattgcttggttaccgtggtaacggtgactgattagtctcttgtgcccctaagggcagagcttgcaagttgcaactaggaattgattcatttatatatagcgtaaaacttgtagtcgccttgtcgcatatctgcgaccagattattggtcgtatgatgttttatctttctttggccaccaggaaagaaagccagcgtttattcacaaggctctctggagcatttgtggcacacgtcttgatatgatacgagtattaaaactaattagtaataaatcctctgatttggcggagcggacaaagctgtccgagtgcatttctcaagcagttaacagctaaacataagatgagagacgatgggttgtccctccctaggcagaacatcaaatttttgaggtttttttttagagttgaggggggaatgtctgagtagaggagaagatacgcaaggcatgcaaaaagggaattgagaagacaggagaggtggagtagtggtgcaacccacgtctgtcccctctctcgctgcagcttaactgtatctccgatccattcgatcgacgaccaaccacctctccataatatatccactcgtcttaattagtctccaccaattctctctttctctctcaattagtctacgacatttcgttctgtcctcgatcgaattaggaggttcgttgaagaagagaggagagagatcgaggtaggatatttgatatttctttcagatcagtaggtggcttgtcgcttgagcttgacaatggacgtggccggcggcggcgaggaagtcgaggaggtggaggcggttgacggcggcgagcagcagccgccgatggagatcggttggcccaccgacgtccgccacgtcgcccacgtcaccttcgaccggttccatggcttccagggcctccccgtcgagctccagcccgaggtcgccggcaacgcccccagcgcaaggtaagcgtcttcttcttctccatctccggcggccggcgcggcggctgacaactgtattattattatggatatggaatattgcagcaagacggtgttcggcgtgtcgacggagtcgatgcagtgctcgtacgacgcgcgggggaacagcgtcccgagcatcctcctcctgatgcagcggcggctctacgagcagggcgggctgaaggcggagggcatcttccgcatcgccgccgacgacgcccaggagcaggcggtccgggagcagctcaactccggcgtgctcccggagggcggcgtggacgtgcactgcctggcggggctcatcaaggcctggttccgcgagctccccggcgggatgctggactcgctgccggcggcggaggtgacgcggtgccagtccgccgacgactgcgcgaggctgtgcgcgcggctgccggcggcgaaggcggcgctgctggactgggcggtgcagctgatggcggacgtggcgagggaggagcggagcaacaagatgggcagccgcaacgtcgccatggtcttcgcccccaacatgacgcacgccatggatccattcaccgcgctcaagcacgccgtccacgtcatgaacttcctcaccatgctcatcgaccgagctctcaacgacgtccaaacctgcaacaactgatccatcaatataattaagcccaccatgcatctcgattatatatgatcactttaattatagcacgtaattacattgtcattcattcgtagcagggttaattaattaagcttaatcaaaattgtttgttttagtttcattttactttcgtccattactcagtttaattactactacatgtgtcgagagctgacttcttgggtctgactgtacgtagcatcgagcaaatcagctctgtcatgaactacatgcatgttaatcattttattccattctaagagcgtacctgtatggttggttggtctgttaatttgacgtttgagatatttgtgacttgtgagtgcatcaattctcagcattactgttcttttacttgtacagtaatataatcgattttttctacgcctgtttcaacaagaacttaaatttttctccaatgtgatgagatctcgctggtttattatatagtttttgaagtaatttggtgcattgatggcaaagtgcgtgtcttggtaagggaattgggccttgcactcttgcagccgcatatgggcctgatcatcaaagaagacttggtataggcccattaaactcaactgaggcctatcccgggagagtgaaaaagagcgggaaaattagtgatgacgccggattagagggtggtcttcacactaatgataaaaaagaagtgctggtcaatcgtagttttaacaggcacagtgcacaaacagaaataattgccacaagccagctgcgtgtgtcaggactcaggagaggcaggagagggagagagaaaggggaaatcaacctgtccaggagagggctggtaataggaataaaaaaaaaaaaaccctccagtgttcgtcttcgagagagagagagagagagagagagagagaggggggagaaagcgtcttcttcgcctcttttgcgtcctgctctcctcgccgcatcctctcgcgttggtcgttcgtcgcgctcccgttccggaggtaatcctacccacctctattttttttttatttcggtcgatctgccgtgcggcggccgaggcggttgcgatagggatagggcgattctccgatcatgggggtggcaggccggagatgaggtcgccggtcacgcgcgcacccaccagtagcacggcaggctgagcgctaggcgccgagctcgagcaagactgcgcctatctaggctcgagttgggtatgttggggtcggtcggattcggctcgtccgagcttttctcgagctgtttttttttttttgggatttgctattaatcactagtgtgaaaaattttgggtttacactcaaatttctgtccacttgatctgtctcaagatctttgctgcatttgcgggttcagtccgtgtttgggccgcgcccgcttcgtagttttcgtctcaatcggcgcgtctattccttttttttttccttcttgatacgcggattctccaaacgatagctccgccggagaatctcgtcggcgatcggcaatgtctcgtggcggcgggctgtggcgacgccttggcgcttggtgagttggccgcccgtgtgtgtgtcacaagtcacaaccttgaatgaagttatcttccttggctgccggtgaggtcaagtggcaatggcatagacgccggcagccggcgagaaagccacggcgttctaggggtagttgacgaggtggtcggtttgctgctgtggctggcggcaaggcacccacgccatttgcagcggcaaccagtgaggcaaccatggaaacttccatggtaagtcacgttctttgccccccctgttgttttgctcttgttgacgaccatgagagcctggtagatctaatgattgtgtttttctccccctctaatctgttgctggggatggagttagaaggtttgtgatagctagctggataaaatgatttgtgtattctcctcagatctgcttctcagaagaatggatttgtggaggttgagagagtgtcagcagactagcatttcattttgcaattaccagaccactagatttctgatgtgaggaagtatcattatgtgaacggcaaagcattttgttgctgccccttttttatctttatgtcaaaaaaatctagtggaattgggcagcatacatgatcctaaacattagaacgttttgcatgttgaaataaatttactatcttgatttagatagggtgataatttttgggatcagttttctatacatacctttgtgtccctatattttttttcttaaaaaatatttgtttctataaggtttattttcttggaatgtcttgcctcactacaagaaacagaatgtttccaagatcaagcctttcatgcagcacttgcctgcaactaggactgtagtaacaagttactccctccattcttatttagttgttgatttgagctaaaatacactgaccaaagtagcacttaatttttagtattgtgacatgattacctctaattactctccctgctaaaatacacgttttgcatttgtgatactataagcacttgagcatggtttatttgacaaattaattctttgaactgcattctcccgatggttgtcatgttcatcgaaatttgttcagttcccaaacaaaagctttgttacatctaaactttctgttttgcttttgctgtttgccttctagcatttgtttgttctatatacgagcacttgaaacaactagctctgttagaatgttttgcagctaaaactagttaaaactagttctcgttttgttcggggaaagggcgaggggttgaggtttgacaatttctcccccttcgtagcttccttaatatagttagtattgttttctacgcatctaccaagaacaagaatacctagttttgtaagcaaatttgaattaaagttagataaggttatgttctgtttttgttattcattctccctttttatcttcctttgttaagagtcgagtgcacctgcatttacagaggttttgattgttgacattgtagtagttttgtggattgatttgttttgtttgaacaaaattagattgttttcactgaaacatgattagcaaaaacttgtttattattagagatgtgtacttcttctaatagtactttgtagcagcagaagtaggggatcaagttagtttaaacctaaaatttgttctgttaaatatttcattaacagtagaaatgtagaaatttgtgttctgtgatccaaacatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggaacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaagcatgctcaaaacatcattagtatcatccattagtattgaccagatagtccttgctttgcttctagctagttgacagtgcatgcatatcattgagagaacaaaatctgcttgtcttctattatctatcagcgttgatcagcaacaaatcctttgttgttacagtacctagtatatacctgttggtactgtcttttgctagtttatcttactactagttcaaatcattttgcaatccattcagtccatccaagtctattgcatccttcaatttgtcgaagttatgtcaatccatctcttcatcgtcttttctacatcaccaattccctgtcagagttggctttcatcatcaccagctcccagtcggagctagccttcattgtcacttcatcatctccacgtcggagcttctcgtcatcatcatcatcatcatcaatcagtgaaggtccgaagaacaatttgtgaagggccttcatcaacatcaatatctcatcatcagtcaaaggaccgaagaatagtttgtgaaggttcattgtcttcatcatcaacaacatctctgaatcaatgaagagccgaagaacggttcgtgaaggcttcaaggtaccgagggccgaagaacagtttgtgaaggttccgaggtccacttcattgaggaggggatacatcttttcttcttcatcatccaagaattggctcacttcgacgacatcatcaagactttggagataggctaatatttagtttgtgttctcttgtttagttttcactccaaatgcaatgttattgtatacacattacatttgagtgggggtgttaagaatatatgtattagtgtgtttgtgttaaggggtatttctatctttttgcgttgtactcttctcaacatattagcccttagggccaactcaatggatgaatagttcaatccccaaatttctctcctctctcaagaattcacaagacaatcccttttctttagaaaataaagtcggaaattttaagctacgcgggaagcctctggcagtttaggcccctctcattgtcgataaactaatattaatggacacttatatttattttgtaggatgatgaatagtgatatccaaacccgcaaagaattcttccgtaaggctacatcatatggagaatgcatagttttggatcataagcggaagttaaaggattttgatggaagtctcttggatctcagtgaagctgaatatgctatcggaccactacattcgaaatgtctcgtaaaatattttgataaagtggatcgtaaaaaggcaaatgcatattctttgctgaaaaacattcggcatcataacatcgtgtttctaaaaaacttttttgatggaagtggccaacccagatttgtatttaactgggtagatggaagcatgagtgcatgggttaaaaccgaaggtgccaaagtacttctgaagagaacagggacgggtacctgtcgaaactccacaatccgtcagcttgtaaggtagtaagttaaaaaaacaatttatggaataacacgttgaatagaatgaacaaaagatgtgttttctttcttagggatttgtgcagtggactggaatgtctatttgagcatggtatctatccaattcaaatcactgccaaggacatctatgtgaaaaaagttgggaaaaatgccttggcgcaacttcttatcgaagaaggtacctacccatatataatgcattttctgctgctctgttcccttgaagaaatttcctactgtaacacgtttttgactgaactagtttaccttcaatctagcttccatgccatgattgagttcctctctaaaatatgtttgtgcagctgaagctttgccaaaaagtgatgctaggaaaaggcaaatccaggcaaatctttggcatgaaatgagagatgcggtgaagaaaatctttgctgatcatgtggattcccccaaagacatgcccctcgtgagattccttgattacattgcagagggcaatgtgaagacgctacagaggtatccgttggattgggatgaaactgagaaggggaaatacttgttgaaggtcttgtgtatgaacccacataaggtagagcaggaggttaacaacctcatacagtggccacctgtgacctacttggggaatttaccatcccctcttcaggagatgataagttatgaccaaacaagaagccacccatctggttacgatgataagaaaccatatcactacctaaagctgtgcaaaaatataatcaagcattggtggctattgccagaaagtgttaaggtagtgaaaattgaaaatattcttttctataatttttttattctgatccttttatgtgtcttacaccttaactttaataggtggaatgcaaaacatggcaaaggctcatccaaaaaatggaaacatgggatcctaagatatggtgtaagctttacgagacattcggttgatcaagcaggtacttatgctccaatatctatataatataaccttttccaaaacttgttgcagtagctaaggtaatggaaaaaaagatggaatttgttcagatttagagagcaacaagtggatagagggctgtgaaatggaataaaatccaacatggttgtgaaaagatacaactgaatggggaaaaggacaaactcatttggactttaacaaaaaaatggaatgttcacagtaaaatcattctattctgctatggaacttcaagaaagtggctatcgttttaaaataaactgtggtaatttaagatgccattataatcaaagtgttgttgatgaggagttttgctctatctcttggattgaatttgacaatgtgtcgtagcttgctgcttgtttaagtcatctaggcagtcaggctatcagtaggggtagatttgagggtcagcctcttttctgctttgttcaaactttgtagtctcatttctgatatatggaaatgggaggggctgagctcctcttgattaaaaaaaaaagtagtaagtacttatgcacccctgttccatattttatcaaaatgttctgccacacgattccatgtaaatattatagttcattctttgttttacaggaaggcaaacgaagctgacgatgggataggcatatagcatgtttttactccagtgcagcatctgagtcgccctcttctttctttctttgtggtcccatctgtcttgaacagccagttatgtaatgttactccagaccaggatgttcgaccttctgaatctgtgttcttcttgttagtaacaccttgctttagtgttaaactaaaatgcttgacacatagtttgatgattgatggatgacttttttttcattgcctgaatattttgtgttcgagagctggaagtctggaactattcagatttcagggcttcgggggtacttatagtacttcttacttacatcagcgttatactattgctgtgctccagcatttccacgatgttattttgtggcgtgcttcttctggcgacattgctccctgttggccatgacacatgcaaattaaccggaaacaaaatacggctaggaagtatccgcggggaacagtaaatgggctaggcgatttgggcttatcgagcgggtatactagaggatggggcgcgccgcctgtaaatttggaggaacagctgaaaattattaaggtacttaggtaactaaacataccagctgacaatgagtatctggttacaaacatggaataaacctgttgatcatccagtttcttacagtgagtatgaacgtgatattttcatgcataacttactcgtacaaatcatttcatgtatacaacaaggtagaaataatagaaaaaatattaatcttacagattgctttaatgtctgtatagtatgagcattggttacaccatgaagagcgatgtcataataaaaagtcatattgaattagtgaattggtcgattcttagaaagccagacccatgcggtcagattcgtgtggatacactcagcgtcacttcatctcttgaaatctcttcagtaaaagatgaaatgagacattagtttcatgagcatcacatgcaatcaccttagtaacactttggccaagttagcacaaaaatgaaaccatgcacgaaagaaccttgtttccaagtcaatcgatgtgagtgctattatagacgatccatgtttcttccacaataacatacacaacctagtgattgtgcaaatgctacaacgaagatctatatcaaccaggacgtaccagaggagatataagaccggtgcggcgggtagacctaggagggcagacctaggagatgcgcagaaccaagctggcgagcagtgggagctccttgtccagccagccgggctctgggaatagtcgcacggatatcaactggctcttctccaacaacatggacctgcattttttttcttcttttagccatcgaacaattgacatgagccaagattcaatcaaactaacaacaaatcacacataattggatcaaataggtgccagatttgataggatcagggcataggatatgttagcatatttcaattccaaaatcgtccatatagagggcaaataattcaacataaatgatgagcttaacaacaatagggaggcaagtaagcaatgaaaggaaacactaacctgcatagtacatggaagatatttcccatcaaatgtgaccacacgatcttttccatcagcaccatgtaccttgtttttccatcagcacctacctagtcaaccgaacagtagaagtcgatagctgacatgctgcagtaggaagcaattaccctaatgcattattttttttgcaaaggatataagcatgtcgaccaaaattacacagtcagtagcctttaaatacatactattagtccgcatcctaatactcacatttccacctgttaccaattaccactattgaaagaatatagtgattgatctagacaacgaaatactgaaaccccaggggtgggtggctttatataattttttgagtgaaaggtgcttactttacatcagttctcactatatacaaacctaagcttatcagttcattaaccgtatcgcgtgactctgtattacatggacaaatagaaaatagaatgcaataggcagaaatcttacatttcattgccaaacttctcatcgataatttctttgatgctctccacaaaatgtacaacagatttattcaacctgtgtccaatatataataaaaaaacctattaatatgaattgccatcttgtgtatctaagcaagaaagcagactgatcaacataatctattagaaaacaaatagaccaaattagaatccacctagcttatgaatatgatagcaccactctttaatctatcttaagaaccgaaggaaatcaagcctagaatatagatgacaatcaaattttagacacagagaaagatccttttgttgcgtacagtgtactacgctgccaccatcacccataactttatgtgaggcaccgttgcttctagggatgaaaatggccgaaaacaatatcattactttattgtttttgacggaaacggtcgggaaatttccattttcttgaattcaactatttagtgtcaacttcaatgccactctgacaaaaattggaaaagctaaattttagacagcaacagtcagtaaaattattattatcatattagttttgcggaaacggtatcgatgtggtcggaaaatttccatactattttcaccctagccgcttcactacttctactgcttacctagtcctgactgcaagaaagcacaactacattcaagataaccaatcacacatgtcattgaattcatgatttgactaaagatcattttttttatgaattaaaatcttagacacaaagacatgaactctacctaaatgatactatagaattgcttggaacaaattatatttacgcatacttagttattagtaaaagctacagaaatgtacagcaattcaacatcaacataggtgggtttcatgacatcagtttgaataaaaaaaattgacgtagcaaatgcctatattcaaaatagtaataggtagtaatatggtggaagaacaacattaccagtgcacaaccctctccgcagcttccaattcatacatgtaacaaagcaattgtagcttgcatgctcctcttctcatcaggccttcctcgcattgcctgtcatcttgacagtgacaagaacctactctgccactagcacgcaagcctcaaattcatcggttgaccaacataggaatcagctactggattgataatctagttcaatataattatatcttatcagctagcatacaaaagcacgtagatagaaaaagacaaaagagcagataacttacaaaaaatctataaatctcttgctgcaggttgcaccacctatgatgaatggctgaggatacctataatttttttttaagataatagatgcctgtaggtagcatcctccaatccaaacatagcttttaaaaatacataaaactggaaggtatcacaaaactcaacagtaactacttcctgaaacatacctgaatcacttagtaagaaatccatccccaccacactatccaacactgaagatttaccaggattctgttgaccataccagtaaagttcaaatgtcaaattacaacattacttttccaaccatgcatataggaatgcaaacgtgcttaaaatattaatgaaagcagtaatctagttgagaaaatagcactgaactctgacaagcttgacttggagtggcttgaagctgatttccatgtctgcccggtcgtccggcaaactcaccagcttgctgtcaggctgtgacaaaatagagaacaccacatatttgcacagtttgcatagaaaaaactgaccatttggagaaaatttgcattgcaaggtggtaaaaataggtactttggggacctggccaaggtcctgcaagaacttcttgataggatggccatgatctctttccaatttgggctcggtgttgtgatgcagttaacaggctaggaaaatgcatcaatgaatgaccctgcatttattaatatgaaagtcagttgtaatgccactttaatctttaatatctgcaattgcttgcctctgcagctcactgaatcaagttatggaaaagttcttcgcaacaaaactaaaatgttctagccatttaatgaactctacgaagcatggattctatcattaaaaagaagtaaagatgtaaactgtgtataaaaagaattgcaatacagccaacacattcatagcgcatgacccaattcactcaaagcaaacaaaggaagcgaaaagaagatggaaacatatgcaaatgcagacacatgcagcaactgaaaccaaaaaaaaaaagtccataaattggaccacgagaattccccgtcagctaacaatcaagcaaaccactgccggaatcaagcaaacattgaactggccagctctttcttacaggaattcagcaagagaaaaaaaagaaacacaaaaaaatttaaggaacacacaatgacagttttacacaaaattagggagggtaaaaggaagttatcttaattaagtaaatataaggcataaaataaacaatgtaaaattatccttgtcctgaaaaggaaaattagcattctatcgtaaatgcaacatgtagaaacttaaaattagccgcaccaaaccatgcctcctagaaaaatgactctttgacagttattggtataatacccatcacgatacttcagatgagacagggatgcaaagtataaacaatatatctacatataatagctaagctcacctacatagaatggaaaggcagaaaacaatatcataagcaagtccagatagcagtcatcacgtcaacaacattagtcatcctgcttgatctgaaaaagaaagcaacaactgtttagcatccaagaattagactgatgttcagtctcaaatgcaaggaaaaacactaaatgggttactaatataacagagcattattctagactatttccatctaagaatatattgcatcaaaacagaaacaaggtcgacacatgaataatttcttagcactgtagtgatgtaaatggaatctagtatatgacacaatgctactggtgtaataggacatcctagctaggaaatattactgctgccttctaatcatcaccgaataaatagacaaattatgtaaccttgttttttccccagctgataaaaaaccctctatacttcaaccaaaaaaactattccctgcagatgtgtagaaaaaaaactaagtagatgatacatcatgatagtaacccttttctcttgtgagaaggcgcctctgttccaatgatatgtatggacctgacattgacaatgatgcaacgcatatcatcttgcaaagattggttcaaacacaagtagcagttcttttttttagatggtacatagataacaaacaataatgatagctctaagatgccaacaagaaagggatggaccaaggttggcacaaccctttatgtgctgctgatcccttctgcccacctacgtatctctcccttattcgtatgctttttatgatctagtttttgtttggggacacagatcctctgccattgtgtgtagtagacagtggtagtagtattatcatgcacaacacatggctctgacaaaatgaatagttggtcatgttcctctcagacaaaaaagaaagaaaatccaactcttttcggttctggaccctttttgctgcctacccatgcccaacaacagaggatccttaattgcttcctagggtttgttttttttttctgttcaggattcatctagttatgcagctattgatccaattagtttgcttattgcgttgtcatcaagctgaaaaaaatttatgtaagaggtttcaggtatacaggcttacttccagttggtgaagggcgagagggcactcgctgaggaacttgatggtgagcatgatgagaaccgggacggagtccttgcgggtatcatgaggtcgatcatggtgtcagagatgagtttgtcggtgagctcattgctgccgtctccgatgaggacatcgatggcgtcccgcggcggccctccttgccctcttgtcctggatgatcctttgtatcagcctcgccatcttcttcttggcctgaccaccaccaccacacacacacatcccaggttcagatttcaaaggttaacatgtaacatctccaattcagtgtcaataaggttactgctgtaagcaaacatgtatttttccacacactgtggttgaaacaataatacaagcatttatgttttttcaaataaagtcctgaaagtaaaatgagcaatgcaaaaagaaatccagatgttttctatattgaaatgttctttttgctacaacatgacaggccttacatcaagaaagttaacacaaagaaggttaatatgccccaaaaaattatatttccactatggtaaaatttcaattaaataatgtcaaaggttaatcagtgaaacatacaaaatcataaagattcaacctgtgaaggtgaacttgcccttttaccaacaggatgcctttgtctactttgtattaaaatacaaccattgtttaataaaattttaaaaaatgtgctactgaaagtataacaattcccatatgttgataaacaaaattgaagcagggactgccaatataataatccattcaattaatggtccaaaaatggcagcaagccagcaacgcatgccgctgaataaaaacattaaactgaaggcccagacaaaatgagcacctaagaaaaaaagaccatatgcggataatgaagaaccataagactgaattacttgggatgcttgtgcccacaagaaatctcggagccacccattaatcgtagtggaactctgtgcaaagtttccccctgtgatatgagttaccaccccttgatcacttatagtaccccaaacatccgattgcattttccaactgaaatggaaaatgactaccgaaatggaattgtacatccagaatagacataagaaaacatgatcccaggcggatacttgatatgttccccctcgcccaagccaatcgcaagggaagcgaaaaccaagatttgctttatcgggtatcaaacggaaactgcgagcaaataaaacaactttcaaaagtattaaactcaccgcaagttatcttgctccaattgttagcatacactgtgaccaattcaccctacaatgaagaagagcgactcatcaaattaacatgcatagttcctaggtgtaattactgccatagtaaaataaccatgtgtctgtggtgtggataattctgtttagaagttcaagcccatgaattaacaacagatttcaagcacactcatattatcagtgcacaagcacatagtacaattatttctctgcagaaaaataagaataggcagacattttattcccatgaacatacactgacatatgcataacaattaatcattagcagatcaatttttctatctatgttgtccttgagacatgtgtgtaggtgaacatacactgacatatgcataacaattaatcacagcatgatgtttactgtagtgagatttcaattctatgtagaaagatctacattttcatcatattggagtcaggaagggtacaataacagcagcatatgcttagataaatggataaattctggtacctagaccaacattcaaatatactagatactgggacgcgccacctatacacaattcttgttattaattgtttatacagttaaataacatataacaattagaaatgtacaaggcgagagacgaagaaaggaacactcacaattttgtgctgaacttattgaagaaaaaacatatagatacaaaacaaaattcacgagtccagcctgacgttaaaccatgtaagcagatgcattggcttgaaccctccattttcaaccaatttgtagtgatatccttttgggtggggttgggtgtgggggggggggtgcatgctgggccagccagtgtcactgacaaaacacaagtaaaatggcttgcaacaaaaaatatatttccacattttccttcttaagtagcttgcaaaaatatactctagtcagtttatctggtttactgcttcaactataagttaagtcccttaatttgtcaacgaatccgatttcatccttcaaactgaaaatcagatataacaggtatgtggcatatgaagcaaaattaacaatttaaaaataaaaacaaaatatttagacccacatgtcagtcaaattataagattaaaaataatggaccccacttcctccacttcatcatctccctttctcttctctatctcctccccttcttccccagatgcgtggcattggtgagagcggaggcgcagcggaggccggcgagtgggggcgtgacggggagggaggagcttcaatacggcggaactataaaaaggccctaatcccaaccaacacctgcatgtaaccaacaagtgcgatgaccaaatttttcgcacgaactccacagcgcttcacgatctgaaccaacatcccgatcaccgatactaaccaaaacgaaaacgacctaactgcatctccaacaaatcggcgagatctatatttccacctaaatcttccatagcctctcacgaataatcaagatacatttgtgtaaaccaagcagctgcaggttgtgatgataagttttttctatgatccttgtccttgtttgttttggcggtatttgtgattatcagtgatatagatgattggggggggggggggtattatctttatatgatcatcagcatgtccttgttatgttgttaggaatagtatgcgtaccttcaaggtcaacttttggaggagactgtctcagatgaaggctgatcacgagccgtcagcgagcaacaagagactccctgttattaaccataattacaaaaggtaattatttcaatcagcatgagttattgttggctgtgtacatccaatcggatgtagaggccaggttaatcccattttctaaaaaagcatgagttattgttgcatgaaactaattatcagaagcatatcataagagaatatatatgtaaacaattatgtatgtcgcctgagtttgataaattccttctcctccctattagatttatcttttattccactgatgggaagtcttcatatatgtaacattctgaagatttgttcttcatatatgtaacgttctaagaacaattacctctaatcaagagacagcataagcatatgttgtccaatttgcagtaatcggtatgctaccttgacgccccagatgatgaggcagaagatggtgaacaggaggacgaagcactgaagcagaggaatccgaggaggatctggcagcggcgggagatgccgctgtcgccagcgcggtccttgtccggtccctcgtgcgctcgccggacttgcgggccccgtcgcggagggtgccggagaagcggctgacggaggaggaccggagtggcgacaggatgcggccggcgaggacggcggagtggcggcgtgcggatggggaaggcgaggacggcggcggggcggcgcgatgtggaccgggaggggcggcctgcagcggggcgacgcggcggatgggaaggcgaggacggcggcggggcgaggaaggagaaggtagttgcattttttttacttacgcggacgcggaggagacagtcagagcaatgtcgtccgttggtaaaataaaaataaatcagtactctcttcgtcccacagggattttgtgataaaaaaataaaaataaattagtaatcccttcgtaccacaatacaagggattttgagtttttgattgcaacgtttgatcactcgtcttattcaatttttttttacaaatataaaaaagggtgaatagctaaaatggtccaccaagttttatctgaggctcagtttagtccttaatattccaatctatccatattagtccttcaagttttcattttaattcaaacttatctttgaaccaacaactctctttataaatgacacttatacccctcatcattcacatatataagagaaaaattgcatgcttaatttttttatagataatacacagtatattatgtaaaacgaaaaaaaattatgtactaacaagtatatacgatagcaattgcttaagttttatgtgcacatgttgaaataatgggaagtacatctgtaatgttgtttatttatgtttgctttctcttttctagtatatagatgtatacaaattaagggcaaaaaggacattttctaatagaaatattgactagaaaaagccatatgacatattaagtggacccaaggatgatttcaagccaaaacaaatatttgaaggacctatgtggacaaaatgaaacgtgaaggaccaaattgagccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatgcggaaaatgaataagattttgtataaaaataatgaactgggtatttttttttcaaccttctgagtcctttcatgcaaacaacaataattgttttctcttgataacaaagcatgaactcctggttatcggtctgtaccttgttcagtgcctttcataattagtttaagaatttctaatacactggatgttttagaaccttccattactgggagttgcaaaagttaattggagataatctaaatgaatccctttattagtgttgttctgaaaatagaaatgataggccattttcttttctgcagtttcctaccaaagaaaggtgcttaacaatttgttgtcacaaaccagaatggccccaggcacatcaggtagtatgcccacctcttaaatatactgcatattttttaatgtcttagtattagtatgtacctttgcatttttgtgcagcacaaatggtgataatttaagcttccattagtgaaaatttcttgttttagagaattagctcgtatagaaaattataatgacttggttgtcattgaaactgaagttcttttaaaatttactttaggtcagccggagagcaaggggcagaaaaaaacggtacaagtctaattctacctcttttttcatataaaactttcactgaatatttttatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcagaagaaggaggatgttgactgcatttctgtatggcatgagccttacacaggcaatcttcttgcatatttggaatctactttgttaggggccaaacatatggttggggaaaaggttgtgctcccaacacctgtgctacagaatcttataaggtgtgtctttgttgccagctttacgtaatgcattaagatatataaagtcatgtaatagtattgttgttttagtcaagtttttgatggattgaagatgctgaggctctgtgggaaataccatggaaactttacacttgagaagacatactattacaagaagaatggaaatgaaatcattgtgaaacttgctaattttgaagttaaaggtaatgcaacctatcgaccgttgagatacaagatcaccatttagggtagaaacaagtagagatatgtaagcacattatttagatgacgttttcaatataattaatgtttcaatttcagatcaggtgaagtctactccagtattgcaagctaaggactgccaggctgttggtgatgcactcagaaagatctcaaagatggctaaagatcgaaaagatcttgattttgattgcannnnnnnnnnnnnnnnnnnnnnnnnnnnnnnnnnnnnnnnnnnnatatcaactnttgatntccagctcttct

SEQ ID NO: 24503 - DNA, 739 bp, Oryza sativa
  unsure (1)..(739): unsure at all n locations
cacggtttggacactctnnnnnnnnnnnnnnnnnnnnnnnnnnnnnnnnnnnnttgttgcttttgaacatctggtacagatctgttagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24504 - DNA, 732 bp, Oryza sativa
  unsure (1)..(732): unsure at all n locations
acgccattagancngcntctnggtacccattcaatggcgcggaatggacggaaccctaacggcgatgatatttttggggattttgttccaaaattaccatcaccgttaggttttcgtccattccgcatttgggataaaactgttttgtacgatgtttttttttagaactcacatttttcgatgacatttgttagatttggacacttgtcaatgacattccttgaattaaaaactgtacgttgagagaactgaatacccattcaaatttgtttgacgttagaagaacagagtttagcttttccaacatcaacttctttttactagagtgagtactggttatagctgcagattatctgttcatggttgcaaagttacaggtgacacaattcacggtaaaaaagaaaatctcacagcagagtagttaaaacagaatgacaaatgcctttgccagcatgatgcacatagaagtgaatgaatgaatgaatgaaggcggttgtgaatgtggacacaacgcactgatgaatcccctaatgatttttatcaaaatgattaagttaaggtagatacacatcttgtcatatgatcaaatggtttcgccaaaaatcaataatcagacaacacaatgtgcgaactcgatattttacacgactctctttacaattctgcccgaattacacttaaaacgactcaacagcttaacggtggcttgccacgccttacttgactgtgaaa

SEQ ID NO: 24505 - DNA, 4572 bp, Oryza sativa
  unsure (1)..(4572): unsure at all n locations
acgccatgttgatctacntctcggtaccccttatgaacttattatgatcggtcgccaaatcaaaagtagcctgctccttggttggcagctgttaattggattattatgcaataagtggccatttcctcttgggtatataaataagcgtgggggatagacttctatctgataactcgtatataccttgttgatgaccagacctggcaatttatactctggctgttatttgggctatggagtactatgtaacatggatggttttctggaggaagcaatcccattgctgttgcacttacattttgaaaaatgtttgctaacagtatttgcaatagtccaccaatatatgagttattcccttttgtccttttttcattcttttttgtttcaagcagcactaagctctaaacctgatatgttggtgctgaccactaaacctgaaatgtcagcttcatggtggcatgaataacttctacgttatgttattaaattgaggtgatggtgttatttagacggtaaggtttctggtgttttcccccccttactgcttaggttctggtgagatttgataattttccactctttagatttctgttatgatgatttgccatcttggcgcacacatcattgactcagaggaccccacatgtaattgccatggggtggcaagcttcaatctgaagagtggcacatcatcaaatctgcctcttttatgtgaatgggtatttctcagtttgttaattgtacttttctatgcttatcttgttgcatttctgttctctaatatatccgcgtgctttccgttgtattcatattgagagtgccataattaatatgctgtcttccgttagttatcctgtggtacaactcaacatttgcaatagcttgttcatacatcattgaattatttataacctatggtacaactctagatagctacaatctttcccggcctacataatgtatttacagaattaaagtagttataactttggaagaaattatttgtaagctcatttcttctccttgattgtattacatattgtcagctaatcaactccagctgaagccgttcaagtcaaaatgtctataaccttgatcgttatcatctatattgtgagtatttagatcaagattcttccctgaactttgttgatcaaaatctagtagcttgctttctctttgatagtcaactgtttgtcttttgcagcttggttcatcaagatatagcttctctacatttatttctttgcttcctgatgttgaactggttgtgctgcctccgccattcttttgaggcgtgatatactcatgtagaacctctgtatcactgtcacttccctctgatttgtgatactgtttaccgctatacagatgacccattctacgctcacttaagcttctgttaagggaatattgagattcttgatcttgggactgttttcggcaaaataatgtactatcatcatatgctttgagtaccccgtggttttgtagcctatgctccttgaatccttcagctgcagtcaaacagttattggctgaactttcaacaaactggatttgccttggctctagtctgtgtatacttgaactttctcttatttctgtaactgcgttgctgagacattcatttgaaacttgtgagaccagttctgatatttttatttttgcatcttccaggcttgcagggcccaagttctgcttcccaagggtctcttgagcttgctcaagaactgcctgcagatacttcccttgggcttctatccgcagctgtagatgccgttgtacctgataccaaattagcttcaggttagaaccattgagccaattcatattgttgatactatatgcattatattaatcttagctgttttctaaaaatagtttgctgccaaactggaggagagtatccaagttctctaatctttacataatactgtctattctattgtacaatgatttgagaatatagttagaaaatagtgttatgaaaggaatttttggggtagatctacccgatcaattacatatgtccaatcttattcataaagatactggtaccgaattctaaaggtttggctggatgtattctgaacatcgcttaacttttactagagggagaaagttatcttgggggtcattcctggtgggaatcactgttgtgaaggatccaaaaaagatgatacagcattcatagcagttttcttatgctcttagttggtatgtgggcatgctgactgaatgctcgaatttttttttatcttatgtcatgtccatctactctatgggcctatcgtgggttaagatcttattatgcaaacagggtcagtacctcacctcaagttgttcatttagctgcctctgcacctcaatttgcatctgtagtgcttcaccgatttgaatagttcttgcacccaataaaagggactattacttcactattcagatggattacaattataaagtacatgggaaatttcttacttctctgcctgtggaatggcgcttgcactggccatcgctaatgcacttgttccaggaatcctatcagcaacacctgtacatccaagggctgcaaattgtcatcatccatgagttgctatgtggctattgtagtggtaacaatggaaattaaacttgtttttaccattctttgttgtcccaacattagcttgaccttggagattcttactgagcctgtatttctgaaacattcaagaaattatgaattgcactgaaattttttagtactattttaaatgggagattcctggttgtcaggtacctggagatggcttttcagatggtataaggtgagtcctggaatgcccatgagcctcatgactgtttttggagtagcttctgagtgattaaaatgaatgttagaactcagctattctagtgcattgagaagataagaatcttatacttactctctgctccacctaattgattaactgcatctacaaatcgctgatgcaactcaggtgtccatttcaacctaggtttagcgtcagttgagagaaccagcccagaatctccttgtgtatttcctccatgcagaaacagatgccgctccattggaaaggatgtcctagtagtgaagaggtcactccgaccctgatgttggtgatacatctgctgcaaaattaatacacacttttagaagaatggaaacataaagaggcaagcatttacactatcctttcttacttgtgttatccagtctgtttcttctctttgctatcacacgtcgaaactgttatgagtgcttctcttttggcagtgccaaagccagcactcttctccaagcctaggtctattgatactcttttggtcttctcaggttgataagcagtttgttgtgaggggttccttatatggggcaacatagaatctagcatcttggaaacaatgatcgaatattttttatgccaactaacataaggtgctgtccttatagttacctctgaaattaaccacccccccccccaaaacaaaaaaaaagtctttaaaaatgcactaaccttttctcttcctcttcatgctttttatgaataaaccatttttctcttcctcttcatgctttttatgaataaatcactgaaagtatgtatatactatagtgataaggactcacaattggaacaaattattgttttgaatgttgctttctggcatatcattctgctatctgatctatttggagtgtgaaagataatcactagatgaaattatttgagtactctatgatcatagctgatggattgttatttagttagtattttgaaactgttgcattttgttttgttttacctgtttaatgttaagttgttaaaagctgggtggtacttggtatgtgtatattttgtttaaatgaaaaaaaggacacttaatgttatggtagtagatttccttgtgggtaaggacatcctacataaacataaattctgtcaattttattctgtcctttactactttaaagcatatggaatatgaacaagcataagttccatcagcgtcctttcttaagattggtacatattcacatttcagtccagagaactgtggaccaaaaggcttatgctttttatgtgagataagctccttttgaaccagatctctttgattgtaatcatcaccagtcaaagaaacagtacttaggtactatgtttctgtatatgtttcacaactatcatcatttcagtacttttgccagtagaggcagatagtttgttccatcgtgcttcttatctaagttcgacatgaaaagctagatgtgatctgtttggaaatgtatgcaggtcaagcccctccctttcccccttcgtttgtttctaaacagtagcacaatactaattatagcgcttcttgcttggctcttaagaatgcctgtactgtagatactctgatcttagttttgttgctctcctgtaaccaagtctgtcagagttcttaacatgttatcattttgccttataccttatatgcaatttattaagggtgttcacctactgtacttttgcaccattgctcttttctgtgaggtagcaagtcgaaattcaatgctct

SEQ ID NO: 24506 - DNA, 1485 bp, Oryza sativa
  unsure (1)..(1485): unsure at all n locations
acggcctttgatttcgacntgcnactnggcacctaaaagcgtgtttcctgatggcgcggaccttgacggtggcggtggcggtggcggcatctcgggccagtctcagccggtcctggggctgcagcgccaggggagcatcacgatgcctccggagctgagcaagaagacggtggatgaggtgtggaagggcatccaggatgtgccgaagaggggtgctgaggagggtggccggtggaggcgggagaggcacccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagatagtccccccctccacgcgcagctcctctccgaccagccggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24507 - DNA, 2417 bp, Oryza sativa
  unsure (1)..(2417): unsure at all n locations
cgagatgncaatttgtagagccncntccgnctttggccnncaccccnnnnatgatanacnnnnnnnnnnnnnnnnnnnnnnnnnnnnnnnnnnnnnnnnnntttttaacaaatacattctagaagctagagaattacctattttgactatgctagagaagataaaaggacaactcatgactaggcatttcaataaacaaaaagagttggctgatcagttccaaggcttaatctgccccaaaattaggaagaaggtgctgaaaaatgcagatgcagctaatacatgttatgcattaccagctgggcagggaatatttcaagtgcatgaaagggaatatcagtacatagtggatatcaatgctatgcattgtgattgcaggaggtgggacttgacagggattccatgtaatcatgccatatcctgtcttaggcatgagaggataaatgctgaaagtattctccctaattgctacactacagatgcattcagtaaagcctatggtttcaacatttggccctgcaatgacaagagcaaatgggaaaatatcaatggtcctgagattaagccacctgtgtatgagaagaaggctggcaggcccaaaaagtctaggagaaaggcaccatatgaagtaattggcaaaaatggtccaaagctgacaaaacatggagtgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatacttaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggggtaccgagctcgcanntcgaaantncaaanggcnntccacgntc

SEQ ID NO: 24508 - DNA, 7502 bp, Oryza sativa
  unsure (1)..(7502): unsure at all n locations
nggctgtgtccctcccttccacgttgccaagccatgtaagcgagcagaccgagtcatatgggtttgaaaagccaatgtccggttaagcaagtttaggaacctgtaaatgcgatttaagagtttggggatctagatgacacaccctaataagtttaaggaccgctggttcactttactctattttgaaactaaacacggcgattgaatcggagtaaaaagtaggaccgtcacgtcacgtcggatgttagcgcacggacggttggggaagtgatgtactgtaggagtatctagctagctggcattcattcttgcattcatggtacaggcatgatcaccgtcccctttctctctgtgctactgttactgtggctctgctgcgtgcagctgtcacggtttcatttttcgggtgtctctgggttggttaacccaatacacaaggcaacgaacatgtttaccggcttggtttcatgtgggaaaagaaagcaacggaattgtagccatctcagctcagctctcaggtgtacaatggccactcgaccgcttgcttgcctgccggtctctttcgtttgctccgttgaacatgacgggtacaaaaactttgggatgccaccaaaatattcgttcgtccaggactccacataggcacatcgtagccgcctggatatattgctccgaccgacactagagatggtaatgggactccgatttccctgggtgtgaatatatgttgcattgcttatataatttgacacgtatatattattttaaatagggacaaagaccccataggaatttattccccgtgcggactgggatgggagcaaaatttcccttcgtatttcacgaggacgggaacggaaaagttttgttttgcggggatgggggtgggggtgggggtggggaattcaccatccgacacaaacttagattctgtttaagagtagagaaaagaaaacgtttgaaaagataggtaaacgagataagttattagtgtataattaatatttaattaattattaattaattattttaaatttaaaaatgaattaatattgtattttgaaacagtttttatatactacctccatcccatattacttgtcggtttgagttgttgtttgtactccctccgtttcaaaatataagcatttttagctatgaatctagacaactgtgtatccagattcatagctaaaggtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaactatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagcccgcagcccgcagatctgcgagcaagggcacgcagaaagcgcggcatcggatcggattcgcggccaaccgaagcgattccccgcgcccacccagattccttccaacaccaagcgtgggaacgaagctagatcgagcggagccggtcaaaccgggtcaaacttccccccgaatcaattcaaatccccccccccccccaaacctatcgaatctagcgagaaaacctaaccaatcaaatctccttcagatcaccccaacccatacaaacccacccccaaaaatcgcacaaaacaagcacacacacacacacacccaaatctaccgatcaaatcaaaatcaaaccaaaccagctgctgccgaaccgatcggatcggaagcagacgcagaattccactcaaaaccagcgagatcgaacacgaccagcgggggaatttcgcgggggcggtggttaccgagatcggcgacggcgacggcgacggcgacggcgatctcctcctctccttctctcccctgctctccccgcggcggcgtccggctccctcctcctcgcgggcgcggatggatcgcaggtggagaggagaaatgggcggagagggagaggagatagatggggagagagaggtcgttgaaatcgcgcaagggaggaggttatataggagggggagggggaggggctgggtcaccggcaggtggggcccacgtgggtttgtggtgagggcgtgaaggggcaggttgaagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagcnnnnnnnnnnnnnnnnnnnnnnnnnnnnnnnnnnnnnnnnnnnnatctcaatgngccctca

SEQ ID NO: 24509 - DNA, 9316 bp, Oryza sativa
  unsure (1)..(9316): unsure at all n locations
tactgagctttgatgaatgacananaccgctcggtacccgattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtactgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttgctcattgttcctgtaatttggcttccgtgtagatcctgccattttttccatcttgccacttgtttccatctagatccagtaactttgtaacattgtctgaataacaaatcatgagtgcaatatatggggttggaggaaatatttcaaggtcctctgcactcaacaactgcctgtgttccttgagcacagggttcttgaaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttgaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaaaaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgtttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattaagaggaatgtttttttttccttcaaaacaggcactttcccctttgttttgcaggaataattaaacatgaatgcatggcaggctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtgggcggagggaggagaggaggacgtcctggagggcgctgtccttgttcatggcggccttgaactcgtcgaaggtgaccttgccgtcgctgtcggcgtccatctggtcgaacacctcgtccagcttccccggctccgttatgtcgcctggcaggcactcctccggcaacgccttgtgaggatcaccaaagttcagatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttggtatgaattttaattggatttgaaggtatgtatgatatgatatcatgcaatgtttctgatattcctgtacataaattggaagggctgccacttcagtttgagtcgagtgcatttggaaatttttacctggaagcacaagcgaagagcatcatcgcctcgtgagttcctgaggctggagaacccacacaggatctctctcatgtcgacggttccatcacggttgttgtcgaacagatcgaatacgcggggagctaggggaatcagtgagtccattttcattgctctcagcacctgctcaaactctgacagagtggcgttttctccatctgcacatctgcataaagagcacttgcttagtgttatacttttcgattggaacatcatatgtgtcatgtttaaatcctaaaactatgaaggttttacgagaaatctgaacttctgaagcttctctggcaaaggaaaaaaaggctaccgctttctgcttataaatcttttcggtgttaatttcccagttcatcatagcacatatcttctactcctaaaatcctaataaaatgggctgcacatgatatatgatatgtgcaaatatactcctgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaaaaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggcccactgctattgattgacan

SEQ ID NO: 24510 - DNA, 5019 bp, Oryza sativa
  unsure (1)..(5019): unsure at all n locations
taggcncnttgattggatttctnnctggnaccctatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaataggtatcgtcaaatgcgaaccagaatattccaaaccattttgaacaccattgaagcaacaatttgaccagagttagctcaggaaacttacttgcaggatcctttgctgcttttctcgattggttgcagcatgaaatggtgggcatctgaaatacacaaactaccaggcttaaaactacgaaaataatcctaatcaagggaactataacaagaaaatggccaacatacccagataaaagaatgtacagaattaccccaacagaccacatatcactagcagctgaaacctcctgcctggatagagcctccggtgaaacataatctattgacccaaacagcgcgacgattgggtcactgaaatcttcgacagaactcaaaccaaaatccatgatcttcagtgtggacttctcatctttgtcagagaacagacaattctccggcttcaggtccctgtgtacaatgcttgccttatgaagagcctccagcccgctagcaatctgacgaatgacgcaggccgcatcgaactccgagtaccggtcacgccccacaatccgatcaaaaagctcaccacccgagcacagctcaaggacgaggtgcacaccatgcacatcttcatacacatcatgcaggttgatgacattaggatgtggcgcaacgctctccactatcctcctcatgacgagtatctcgttcgtcagcagcgcgtcggagatcgatacctgtttccacatcggcaggccggagccgggcacgggctttgtcccctgcttcatacccgccatcgccgggccgagcctcctcagagtcttgatggcaacctgggtcttctcttcagacttgctcactcccctccttactattgagaacccgccccggccaagaacatccacaacttcatagtcatcggacaactttctgctctcagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtcaaacggctggagaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaacaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaacaaaaaaataataattttctagatgaactatgccgaatctccaaagctcaatggctcttgtgacgcttagggtttatctttccataggctgcttgcctttcggtggtcatcttcaactccctcctcctacgcttccttcgttcacttctggttgattttgccttgccatctgcatccccctgttcattcggcagctccttctctggttctgatgaagcagggccttcctcagacttagacttcttctttttgaccttcttgccttctttatcctgtcctccaaggatcgaatccttgatcagtttcttatgatgcgtcaccttccattctgcctccctgtaaggagctatcttcttcatggatacatactggttcaaatccttgtcatctgatgccaatatctcataggtgctcaggccgaaactgttcggcttaacttgcttatacttgaacctagtcttcagatctccaatagtgtcctcatagtctaacttgtagtactcttccatctccttctcaagctccaccttgtccttcaaagaaatttttcctttcattttctgatttgtcccctcaccatttgcaatatcttttccacctttctttttctgagaagccccctcagctgctgcagacgatccatcttgcccatcaagagcccagtccttgggtagcccaagcagttcatcttctttgtcaaagtctggtttttccaaatcaatttcctcaccactcccaaattcaggatcaacatcatctgcttcatagtaattgtcattgaatgtctccttcattttcctgtcatactcctcaggatcaaaatccttctccaagtcatcggctccgagcttgcaagctgcatcgctatcaattcccgcaatcatcccgatcctctcaagcttctcggcgatctctttcttcttcaagttcttcaaatgcttcaactctctgcctgctcctgcttggcccgtgctatccgctcctccttgttcttgcgctgctgcttcctgctgctctccttcttcctcacagacccctcgacaaaccgcgaatgccccatcaccctgtccattacatccgcaccagtcgcggctgcttcctcatgccggaagttatacctggtctcataatcctcctgctctatgagatgctcctcttcgtccgatacctcctggatatcatccggagagtatttcttctcgctgcccgtctcgaaatacggcctctcgagaaaaattttttcaggaacttgctgttctcgtccagctcctcgtctttgccgaaaatatcaatcagtatctgctcagtctccttcttctcctcgtcatcatcctccttgttaccaccatctccacccttcggcttcacttggaacaaatcgtcatcatcctcgccgccatcgccatcgccattgcctaatgccgccttctccgccgcaagaaaagcctccagccccttcctctgctgctcgtcgtaggcgatcttgtcgtacttgctgctgctgtggccgccatggctagcctgcgccgcgaactcggggccctcctcgagcaggtggcgagcgttcacgtccttgaggtacaggggccgctccttcttcgtcttcttgggcttctccccctcctcgtcgccgggttcactctccgacgaggaggaatacatcttggccttcgcgtcaagaatggcggcgtcgccgcgccgaatgcggcggatgacctcgaacatctggcggtcgacgcggcgggacgcgatggcggcgtcatcgtcgtccgacaagaactcgtcgtggtcgtggtcctcctcctcctcctcctccggcgggacgaggcctttcttcttgcgctcctccaggcgctgcagcgcctcccgccgcttgttgtgctcgaagcggcgggcgtactcctcgttgatctggatcttggagagatcctcctcgccgccgcctccatcggactcattgtcggagcccgcgaggatgtcttcttcttcttctcctcctccctcctctgcttcatggctgccgctgcagtggcgacggcgacgacgccggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctcttgttgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggtgggttgtggcgatgatgcagaagaagagcacggacaacatcaacaacaagctgcagctggtgatgaagagcggcaagtacacgctcggctacaagaccgtcctcaagacgctgcgcaactccaagggtatcgatcccgaccgattttttgttgttttgttcgatctggtagtgttagtggatgttgattgattagtttgctcgcttaatccgaattgtagggtaggtgggagtgttatgattgattgatgcgttgctagctannnnnnnnnnnnnnnnnnnnnnnnnnnnnnnnnnnnnnnnngtgatcntactngggccata

SEQ ID NO: 24511 - DNA, 1783 bp, Oryza sativa
  unsure (1)..(1783): unsure at all n locations
ttggcncattgattgatttctcnctcgnacccggcttgcttttgcggtgtcttagagatgaatacagtaccctataacaataccaacctcttagttaatagttctccatgatctccattagtctggggacaactggaggttgaaacatttgttgtttatggagcatagatcatgttatatagtgtgatgtctgaaatggttttatcgattttatatgttctcagttacctgcttacacatgacatattctttttttctgttgtacatatgtgcaaaatacggtgcatttaactcaggctgtatttgtattttgatgtgtggtccttgttattgtgtttgttgcttgttgatattagttaagaaagttaaatgcaaacttcccttgaacttaaatttctcgagttgaatgaatttgcagttataacatgtaggaaatttcagataggttgtgttgtggtttctgattgtgacatcaatcacatcttttttatgtttagggaagctgattatccttgcaaacaactgccctccactcaggaagtctgagattgagtattacgccatgttgggaaaagttagcgttcaccatttccatggaagtaagtttgtttcatccttccgaaccatttatgttttgtgtgatagcatctgtattcatctacatgtcacggtttttccgtgatatagtttggtactgtatgtcttactgtgccttcgctttcagacaatgttgatcttggaactgcctgcggcaagtactaccgggtgtgctgcctcagcatcatcgaccctggttcgtcgctaccgacatcacttacatatattttcctctatggcaccctcagaagtactgaatatatttgcctctttccctgtttcaggtgactcggacatcatcaacacaacccctgcctcccagtgaagaagtttttacctatttagttgagatgtagggttcaaacgtgcttacatggccaatggctgtttcttggttatctttagttgtgtaattttgctatgctgaggtgggatctgccatacagataatactccatattgttggtaaggcatttctatggtttttgttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggggtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattn

SEQ ID NO: 24512 - DNA, 2844 bp, Oryza sativa
  unsure (1)..(2844): unsure at all n locations
cagcgcttgaattcaatgcattgacancagttgtacccctaatatctctttttctctccccggcgggaccggcgccccgtcaaccactcctcgccgcgagggagcgccgatcggctcggagggagctaggggttggctcgctcgctcgctttcgcgggcagctgaggcggggactggcggctgttgcngaaggtgggaaggtgaggtggaagggaaaatggaggggttctgcagaaactgaaggggctggacgcgtaccccaaggtgaacgaggacttctacaagcggacgctctccggcggcgtcgtcacggtcgtcgccttccgtcgtcatgctgctgctgttcgtctccaagacccgtaagtgtgtgtgcgcgaagcagccgccgccgcgcggatgttgtgtgctgttcgcgtactctcccatccgtggccgtaatggctcgatgtggtttggaattcaaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaggaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaaatttaagtacttaaatatttttattgtcaataccttattttttacatgaggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttttggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaannnnnnnnnnnnnnnnnnnnnnnnnnnnnnnnnnnnnnnnngaantaacaaaganantcatggcgctg

SEQ ID NO: 24513 - DNA, 6899 bp, Oryza sativa
  unsure (1)..(6899): unsure at all n locations
tgagcgcnnatgtagttcnnnnnnnnnnnnnnnnnnnnnnnnnnnnnnnnnnnnnnnnntaattaatatagtctatatagaggtagtatctcttaagaagccactattactggaagtccctgagaaatgattttattcctcagtcccatatctgccttgtttctctccactaaccaattagaacaacaaaaatggcctactcctgacgtagtggcataccgtatagttagatgcctgttgcgcgtatactctagcctttctatactagtatacttgtgtctagtgacaagctagtgtggcacacctctctttcatgcttttgctttgcaaggcagggctcatttatgagtgaaaagagtgaggcgacgtcatttctcctactatttactggaacttccgccctactgatttgttttccttgggcatgacagtgcaccagagaagattttgtggaaagagttaaaactcaacaaggtgaaggttgtaatgtacatggctttttagatgtcagcaaagttgcagggaacttacactttgctccaggcaaaggattttatgagtcaaatataaatgtgcctgagctgtcggcacttgagcatggtttcaacgtaagtaggtccaataaatgttccttttccttaaaagtgtttttattcagtgtttctgatatgtttgtgtataattttaccagatcacacacaaaataaataaactgtcttttgggacagaattccctggtgttgttaatccacttgatgggtacgtccatagctctagctcattgagcatataattatagccttgcacttattctcctagttatatatttcttttttcaatttttatctttgtaccctcatgtcctaacaaatttcatgaacgtcagtgctcagtggacacaaccagcatcagatgggacataccaatacttcataaaagtgagctcttgttatccatgtttacgtgcttacatttgtatcagttgtttctgctacaaaccatcatttgaaaagaaacttactgggttttgcttaaccaggttgttcctacaatttacactgatctaagagggcgcaagattcattccaaccaagttagtgaagtttattgaatcatgtttatactttatattttttttccaagcctagtgatcttattgttacttgcattcacagttctcagtaacagagcattttagagatgggaatattcgccccaaaccccagcctggagtatttttcttctatgatttctcacccataaaggtagtaacaatggagagaaattcgtatgtagtcatgttcatttttctctttttatgattctatcttagcttgctctactcatcttctcaacctgtggatatgtgttgccaagctcatctgttgaatggctggctgtgttggtgtgaccattcttgctgcacatgcagaatgctccaaattcaccatctgttattattcagtactatttaattactttggacacaagagaagtctacaatacctttgtttcacctttatctattctgacactgcaggaccaaactggaatttgtaggctttaggtcatggagagtttctaaagttagttattatactagtcagtagctaaaagaatcagttcattgatgagatatatctgttaggagtatcctagcataaaatttggtattatccttttattatttttattatttgctgaatggctccaaaaatgtctgcatatgcatcgtaacactttgaatacaaaattgacagtgcatgtctatactcattcaaaagcctctagtggtggtggcagggaatttgccaccccactattgctttttgcagtttttacaaattgtcccctgatatttttctaatattgtggaatagttcaatatttggttcaaacaagtgaatagcagataatgaaataaacaaacaattgatactaagatatttgataaaatatatatttttcttacatattatgatattgtttttcttctgcccatagcaaagcttgggcattttgctagtactcaaaagtcaaaacttatacatgtggataacatacagtttcgtatcaatataacgattaactaattctcatattctcttatcagattgaaaggtactccttttaagttttaactctttagttctgtgacccactaaaatcttagttctccaccttatgtttttgcaggttatatttacagaagaaaatagttccctgctccactatctgacgaacctatgtgctatagtgggaggtattagcattacctctattttattctcaaactgattaatcttttttattctattgtagtgaatgagtgttatctcttcagtcttcactaacaaattcttataattcttatacatttcaccgaaaactccaatgcttatttgacaaagtttataattagtttgttactatttgcctaagtgatgaaccgttgaaggaattggctctgtttatctatgtgcctgtgtataagtaatgtagcaaacctagtatggatgcaagtcactaaacttttgtctgccttgtatcctcaggggttttcaccgtctccggcatcattgactcgttcatatatcacgggcagaaggcactcaagaaaaaaatggagctaggcaagtacagatgatttacctgaaacatggactggccctcatgttccccaagttcccaagttccgtggcttgtaaaggatccattgcttaagacctgaagacgttgctttgctggaaggttttgctaaggccatcagaattgacgatattgcacattagttgatcaaaaactcgtttacatgtaaaaaaagacaatatcatagcgttgggcctgggggagtgctttgatgtctcagtgagactctttttgagtggccaaaactggcgaaatgagatggatagattaaatcaattttaccactgcgtgtgccatctaacactgtttgacgttttctgtatttcttttcaggaagaactagaacttacattttttttgttctttttttttgcttcatctgagtgcattagtagagatataacccatttcttgtaacttcagggtgttcaaagagacaatttgatcattttcgtgtcacgtccttctgccatcgtttgacgcttgcaatttattcaggaagaactagaaattgcagttttgcttctctgtgagcattagtagagatacaaaccatttttaaatagtatatatatattgtggttatttgccaagttgttcgatatacaaaggatttgaatctctaatcaacgagtgagttgacctagttcctattaaactacatacttgatcagatacgtcacgattaattaactatcatgttcttagtttaagtaagaagatagaattagggagtatattacgattaaattattgttaatctgattcaccttgtactttcatcaggtcatatgcacaatccaaatctctagagttcaatggataagaagaacaaatcagaactcgcatcgactgatctgcacatgaaccctcatcagaatggtcaatgaagagattgcgtggccacgaggttacaacataatatttatcatataaagatttcactgcaattggtgaatctttagtaatttgatccataggcgaagtttctcctataatctccagctttcttcatggaactgcagtttgctgctgatatacaggagagtaaaaccaacttaatctaccaaggcaagtgcctgtaaaagaaaaaaaaagatgtcttaaacaaaaagtacattgaatgaagggtaacaaagcaattgtagagtgatgtgagtttgtcttttaggtttgtttttcaggaagctacgaatttagtcctaagataaacttttgatcctttgggagccctttcctaggttgggttaccctacagaatggtctaaattctaggctgtttgaaccaaccttctgctggaaagcagctttctggaagctcaaagatttgcataaataatttttttttcaggaagttcatgcttgctgctttctacatgtactatttggttcaaaatgatatttactttaaaaacaatgcaatgatttgctttgttttatactcaattttaatttacggaaaatcacaaaagaaacaaagggggcaaacggtaaactaaactgcaacccaaaaggacacccaccattctatgatttgacccaagaacatttcagttatagttagctggggacttttttttttcagaattgaaatttaagtgcttctgcatacgcatctgggtaactgggttgttttggcaagaaatttagtggcaatgtggtagctaatttgttaatccaaaattatcatgaacttcatctctactttgtcttgtgactaaccattgctggtcaaagatggaaatacatgcagttccaacttccaagtttcatgtggtcagtagtgaggacttacatggaagaaacctctcaacttccaaagctcaagttgatgtatggtggtgtttggttggaggaactaaagtggggctaaactttagtccctctcacaaaagcataagtctctatggtagggacttatgtttttgtgagagggactaaatttagtccctagttcccaaacaccccctatatttcaccattaatctgcataaactaaatcgcactctgagcataccagatcaatcatacaccagctatttgttttattttcgaagaacctcttaatccatcagtccatacatgcaaatcactattagcaaatttaatagcccatgagaaaaaaaatttgcaacttgaagtgcattaattgtataagtagttaacgcgcaaatgtacaatgtataagtagttaacatgctctagagttgagacagcaaacatggacattatccaaagattccccatactcccaatcgttcttagcttagtattcgaaagtacaaatgccagctaagttcaaatgcaaataatgtagaaggaattactttagaggcccaccttatgagtgaccctatgaaagatctgaaactttaaaatctcttaattattcatagcaagaatgagcaaattgttgctgttgtgtccaataatggatgtcctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaatgaacacgcaaatcaaaaatataatggcagctgatatcctgcagaaattgtcagcatcagattggtcgttttcatttcacaatcccaaaatgaatgtcatgtacatggaagaagaatctggccgtctctttttcaaggctaacagcaacctccgtgtatggaaacttcttccaaccattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaagagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatcatnngccctc

SEQ ID NO: 24514 - DNA, 5036 bp, Oryza sativa
  unsure (1)..(5036): unsure at all n locations
tgagagnntttgtggaccncttgataatcctcttnnnnnnnnnnnnnnnnnnnnnnnnnnnnnnnnnnnnttgtttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctccatatcctaaaagttattctgatgagaggcatgttcactgacagcttgatccatgtgtcatgtatttcagtgtttaaaaaatgcataccccaggttatgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgctattgtacctgctcttatatacttcgctttatcgaatctaactttactgaatttaactttggtgctgaaaatgaggcaataaagtaattattttattacagttggcaggaacttggaaaggcaaatcggtgtctaaacttggtcttgcgatgtttctgcttaatgcttataaattaacacattgatctatgattacgtggactgctaggtgaagccaatagttatacttgctctttacctggctataggcccctttgccacctttctcgagggttgcagggggactgcctatgaagtgtcattcttatggccgtgtttagttacatcccaaatgcccctaacttttcatcacatcacatcacatccaaaacttttctacacacgtaaacttttaacttttttttcaaacgaactagacacaccttattccgcgtgaccgttataataaaccagcatacattgagtgaggaactttgacaaaaaagaacacactgaactcccaaattttgccacggaggatctagcataacttgtcagagacgagatgtgattagcttgccgtattaagacatgcacgcaaacaattacaattacatgacagaaaattactgggtagtttattccagaaaaagcaaagaaaacaacaggaacatggtaaaaagtactcctacagaaagaatggaagaacaagtaaaagtgctgaatgaatgggttaagacaagaaaaaagaatgcatagtccagccgaaatgtcaggttggttgggcctggcagcaagcataaaaacctaacgtggtaaatgtcatgtcaggttggttgggcctgccagcaagcataaaaacctaacatggtaaaatctcatatcaggtagggttggtcctgccagccagctcaaaaacgtaacatggaggtgtatttcttatactatacaattgtatgctaatcacatctggtttattcctgatcatcgtcagtccttcaaatactcacagacgatggaacgtaaggaacaaaacatggagtacacccttcattggttaggggcccaaagttgccagtaacgaggccttcaaggtccatggcgacgacgcgctcctccaagggttcccagacaacgacctctgcggcgccttgtgagcggagcaacatagcccttttgccaaccttctccccggagaatgagccgacaactgtccagagtgcagcaaccttatcatcaaacagtcgcttgtttattttaagcacgcccaatgtgaggaaaccgtcaacatccttgaagcaggtcacagtaagatctccctccatttgcccaagctcccatacggtatcttggtttaccactcgaggggcagggatgactttaaggaggtccttccccgggtcatagcagaggatagacccaagggaagtgcgccagaaggcgcagcccagtgtaccaacaccagactccgccttcacctccacagcaggaggggcatctttagcaatagtccacctcccagtcctggaggagtatgactcagatgtccagacgctgcccttgaggtggaaggcagcgacgacatgataatgctcaacagcaccgtcgaagcaggatgtcaggggttcctcgaatgtgatgacaactgctggttctccatgatcacaactgtggcgtggtagctgaacccacttgaaggtggtcgtgttggttacatagtacaagcctgttgtctttccacagacgcagacaaggccacgcgtggatgcaaggaaagatacgggctctggtaatgcagcaaagcgtgactcagggtaaagaagcttgccgcagcgtatggtgtcaaatgcgagatacccaggctccttacataatgtgttgaaaaagaagcctgagagcggcctgcacagcggtgagagaaaaatttaaaggaagagctacaaaatgacactagatgtttaaatcatcacaaaatagtcagtaaaggatctcctatatctaaggagaattgcatcaaatgctgatgtttaaaacatcacgaaatcaaatgagatgcagtagatctaaaaataactaccttgaagcggtactttccagtggagcatcctcatcacacagtttatttatcatcaattcatttctgaggacataaatatgagcaaaagcacaattgttagtggataacacatcaacaacattgcaatctgtgaccaacgaatagtgatcatataactgcagaaaaaaatcagctaaaaagcattacaaatttgttattctgttaaatatgtatgaaacaagtcg

SEQ ID NO: 24515 - DNA, 17423 bp, Oryza sativa
  unsure (1)..(17423): unsure at all n locations
ctctcttgtatacntnnctgtnttattattttttgtattatcntttcntctaaccaactattantnnnccntnncttattactctnnataatttnnttnttnttcccntccnccccccnnncnccnnncataggggtttgaatttcactttgtnactatctacgattatgttttttatataaaactggtaatagaattaatattcacatataggagtatctccctacgtacggttgtaatttgtatacagtaaatttaaaaaagtagaattacatctgatataccggtcttacgctcttagattttacatttttatgtgtttcatatcaaccatatcgaccaatctacactggtatagtttgaaaccatgttaaatttagtaagaactttaccaaaatcagttcaatcaacaaaaacaggtaagtaaatttcacagaactacggatatttcgacttatctatcgcaaaactaaaatatcgtatcacaaaactataaatttagcggtaaatttactataaaactacatattatatattgaagttatcacaaaactacataattaatattgaagttatcacaaaaccgcaaattctagagtctaaatccctagtactaacgttatattagagctatataaatgttgtagttctatgataaattagcactgtagttttgtgatatatttgctacttaaccttttttttttttgacactccattcaacatgtagttttgtgatataagattttaaatttgtagttttatgaaatttacttaaaaagatgttcccatatttatcattgcattattctgtctggctgtctgccatcaagcaaaatagtcttgactcttgagaaggatgttgccttgagaaagatggtgcttcaagccttcgactcatcatggattagttgagttgaccaccaccaccaccaccacaccacgacagacgggccaatccacccaaccgtctccacttccctccccaccgcgccaaattcccacccccttctccgccgccgccgccgccgaacgtgcgcctccacctcctttccattgccgccgccgcggcacggtcaaccacccccacccttcggcggagtcgcggaggaatgcggggggggcaatagaaaattcgctcgctagcagttggcatggcggattagtttaatcttgaagtccttggtggtggtggtaagaagaaggggaagaagaaggggattgggctggctaatggccgggtcctcctcctcgtttggctcgcagagcagaccgcgacccgggtttgaggggggagcagctccgcgccgcgctcgcggttgctggctgaggccgccgccgccttctcgggttgggggagtggttgggaacccgttgggttcttcgctgctggggttttagggatcctaggctggcttgcttgcttgctcttggaggaggaggaagatcgtgggggtggagggtttcttgcgggggttggccggattttgattcgtcgcccgagcgggtgggttcctgtttcatcctgctgctggaaatctgtagaattgaatttttgttttctgattccatatgctcgatttctctttgttcctgttcgcaacttgtagaaattatggtggaagaattctttggtttgagaaggataatgagttgtgagaaaggagatttttggcatgaaaactactttttcttttggtatttgttggcgttgtggcgcgggaaatgtttgatttattacttggaatctcttacagtatttacaggcatgtaattcatgagagaccgcattgataatatttcatgagacttactaggtagtggatttttgtacgtcaactgttgctcgaaatggcactgtcataattttagtataattatgatgaatagttgacgatacttaattctgttaaatttttgttcaggcttgatactggaaaaaggagaagcttccatttttttttctctgacttgaaaggggatggccttcccagatgatgatgaaaagatgaaggtttgtgcttttcgctttacatcattcatataacattacaatacactcacaaaaataaaacatagcagcataattctattctcagatccactgtgctctatttgcatgttttggccctaatattttttttttcatactgaacttaaatcaaagtatttactttgtaattggttgtatactatagggttgccggccaaaactttttggaacaaaagataagaaagttgtgaagagggcagattaccaaagctgttctgcaggttagtttttctttctttttgaattgtgcatctagactgaattggtgtcttgtaggatagtgataaattgaaacgaagatgagcataatttatcaaatttcagctcatctagttgaatcaggggaattgctcaagtcagttgggcaatcagccaactacattcataaggtcaactgaacctcgtttcattgtgtataatgagaaatatatgaggagacagccagttcaaatatgtttaagaagatgctaggattcatttattctctagtttcatacttgataacttcgtgtcagaaatttcacattttgcccgaattgcttcaatacaattacgttgatttggcctaatgacaataatatagcgtaatagcaactaaatgtttccatgttttcctgtcaaatgcagttaagtccgggccaagttcctcaaagtcacaatcttcttcccccttcagaacacttacaggtggccttctgtttagcatttttgccacattgcctcactctattcatgtgctgatttgttttgattggattattttttggttctttggactgaaaggaagtttttgcagaagttaggagcatacgcctcagccatttacttggtcactcttcaagtactactaaaactgaacctttcaggtcaaacagctaaacttgcatgttgagtcatactttatgccgtcggtttgtcatactttacattcttagatcggactaggtcgtctttaattttttaattcattatataggatatttgtatctacatggaatgtcggaggaaacacgcctactgctgaattaaacctggatgacttccttcctgctgatgacaattcagatatttatgttttagggtaagttatttcaccaatttttcaccatcttacatatttttcatatttcagttagtgagtgatatgaaaaataaaaatagctccttttaatttgtttcctagtgatttcaggatgttactaacttgcttgctttgccacgatgagctaattttccttagtgttcatttgtttcattcagtgaaccgaagacgctgtttccatctgtctcttttctaatttttttttgacacattctcttatgatattatgcagttttcaggaaattgtccctctcaatgctggtaatgtgcttgtcgtagaagacaatgaaccagctgcaaggtggcttgctcttataaaccgaacgctaaacaaaccagttgacagtaatgctgatatctttcagcacaagccatcttcttcccttgattcaacctcgtctctgtcttcatcaaaccttgatgcctcattctccagccgcacaagaacagctagtggtagttctgcaatcttccagaagtcctctttgaagtctatcaggaagccttacatgccaacccagagaaaactgctcaaactctgcaattgctcagttgagatgactaggaagtcctacaaagatgcttgctttggatgtccacaagcatatgctaatgagacggactcttcagaagatgatacagatgatagatcgaatgatccttgtggttatatagttgatggaatgaattctgctgcctctgcctccagggatcagctaaaatacaacctcgtatcgtgcaaacgaatggttgggatttttatcacggtgtgggcaaagaaagaacttgtgcatcatataggccatgtgagaacgtcttgtataggtcgtggaataatgggctatctgggaaacaaggtaagaattaaatcaaagttcagaagtattatcttcataaccttgtaatgggatgtcattgttaattaaagcattacaatggtcacaattatattaataagtacagatttagcctgacatgttttttgataatgtttaatagccggaagtcatccttctgttctttctttttttttttttggagaaaaagagggggacctctcccatttcattaatgaaatgatagtagttctacaagcattccaggttccaacttacacacaaagtctcagactactcctgaccttcagaattacaccagacagactaacagagcaacacagatgctaaagcaaacatttcagctccttccattctttttagtgtgacatagtaatgagggttcttcacaattctcatgtgtagattacatatttatgccacacttgcttttggcttcagggatgtatatcagtgagcatgacggtgcaccagacaagtttctgcttcatctgtagccatttggcttcaggtgagaaagagggtgatgagctgaggcggaatttagatgttttagagatactgagactcacgcaatttcaaaggatttgtagagctgggcgaagaattcctgagaaaattcttgaccacgagtaagtcatgcactcatgctacacatgctgcgaaggatttgttcattgtcaatcatcatttactaattattgtgatttctcttattttgttagtcgagtgatatggctgggagatctaaactaccgtatttccttgagctatgaagataccaagaaacttcttactgaaaataactgggatgccctttttgaaaaggaccaggtaaacttctcaaaagatgcactgttttttgaaacttcctctcagaaggaaaggactaaagtaataaacgataaaaccaaactttcaagaacttctactgtgtatgtgtgctctatgttctaattatatctagccaggctataatctacttatatcttgtgaaattttggttaacatgcatggttgccttctctttttcagcttaacatcgagcgcaagtctggaagggtgttcaagggttggagtgaggagaagatatattttgctcccacatacaagtattctagtaactcagattcttatgctggagagactgcaacatcaaagaaaaagaggagaacccccgcctggtatgtaccgtgttcatattagttagttttactataaaaatgtattcccactgtgtcaggttacaactttattggtaagttagtaccatttaattatcattataatttgtccacatgcttgtgtgcaacttcagtaatccaacattatcatcttatattaccatagaagaggaacatcttttgggtttcttgacgtgaaacagtgcgcatttggacaaatgttggttgaagtcgtagaaatagaaaacgatgaaatcattcacatgaacaaatattgcatcatactaacaaatatatatcagacaaatggcttggtgtactggctgtgtgcattgcactactgctgcacattttgcatttcaaatgttaatagtttcaacttgttcaggtgtgacagaatactatggcatggagatggcattgtgcagttgtcctacttccgtggggagtccaaattttcggatcaccgtcctgtctgtggaacatttattgttgatgttgaaatacaagagagcagatcaaagaggcgatcatctaataccaacatcagaataggtgctgaagaactcttaccaactagtaagagtaaggctaataaaaataagggcaataaaggtatgcagcttcttgactcttgatttaaatttaccataaaaacaacataatttccagtatatgcatggacaaaactaatttgtatgggcattgcacaggttctgggacctaaaccctattggaaattaaattggtagcaacagcaacttgtactaagatactgaagaatatttccatcggcacctgtaggtatttattccaaagcagattatttttttgtgacaggggaaaggtgattaccaagtcgtacagaaaatgtagtgcatatatactttccaaagggaaaggtgattatattatactcgaacaattttccacattctttttgttcttttgggtagaacaagtgtgcctatgcatagctatccagaatccattgacccccttgtattattgtgtctgtctgatcagtttgaacttttctgtaacaaaattgtactgagaacgaggcattattccaaaatgtacattatgttatctatctatctatctatctatctcataattgtctttgatttgccgattattatgtgactatctcatggataaacacaaattaagtatgattacaatgtacagtggatgtttcacctgagctacgtctgtaaattttcctttttgttcagtataattttggtcacctggccaagtgcaccatggtcttcttgtctggcttcgatcgacttctttctcacgaatgagtacaaacttttgtgattttcagctgaatttcattccttcaatcacattaagaacatttatgcaaacctattttatatctgaattctgctcaccttgaagttcaacggtagagccttagagggttctgcaactggaagccagaaatgcaaacttaacaagaaaggtcagcatttctggtttccctgacaaatgagtgcagttgttagtgcacgaagcttattctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgattaaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctgactttggggctaattcatccaaaggttagtttcaagcagtatgtcattgaaaaccnnnnnnncgctcnnnnntttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatccaattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtacntaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatataacaagataagtatatacgtcctgcaaaggacaaatgtcatggaatccagcaagttttacatcaaaaggaattttatagttacttaatacgtctttaaataaaaaggaatttgattatgatcagcaaggaccatacaaacaaccagccacatcacccccagaaaatgatagctagttgagcggatcaatcaaacgattctaaacatcccggcgacgacgacggcggcggcggcaatggcgacgccgacggcgacgaggtggtcgccggagcggccggcggcggcggcgttggtggacggcgtcgccgtcgacggcggcgaggcgaacggtgaggtccctgcagatgaagttattaaggtcacatgaactcgaatttagcggccgtataaatacgtgacaggcacatgaacctaacggtacggcacgtcagtgtttactgtcgagcaattaattgccatcataaactgtatatgatgcttttgtacatgtagccgattaaatgtttattcctctatgatagcatcatcacaaattgtatgaacaacaaccataacgattccctcttcttttttcttttcttttttttgcgtgtataaggcaaagcatattagacaatgtgagttaggagacgtatttactggtgtagtatgcattagtagtgatgtgttcatcagcatcttttttatacagcgtgaaaaaagattatttgaaaaaaaaaatccggctggaaacacaaatctctggttaaaattagatgcttccctaaatctttgctggtatgtgacgtgtgtattactcagcttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaagtggagacgggaggggtggagacccggcaaatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggcccccctggccccggcgccgccgccggcgccgactgcgcctccgccgtcgtcgccgccgacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtttagttgaggaaataaaaatttttgggtgccatattggacgtttgaccggatgtcggaaggggttttcagacacgaataaaaaaactaatttcataactcgtctagaaaccgcgagacgaatattttgagcctaattaacccgtcattagcacatgtgagttactgtagcacttatagttaatcatgaactaattagacttaaaagattcgtctcgcgatttcctccctaactgtgtaattagtttttcatttatctacatctaatgcttcatgcatgtgtctaaagattcaatgtgatgtttttcggaaaaatatttggggaactaaacgggctttaatacacgctcaacgaacgtacaagtagtacgtcataaataaaatctatatatcttgcgaaattcatattcgaacaccatggtggtgtttgaaattcatatatagataaggatgaagattaagattaaggttgtgtatagattccaactttttttcatcgaacttctaattttttcgtcacatcaaatatttagacacatgtatggagcatcaaatgtggacaaaaacaaaaactaattgcacagtccggctgtaaatcacgagatgaatcttttgagcctaattacgtcatgattagcacataggctaaaaagattcgtctcacagtttatagtcggaacctataatttgttttgttattagtttacattattaatacttcaaatgtatatccgtatacgtcaaaaaaaattggccaattttttacagcatctaaacacggcctaagtgttttacgcaaaacgatatggtatcaacgtatgattaattttttaattgacttttagttatttattttgtaaaatatccaaactttagagcaacttttatataggaagttttcgcacgaaacatatcgtttagtaatttttaaaaagcatgtcacgcatatccaaactttggtccagtttttgttgaagaaataaataaatctatacatcttgcgaaattcatatttgagcactatatgtatcccgagtcatgacgtttggtgcaagagcattttatccatgtctatctacaacaacaataatatatatggagtataagttttcaagaaaacagcaataatatatcgaacgcaattcaaggatgatggcatatgcatgcatgccgcatgaaggatatgagttgtggctatctagctagctagctcacattaatgcaccttgttgtaggagtaggatgcgtagttcttaaaaaaaataaaaaaagaaagaaaaatgtgtaggatgtgtacaccctccgtccgtccgataaaaaacgaatttagaatcggatgtgacatattctagtacgataaatctgaatatatatatgtctaaattcgtagtaataaaatgtggcacatataatactagattggttttttttaatagaacggagtacatgtgaaacaagaaactgcccgtgattaaatcctgtatctatacagtcgacacgcatgcattgcggctccggttctcgcggcagggattaaatcctgccgtccatcttcagctcgattcatcactgtccatcaggtcaaatttgcgcagttcacacacgccggccggccgggccgaccctcgcgttgcatgatcgaataatatgattacggcgagctgttctgttcttcggttcatatgcatgatccgatgatcgatcgatcatgaggtgccagtcttttgcattgattggatcaaacataattctccctctgtctcaaaaataaataaacacatgtgatatgtaacatattttaatactacaaatctacttataaaatagaacttatattaaagagacaatccattatatgccactgagtttgtcacatctttacgatttgccactgactttaccacgttttataatataccatcgatttttacttaacttttatgatttaccatcgccgtccagttagtctccgttagtactgtacaattttgttcaaatgaccaaaatacccctgtgataaaacttccaaaatgtggacaaaaattccgaaataccatattataaacataagatagtaaacattcaaaatttgtccaaaaacttaaagtctgatatttcagaatttttatccaaaatttgaaagggggatcctctagagtcgacctgcaggcagcgtagcatagaannngcaatncatgcngctg

SEQ ID NO: 24516 - DNA, 8274 bp, Oryza sativa
  unsure (1)..(8274): unsure at all n locations
gaggcnncaattangatctnnnnnnnnnnnnnnnnnnnnnnnnnnnnnnnnnnnnnnnnctagtagttggctatactattaaacttgctctaaggccattcccaaccccaacccaatgattaggatggtgtccatagcattaaataaactaccacctaagatgaaagatgatgtggtaaatgaataaatgaggaaagcgaaggaaatcaggtcttgcataagacatggtttctacacaacatacaagacatcatgtgagataagtagcattaaatttaagtatggaagagtggtgtttgcattgatgaaagagtagtgtctagtactagtttcttaatgatgtggagtttatagaaactatgtctagtgtcttgggttgggactggcctaatctaatagcccattcatacaatagttaactataaaaatatactacactattaatacccggtcccatacacacgtaatgtattgaagtccgtgctacagctggctacaaatctgcagcccgcttttttctctctcttattttttcttctcgatacgtggttataggtggcttatacctgctcttaggaactaagccacgtcactgtctaatcctcaaccattcgatctgatctgagcggcgcacacgagtcagcccatgtctctttctagggttttttctccttccccatctggatcgcatcactcacagccgccgccgctggtagggtaggtagaaaaagaccgaaccgaaaaaaccgacactgagaaattcaatcattaatttggtcctatgtaatgaaagaccaaattttgttcggtcaaaattcacttagtttactcggttaatcgaatagaccaaatgaccgaattaaaaaaatgtctaaatgcaatctacaatccactaagttcaataggattaaactctaattttcacttccctacttcttctaggcatgcaacataataagagtctttacttctacgtgttcacgattttttttggtgatttttgtgttgaaaatttccattatttctttgcaaatatgaaaatgttgttgaatttcggtcaggaccgagaccgagaccgaatttgtctatcctgacatttttacattgaaattcagtctttacttttcaaacaatgaaatgaccgaagacgtggtcgcggtcgcctccccctcgccatgctgcttcccccatccctcgcgcacgattctataagaaggcaaggcaagatagcattgactgttgcatcatcgggaattgtatccttgttacttccaggtggccacacgcctcattcccagaataatatctatggtttgggtaggtagtatcatcaaatcgattaaaaatacttgatctcctaatttaatcggaacatttctacaaatagatgatactaatacagttcctccaggtgaatgtattagcatagctttatctaaattatctttaggtaaagactgatttcaactggcttttgcagataaaaaggaatgagaggcaccagaatcaaataaaacagtaactggtttagagtttatggtgaacatacccatcaatatattaggatcttggtgcgcttcttctgctttaatatgatgtacttgaccacgtccaagattaggtccactcttaataattggaggatttttctttataaaacctgtagcagatggtttctgataagaagtttggccacccatattttgacgattagggcaaagtcttgcaaaatgtccaattttcccacaaacataacatggagagtcttccatttttaatccaggtcttggtagtattggtggcatgcctggtcttgcattgggtaaagatggcttaaatagataaggcctccgaacttgtagtgaacccctagttggtgattgtcgttgtaaattcattcttctcttacgaagtccttcgaccattctacgatcattttctagcctaaccactttattgactaggctttgaaaattttcatgatcttgactaatcattggtcctcgaagttcatcacgtagtccttctataaacctttcaatcttttccttttcatcttgaatatcagaggcagcatattgagcaagttgcgtaaatttattcaaatattcttgtactgtcataaagccttgcctcaatcttcgaaattcattctttttcattctaatcacagctgtaggtataaaagcatctctaaaagctgtagtaaattccatccatgtaataatatgtgtaggatcttctatagaagcttgatatgcttcccaccactcattggctggtccttctagttgatgggttgcaaaggttaccttctcttgttcgcttgttcggaccaaggttaatttcttttcaatagcccttagccagtcttcagcatccataggttcttcagatttagaaaagactggtggtttaattctcataaattctgcatgtgcgctgtaacctttacttccttgattttgtgctatggcttgtaataattgagtttgtcttgccattacttctgccaaagtggtaggatttggtgaagggatttctcctgtttctctttcacccgtactgccattgcccatactcatctagaaaatggggtaattgatatcttctcaaaggggagtcaacatccataattaaacatagcttttatttatggacaagttgtacatgatgtatgctacaaagaaacaaaccaaagaaaaccataaccacaaagaaagaggtaatcacacatagaagttagagaggagtaggataactatctattctacacttaagacctctaactatctataacttctatttatctagccatccaccactgccttctgcgggattagtaaacaatgatgcaggtgcgaagtgtgaaaattcatgaggagatgcagaagttgatgcagtaatattgggagcagagcatgagtaagggtcttcattattttcttgatcattagtatgtatagaaagatgttcttgtgtctcaagctctcgttcttccggatcttcctcttcctctggagattcagtccagattggggcagtatttaactcattgatatgaaacacccgatttggccttagtatttctggttcttgactaggctcactgatatccatagctgaatgcatttcttctgcttcatcatcagaatgaataggatacaacggtggtggtgatggtggtaaacattgtaaaactccctcaccattatcatgaggatttggcccatctggttcaccttcacgtactggtgagatatgtccttctataccatcatcatcatcatcatcatcatcgtcatcactaccatatttgggatttgatgaagacaaaaggctgctcctgcaacacaaatattgaggatagaattttgtttttctctttcctcatataattcatgaagtatacgatatttgtgtttaagaacattttctctgcattcagcttcttcaagacgtttacgttgtacgtccatatgttccagagcttcttcatacatgtcatccgcggcttccatccagatagacatagttgcttttactggttgttcatgataatccacattctggagggtgcaatagtcttcgcccggctctcgcataggatgataagaatagctgagagtgttgcaacctgtcttggtaaatatgattgagacgtagaaaagcctccctggacacatcatatagtgcagcttgcacggtatcccgcctatgacgtgttcggaagtaatacatatcacgttcacctcgtggaggattgatctttacggtcatatcatattcccaacgttctccccgttgataagcatgtgaatagaattccggcttctcatttatcttcagtttagtcatcaaattgattagttgatcagtgcactcattatcatggatagtaattgcagtttctatgagttcttgctcatgctcttctgccattatcctgaaatacacaaatgatattataatacatgctcgtggattaaatctaccccccttaaaaggtaagcttgaaataaattcaaacttagcttagttaatagtccttaaggttcatcctatagtcaaacatatgctctgataccagtcctgtcggagcccaaaactaacaacttggatccgactgagattaatgtatcaatccctggatcagtaaaaattgatacatacaatataactggttcttcattgcatacgttaaagtcttacaatactaagggttttacaataataggtactcacctaagctaattaatatacagcggaagtttctatacattctaactagtgaggtataacctttagggattttctaaattatcagggtcttcgtagtaatagttataagggtcctcctcttgacccagatctgaaaaaggggttataagagcaaggatgagtattcacaatactcagcaaattatcatggaaatatgttatgcattgacatataatagggttctttgcaaaaagcggtattggacaatctggaaaagttatagcagaatttataaaacatataaactttagatttctaaccaaggtaccatatgagtcccggtactcaactccatgagtacggctattcgaatagtttcaaagatattctactgcagcagatgtacgctttacccgcagtccatgacttgctgataatcatcggctttagtcatggctcagtattaagtcaataacaattatggcacttattccatgaacttatatcctcatatgctctgaacgtaatgttaacagcagcaagaggagttctggcgttcccgaggtatttaaggggaactgatcgtatgacaccacatcatctcgatcagggtttagaaatataccatatagtttatacccgagtatcacaaaccatttacctgtacatggtaatggttaaagttgcccttcgcggctatagttgcctcctgcgcgaggacttaaaaataagaaccactatacagaggtgccatattgctaattaacataataactaggtctgtccccattctagaaactgcggtcgtacccattcgttcgacataagtacctggtaaaacttatatcgattgagacaatactagccacccggaaatcatccaaatcttacgtattgtcccaatctaagtatagggtattttaaccagattgtaagcaaaataagcaatactaaattatttgggtttctatgattaatttatgcatagaaaatagaatattgaatagaaggctataaataaataaataatttgtaaaatataggcttaaatgatcaacaggtatatggtaacttgccttgctcgatgtcctgagattgattgatattatctagagtgtcagaggaatcctcaagacctagggttagacatataaaattcaaattcaaaaaggagtttaaataaaatgcaaaaatagcaaaaaggggcccaatagatagaggatgattttagaagaatattggtccaagttttactgaaattggatctatattttaaaagatatgggcttctaaagtttgaaaatcgaataaaagtgaaatggtactgtgtgtgggtcccatctatcagtctctctctcttctcttcttctacctccagccgttccccatttcaagccggcggcgctagggttggcgactgcggtggcgctagagggagaaagtggttgtggccgaggaggggagggagctagggatctccggcggcggcgagcggtggcagaggagttaatttgatgcgtggacggcctagcggctagggcggcggtggcacggttaggttgtgatggtgaccggagtgatgagagttagacatggttaggggaggggttctagagcatctacggggtatctagagggatttcggcagcttgccaacctttggcaaggtgcggaacatagttgccgacgagcgcctacataggcggcggccgtgctcacgtcggcagctcagagggtgacatgatagtgcaaagggattgctcaaatggaatctaggtagtatgtaaatggttgaaatggaagaactcaccgagatcggttgaaacgacggattgcggccggaaaaacttcgcggcggcgaagaacagagcagcgcaggggcggcagtgctcggcttggtgcggcgaggtaaaactcgacgtagggctttggttagggcttagtatactagaacatggtatgatataggtgttctaagtgttatttagggcggaggatggatggagaggggtggagtcgatcacgcacaaagtgttcgaccgacgggcgagggtggttgatgagatggattggtgaagcagagcttcgggattatggggctatggttgttgatgatcgatgatggacagggaagggattggggtcctatttatagggctaggaggagcggatgagctcgggcaccgttatcgccatggatgagctcgggatttggatgaggcaaaggtggcagaggctgagagagggcgggaaagatcgatttgagtggcgggaggccacgtttgaatacttaccggcgaaggattggcttgaccgcgtgttgattcggctggcgacgtgttggcgccaatccgagcgcgacgcgcggcggcggcgagggtgaaaacggccggctcaggggtgaatggtttgaattgtgagaggggataccaccgtctatctccaatccaaccgtgcggcaagaattggcgcgattcaccccgggtagaagcgaaatcgcactcggtggcggcttggacgggtgcgcacggcgtcaagcggtgatttcgtgcggcggtcgtcgtcccggctttgtcatcgtcgagattggtgcggcggcggtgggctgagggcgtcggacgggcgacggtgcgccaaggcggtcgggcacgcgcgatcgatcccgagatcaacgcgcggcggctcagcgcgcggcaaggtcggctgccaaagagcgcgcgtgaaggggaggagaaggccaactaaaccacggtttttgagtgggttgtgatcccctaggaccaaacctagactttgcacaagattgggttgaaggtgggctgctctagttgggctgggcattttgtcgagcaccttgagtgtaatgaacagtaaaaatcagaatttttgaatatttccctagaaaagatttgaattcaaactaagagtttggaaaggtttcactagggtttagagtatagtaaatctccactaatattgggataagctaaggaaataatctatggtttgaatttgagagaaattgctcaaattcactagggtttagaataaagggaataagttagagtaaattggttgggctctaatacttgaaccaattttaaataaaaaatcaaatagatttttgaaccaaacaaatttaatcaaaagccagcatgatgcagttaattttagtttaaaatttgaggatgttacatgatgcaaaaacatctctcattgtttgggatgaatctcatgttaatcataagtattgctttgaagcattagaccgcacactcaggacatgttatctgctaccagcctgcattcgacatacaaacagtttagcggttttgggtggagattttgcccaaacacttccatccaatcatccaaaatgtaacaaagaaaaaaaatgaaatcatgccttgttttaattcatattgatggagtacttcatttaaccgaaaatatgaggcgaccaacgtgaaacccaccacgcacgcggcccgcacccccatcccaaccgaccgaccgaccgaccggctcgcggtcgcaggcgggcaccggaccaccccacaccacccaccgacccatctgatcaagataccgatcgattcctccaccccaattcccaattcgataccacccgccaggccgccacgccctcccctcctcctcctcgccatggcggattgccgcagcctcatcgagttcctccgcgccttcgagcaccgccaccgccaccacgccgacgccgnctacacggactccgccgcctgcggcaccgcgcccgcccgcccccgccgcgggtcgtcgccgcggagggggaggcggaggctgttcacgtccctctgcgaccactccgcgatggcggcggtcgacgcggtggcgctgctggccgtcgtctccgcgctcgcgttcctcgtcacgccctacgtcaggatggtggcggccgaggtcgggggccttgtgtacgacctcgacgcggtggnggtggcgtcgtcgtactacgcgccgttcgcccgagcgggcgccggggcggcgatctcngccgtagccggttgtggggc

SEQ ID NO: 24517 - DNA, 1267 bp, Oryza sativa
  unsure (1)..(1267): unsure at all n locations
nggtttggcattgtaccacaccgtgatgtggtggtcgccctgtcgtcgtcggtccggttggacgccggtggcggtggcacgtgtgcgcacgccgccggtgggcccgccgccggttcacgcaaggccaggtttggcgcggcgcggaagcgttttcccgcgtgttttggtctctcgtcgtgtgggtgggtggggtgggataatctggattccgtttgctttctttctgaattctgatctctagctctctctctctctctctctttctttctgtggccttttttttttgggggtgaggatggatcatggacggtgccgaaaaggctctctttttagcggctattaattctgtggttctccgtcaatgcagtgctgctcatgatgatgttaacagacgaaagggatctgtgtttagtaacaccgaaaattgtgccttttcttttcttaggagggaggacaatgagatcatgtttattttgattgttcacatttcacatgataatctctactattatttttttaccggtattttggtgcgtcatccgtgtttaggtcggttttttaaatctgttcgcttttagaaatacatatccgtatttaagtcagattttaagttcgtttacttttgaaaatacaaaatgagtcgtataagaaatctctttaaaaaaacttgcatgctaacttgagataaaagtcagactcctaactacatcttatgattttctaaactaaaatatccaagcgaatttccacggtgaatttcaccctagctaaaccggataagattacaagatttaaaataatcttcacccattcgaacacgcttttttggtttctttgaataatgggcatgtggtgaaccagtcatgagtaaatgtgcttgggacaaagtctcaaaggggataattcaatccatttgtcccagacagcacatttggttggggaaagacgaatctttatataatatggagtactccagatctgattagctaagggtgctaccatgaagaaacttaaaaagtgtgtgcttctagaggctcataccacatatgtaaatatcatttcattcattttcatctagcaaaaaaacacccaatgcacctctttcctgtgcatacaaaaactcggcacaccgaaagaaggcaagaatcacaataaaagaacacaaagaaaccctatttttacatgtgtatgaacaccatctctacatcgcaaagactccaagaatacagttaccgcgnagggtaccaagtaggaatcaatgctctgc

SEQ ID NO: 24518 - DNA, 2154 bp, Oryza sativa
  unsure (1)..(2154): unsure at all n locations
gatggccattgaattcaatgggcagncgcccgcggncgactctagaggatccccttcttgagctcgtctcctcgggctctctctatctccttgctgcgacctttgtttttgttctttctacgacgacggccgccattgtcgattgcttcccggcgcgctgaaggaaagaagcctcagggaccaagatctcaccgtcggatcgccggctgccgcctgaaggtaaacaatctttctttcgtgcgccatcgatcagccgcagttgtaatgtcgtagcagagatggtgatgatcaggatgctgctgctgaactcgctttttggttctaggagatttaagattatacggattgcatctttgttcttaaagttttcgaatacagctattgcttaccactactgcgctacctgaatagatctcttgccattctgcaggatatatagcatggaattatctagcatgagagtttcagaattatggacggaacattttctctctttgcttcattcattgctagtagatccttattttggctgaactattgcctttttcgtttgtttctttgctagatttgtgctggcaagttgatagaggacaaggccatgggtgtcgaggcagatcatggtacgccatgtataaggacgatcttgaggtgttcaatcaggatgagctacagatatgcttctgaaaactgggttctcctcttcccggtcctgctgctctacctgctattcagatcttcgccgggtttcttcgctttccttctgtcccactctcctgtaatcatatgtgccgctcttatccttggtgtgctgataagccatggcagcacaaacgttgctgagatcaaggaagaacggaaatctgtcgccgaggtttcggatcccaagtatgcagatttgtccaggaatatccatttggaagcaaacaagggattttcggcaaaagagaacacggcgagcttaaatgacggtgaaatcaaagatggcttgaattcttccagagaagatgctatcgaagttgtgagatggtgggcaagataagtcatgatagaggatcaacagattcacagagtgatgagatgaaagtagattcagaagataaaccggctggtacctgtaaatggggccgtgctttttttgttcgtcgcaggaagaagctttctgatattaaggtagagcctatcaatgctgctgtggacagtccattagactcatctttggattcaccatttggtagagttggctgccatgatggttcaccaggttttgatcatgatcagacagagggtaccactcctggtactcctagaacacgcattgcttctgtcctggacgagattgaccctctttccagtgctgattccccccatcctgatcccatccaaaatgatgactcggacaaccacatgtcccttcaggattctagaactgtgagagataataattatgaatctgacaagagcaaggccaacaaaaacgatgacaagaatgtcagcactgatcctgcatttcttggaaccgtagatgatgataagaatgtcatggatcttgggtactctgaggtggaaaggcatcgtaggttagagatcttgatggttaagagaagatcaaggaagaacatagtatttgatcctgacagtaacttagacatcgataatgataaggtttgcaagagaaacccatctgatattctttcttgttctgatgagacagaatttcctggctcagctccatccgttctgcatacatggaggaatccgtttgatcatccttttgagcaatcagatgaaagtgatctacatgaacatgtcgcaataccccaccaggacatgttcttcacaaggcatgaaagcttcagcattggcagccaggggagacgtccctcaagatttaagccaccttttatcatcgaagcaatggacattgatgagccaagtgcaagtgatttccagagacaattcagtgacaaaagtgcgtctacattgagtacagttactgaatctgatatcatttcttcagttgctgatcaagaggacataagtaacaacataaaaaatgactctagtagagagtatgaatcaccagagctacctacaatacctacaatgggaagtgatattatatgtgttggacgcacatgatcagatgggataaat

SEQ ID NO: 24519 - DNA, 5172 bp, Oryza sativa
  unsure (1)..(5172): unsure at all n locations
aagcaaatgcatccgtttccttgcggatagtatgacgccantgcttccctcgggtgagggcttgatagcgacaaacgttgcaccctgcaacgcattgcgcccagnaagctcaagatatggagcgtatttgagcttcatgttgcatgctggaacctgagtcctgttagaacatgctgaggccgacaactggttctccctaaattccttaagctgctccgctcccatggacaatgtgccttggccatcagcatcggtcagtaccaagcttgtaagagtgggatgatccttgataattgaccgaagaagataatgtctcgttgatgccgcaatcagagagctgattgtccactcgacgcgaagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatcatcttgaggaaatgcgagaggatgttcctcggcttcggcgaggacaggttaagcgcgtcctcagcttcgccgtcgaccgtcacgacgcggtcgatcttgacatagacatcatggacgaggggcacgagcccgtagaaccgcttcgacacggcggagcaccggccgagcgagcgcacatcctcgacattgttgaggatcaccagcacaagcgagtccggcagccggtcgaattggtcggcctccagcaccgggtcggcatggattcgagccattggaaaccacccgaaatggagaaatggatcaaacgccctcccccccttccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctaccttagacaccgcgccaccaccaaattaaccgcgagggccaacctttcgacgcccacacgcgttcggatccgacgccgacgagcaaccgtacggtaccgaaatcgcgaaatcgggagaagggtcgcgccgttttctcaccggaatcgagagttccccccttcacgcgcagatcctcttcgaccagccggagatgccgaaagagcttcgatcttggaagcccgtgggggcgaatcggacgggattagggtttagggagaggggaattggggatgagatgttcttgttcttgcctctccttttctttcggtttcgcgaagaagaagaagagagtttccctgggcgaagtgcttctctttcttctctttttttttttttctcgtcacaccactcgacgcggctctcctttaatatcgtctcgccgccgttaaggtgacggcctccggcgccgtcagttccacgtcagcagtagatgcgaacaagcgttcagtaaatttttcacttaactgcacgttcaccaccatacatgcaacatcctactctcgggacccgaataaatcacagaaataaaaaaaccgaagaagcatgaaaaatatagaattatgttaggaatgcctctttaaaacatatgattgtaaaacaaaagaaaacacaaaaaatgaccgtataaaagacacatgaattttaaggagagacagagactcaaataaaacttttcatgaggttttccctcatgttaaatttcctctaaaagttacatggaatgagacatattctataagaattttatggggttcatttatttgtttcaaatggctatatgggaaaaaaatcctatagaaatacaattcctacatatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattatacccccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccggaatgggttttcactggccatccaccacctaccaatataccacagatgcaccattgctccactgcaaactaaacctccgccgccggttgggcacaccgaacaagtgccccccgcgggccagtctccaaatcaagctacctcattgggctccacctccatgggtttcgcctcccgttgcgcatccatcgtgcgccaccggtctttgacgccccggcccacactgcaaggtaccgggccgcaacactctaccggcattggccagccacagcccccggccctcgtcgttgcctcatgccgcaggcgcggcctcctgcccctccaccgccgtcacggcctccgcacctccatctccagcacctccgcgctgtcgcgcccgccgttgctagccgcaccctccgtcaccgacgccctgttaacagtgaaatttggtaagcccaaaattactatcggcttagagtcagtatcgacttcaaagttttagaatcagccgatgggagtcaagttgccgcgatgtcgtgttcttggtggagtcggatcaatcaaaggaatcttatccagaagagactgagttcaaagagaatgcagcatggcaagttatctattaatgaggaatagtttgttagttttcttttatctttaggaaagtgtgtttagtgtcctataaggactttatcttttccttctatctttaagaaagtttctttcttgtccgacaaggacttgtatcaacccatgggtataaatatgtacacccggggtctatgtaatctatcctcacgatcaatacaattcggcgcatcgccaccttttaccttttctactttattttatcgaccggcgggacttggcacctgacgcggggctaaatcggtgttcgatctccggcgaaggggtaagtccaatgttccgtcggtccaggcaattgtatcgtctacgtcggcgttgttcaaggctgcatcagggcattcaacctgttggattgctctgatttggatgatatatttgcctacctatttatcatatgtctctgttaatctagtcttagcatatcaatttagctctatcggctgcttctcgttttagggtttctgccggtatcggctaaatcacgttgctagattagattagcttagacatctaccaccctgaaaactcagtcaatggcttgattgtctagatattatgtttcttttcatacttagtgctgcatcagttaagtttgatataccaagtcgtgcttagaaccataatctatagcctgctctttgactgccaataagggttacaactggtgagttatctggacgttggattggctcataaggattgcatatacatataagttggatttagccgaagacaacaaaatgttcactgattaaatcaatcttggggaattcatgacatcagacctccagccgatgtatgctttaactatcggatagggcttattta

SEQ ID NO: 24520 - DNA, 6378 bp, Oryza sativa
gctctggctgcctgttggtcagtctctcaatctcctcatcggtcatctcttcaacgaacccgccaccacaggatgggcacttgatctcatccaccatggcctcctcaatggcctgctcgcattcatggcaccagtaccttgtgattgcagcttctgccatcttgcaaatccttcggttgacggcaccacgatcaaaacgcaaatctgtgaaccgggcaccataataagttaataatccgtaagattcccaagcaaacaaccacgacatacacattttttatcatctacacgagagagtccagcatcttgccagaagtttaatcaagaagaactgaaacaagatgaacactacggcatccatccgtgactggatttcacaaagacaattgctggcatacagatctcacaacagatcagcatcaagaacaaagaacaagggttagctttgcatccaacacacgaaataaattagccttttttgggttcttcatcaacaggggcagcaagctgtcccagagaaaagacccacttgggggggatgaggcacagcactgacagatagatctttgcgaaggggaaggcagagatcaagagccaagattccctctccaagaatcaggtgctcgattccaattctttcagagaacacgatgctatcccccccgaaagaggaataaaaacgcagcagaagtctttggtttgggggttagaagaacaagaaaccggattccggcactgctcaagattcacgccattgcaccccgtataatttcgtcgcaggactcatcttcccccaccaaaatttcctctttttttaaagagaaaaatctctagattaacatacaagcgatcaaagggggaaagatagaaatcgtctccatgatttcgaacactggaacgaaaataaaaagaatccccttttgtatcaaactaagcagaaggaaaattcaaatcaagaagtgactaaccattcgattggactgggatattggattggatagaggcggtcgtcttgttctcgtttgcttcgggcgaagtgtgagacgaagaacaataagttcagagggcaggtggctgcaaagctggatactttactccatccctagaggttatcgtactactaccaattttttttctctcgttcttgaataagataaagttttttttatatgatcctagcgcaaatctccaaccaataaagttttgttatgactaagcatacaaatcacgcaaatccgctgatcatcttgggagattttttaatatctgtaaattggagtttggctgataagaactcgttttcatccaaaagcaaaactacctaccagactagtatgctgttggcttctcccttgtattattggcgtgttaatttctataaaccattttcaatttattagaaaaatcttgttataatcttttttttacgaaataataagatatgaaatgtcaaagatataaatgattttgtcaaaatattttgtttttgatacttttcagcgaaactgtcgacgatggtatttgtgatacttttcagctaggcagcgagggccttatcttttcgcttatacttatatttatcagccaaagattaaaattttaacattaaatttgaagccaattttaaggtttttttatcgaagtttatttttcagctttgctcttagatcgctaagaacacatataaagttttattcacaaattactttcgtttgcaaatatgttattttgcttattcctgcaggttaacagcactgttcaggccttgctaaatgatcctgtctaaaaaaatcgtttctttaaaaggagatttgtaatttggccaaacatgagtagatgttgtttacttcttctttttttcatatatgccatgtgtatgacatgtggctttggtgatgatttcccaggtgtagcaaatgaacactaatcactcaattatggggcaaaagagcacaattttcttcttttaaaccacttagtgtttcaaatacaagaaccgttaggatttcttttttaaaaaatattttaaccttttaaattttttaaaaataaaccatcccaaacttattactaaatctaaaccttgacagcagtgccatgtccaatgtttatcacatgttttgttacgccaaatggagtgccatttttaaaatgttcaaataatttttagatagtttctttttgaaaaacaaaaaattaaaaggttaaaaaaatattgaaatgccaagaggggcaaaggcaaccatatggtttacttggtcaacctaaatctgcttccaaaaggttaattaacctctaccgtaattgggtaacttaatcacgacgtactccacctgcctgtcaatgtcatactttacacctgattagtactcctacttactatacttattttggaactggacctatctaatttctcctagtcagaaccaaattttctcctcagaaagatcccatttttttctcatagaatattcacaagctggtacttctagaagataaagaaatgttaaatccggaccgacgatctggtggtctactcgccgatgtcaacgtgccacctgcactttttgggcctaaaatgggccatacatgggccggaacccggcccatacaggtccgtgtgaaccaggccggatactgcggcccacactacacggcctggcccatgaatgatcggagatgagagcaagggtgacgtcagccatggcggagaagccaatccacctcctccctccccttcacctggccgccggcggcggcggcgaatttgccgaaggcgggagccgtgaggggaaggacctgtggcacgaggtggtggcggcatggagttcctgcaggggcagagcacggagaccgccgtggccgtggcggtggccgtcgtcgccgtggccgccggcgcccgcttccttctcctactcctccgcagcagcaagaagcccaagggtatgcacccggaagatctctcttcactcgacgacgctgcagcttccactgccactgaccactgcgatacaccgacactgattgagggggcatctacctagcgatgtcttcgggcttagccatcggatgctcgcatctgttctgcagcatataaagaatgggttcgagactgtgaatgtcttcttgaaggaagctaggatcatctttggttcatagctcatcctgaatggttgtgctgtgatttgttccattaggctgcttggaccctgagaacttcaaggagtttaagcttgtgaagaagaggcagatcagtcataatgtggccaagttcagatttgctctaccaacccctgcttctgtgctggggcttccaattggccaacatatcagttgcaggttgggggttatatcatatgtcttcttgcttctctcatatcttttgtttctcttttacaaagaattgtgttaaatgttatctcctgttcttgcagagggcaggatgctactggcgaggaagtaatcaagccttatactccaactacgctggattctgatcttggacggtttgagcttgttattaaggtaaaatttcacaaatatgttccattttgaatttgttagtcttgtctcgctagctttgtgcgtaatgtaaagctatagtccgtcagaaatgcaattatgtcaattcatccccctttcctggtttcccccctaatttttccttctcattttgaagatgtatccccaaggaagaatgtctcatcattttcatgagatgaaagttggtgactatttatctgtgagaggacctaaggtatggctttatttctgttgtaagtaatacagaaattttccatgctgtatttggccattcttgtgatgtataattttttctctgacttggttataaatctttgtgcctgtataaatttgtctgtgacttagggtcgcttcaaataccaacctgggcaagtaagagcatttggaatgttagctggaggatcaggcattaccccaatgttccaagtaagaccctttccaacaccaattttttttatggcatttaatatgtgagacacctgtgttcttcaattcattgtcctcccttactgtaggtcacaagagcaattcttgaaaacccaagtgacaatacgaaagtgcacttaatctatgccaatgtcacatatgatgacattcttctaaaggtatgatcttgttgaaagaattgctgtagttctccaccagtgattaaccttactggtgtttgttatatttaaagtcgcttcaattcatgggtgcctattagacttggatactatatgctctatccgttcagcttatgatattaagaataagaatctggtatgtctggtttttgaataaagggtagtttgtctagttgtagtgcaaagttagcaggttataccacagaaaccttgaaaatatcatacaggacatgtactttgttaccagataaccagaattccatatatgtcgtctcgataatcttcttccttaataatctggtaacagcccactttttaattgaaagtcaaagatgatatgcaaactatctctcagtggcctaaccatgaacacaatcaaccttgtattgtagcttgttttgctatgtagagtcctttctctttagatctgttggagaaaagtaaggttccattgttgaagtaatgcttcatatgtgcttttcgataactgaatgagactactgcatagtttctgtaagatgaacgtggttcaatatgtagtacgatgttgtgcttgaaagctgatgtttgctaattgctgctgctcatttacttgtcgctttgatttatgcaggaagaattggatagtatggttgaaacctatcccgatcgcttcaagatatactatgtattaaatcaggtttgttttctgttctgaggtctagtactttgtactgtggtgtgcaataatttcatgcctgaactgtctactttggtagtcccatcttctactacttactgctaatactactatattatggcttgcattaaattcctaccatgcaccttacaccatcagctttgttttcatgagcagcctccagaaatctggaatggtggtgttgggtttgtgtcaatggaaatgatccaaacccattgcccggcacctgctgctgacattcaggtaggtgtcacattgtgatgtcttctgtggtagcgtgccttctggaacttggaaccgacaattgctaagagaatagttgaagtgtattccatctaccaagcaggacatctgtgtgacaatgtatggttgctcctttcagatattgagatgcggacctcctcccatgaacaaagccatggctgaacacctggagaatcttggctacacgaaggaaatgcagttccaattctaagcctccacagtggaacaataccgaaataacagcgatggacaacattttcgttcaccttcagtagaaattgtctgaccctagtgccatttaatcaagatataggcgaactttaaacccgataaaagtagaatgtcaggtcagcatattttgagtgaaagcaaaaaacaacacctacttgagttggggtcagaagttcctgtagcccatcatttttgtgccaatgctgttcaattccagacagacagaatgaaactaattatttttttttcaatcagaattttggacacaaggttggaacgttcattgctccagctaactcgttgctcaggtgattaaagaatgaccaacttgtaccatttgattatgagaagaaaaacaactactgtacgtgccatttatgtctgtccatagatgcaaaaacctgtgacagcgaagctgttgtctgttcttttccagctcctgtcctgtacagccaaaacagtgcatcaattcatccgcttgtttatgcacaagattgcaaatctttgacagcaaagcaatcgccttttcttttcagcagctccaattgatttggtattacatacatacaaaaatgcattgtgtcttgtacgttactgtacgtatgtgctggcttcctaggagacatcagcgaggagattacgtccgcctgctgggcacacaagcattcggttccattttttaaagtaaatttcgggacattaaaactattttatcaaaactatcatgttgctgcaactttagttagtcatttaggcttcacctctcgtgcatgcaaaacagagcgacgtattttcttaattttaatatatttatatgatttttttaaaagtagcttttgtatagaaaacttttgtaaaaaacacaccgcttatcaatttaaaaagcgtacgtatggaacacgagagaggcgagttggaaaatgtgggaaagaacacagccttagagaactgtgtagaactatgttttataaaaaactatagttttatttgtttgatagtttagagcccttatat

SEQ ID NO: 24521 - DNA, 635 bp, Oryza sativa
  unsure (1)..(635): unsure at all n locations
agagttgganacatgagaattgacattccactcggtaccctgcgatggaaaagntagaaaatcgaagaaaaagcttggagctaaacaaggccaagttgatgggcttttatgtttctgtatccatgatgcaatgaacctccactgctctttgcattgtctatacatctactacaacggtactttgggtttttgtctgaagtgaaccaaactaagtgcatactacttgtcttaagatgaattcagtcattttgctacgtctcatttacctgccagccatatggatgatagtagatgcttgtgttttcattcgccatatgggtgtgaaattctggtctttttactataccactgaatttgaaactgagtcgtcgagggcgtgttgcgacttgtgacgaaacagatcgatctaaaaacgtgccaaatcgcaagtaatcacaaactggatcaaattcgaagaattttatattctgcaaaaaaatacaaaatgggtgataatagattttttttatttttaattttttaaaaaatatttacagtaatattatactagagaaaatattacagaaatagacttcttgtcaagcctcccctttcccccccccaaaaagagggggggccccgggggggggaccccc

SEQ ID NO: 24522 - DNA, 770 bp, Oryza sativa
  unsure (1)..(770): unsure at all n locations
gaggccatgantttgaatgtcagctggcacccgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggtggcacggtacggccaattcggtaagagtgagagtttacagtcaagtaaggcgtgcaagccaacgttaacttgttgagtcgttttaagtgtaattcgnggcagaattgttaaagagagtcctggtaaattatcaagttcgacaatttggttgcct

SEQ ID NO: 24523 - DNA, 777 bp, Oryza sativa
  unsure (1)..(777): unsure at all n locations
tagggctttgaattgaatatctgctcggcacccatagcaatttaacttatatgttaccgcagatggctgctgatcaaatagacataaaagcaaaatatgtacataagtaaacagtgtctaagcagctaccagcaaataaaacactacagagcaagaaatgcgtgatcggcagtcaatatcatacgaacacccagggaagaagcactacgggcatttagaagcacaattgcagttcacgcatatgttacacagcacaatctcacgagcaagtaggaagctaacatgctcattcattcacataatcattagatagatcgcaagagatcaatcactttaccgatgcggcgcctctgcttgcgggcgggctggttgaaccatgtcttgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtt

SEQ ID NO: 24524 - DNA, 996 bp, Oryza sativa
  unsure (1)..(996): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactggtgagcgaggctatgttgatggcacaacaagagccagtgatagaagctatgtggatgccaccacaagagcgacagaccgagcctatgctgaggctaccaggggtgtggacctacggggtggggcgttgagaggtgctccaagaaggtatgtgtcccctactagatatacaggggccgcaggaattccatatcgacctgtttcaacagagcctgtgcttcgaaccacaccggagctgaagtatcgaggcccaggtatggagccccctggttttcccaagaaaagagacacattgttctcaagcaaccagacagtagtagatgatcatgttgattgactgtttaattagcggtgtagacaacacgctaaattttgaaggggttttgaaaatcctgcaccaatgtgggcagcgatccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24525 - DNA, 1399 bp, Oryza sativa
ttaacacccttgcccacacccaaacgcccgagccaactaatcaattaaccagaaacggaagagcgccaattaccaaaccccttctcccgggggttggcgattcattaaatcaagtggcccgaccagttttccggcttgaaaacgggcagttagccccacgccaattatgtgaggtagctcccccaatagcacccccaggcttcacacttaatcttcccggttcgtatgtggtgtgaaattgtaacggaataccattttccccaaggaaccagctatgcccatgatacggccaagctattaaggtgcaccaaaagaataccaaagcttgcatgcttgcaggtcgactttaaaggatccccgcaacagacagcatctcgccgttttcgtgaggcttcttcagtgattctgaagcttatgtgttttcttgcacacaaaagtagatcagctagcagaaacgtgttgctagtttggtcaagatttatgtgcgaaacatttgacactgctgccagtatttgtcagatgaaaacgctgagatctcctctatcttgggagattttgcacgcctgatttaactctgggtcgttttcgttctcgcatcagcatttcatcaaatacccataagggaattttcccgagctttgagctgctttagaacaaggttcagatgctgatcatcagcagttcaagatgtgatctgaagcacggacagaaattaagaaacgaagtcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaattctatgtgcctttcaaatataaacatttgagggcatgatagttacaaatgaaccacaacacactaaataatactgctctatataaagttttatgtgatcaaaattattggccccatctcatattgattatggg

SEQ ID NO: 24526 - DNA, 731 bp, Oryza sativa
  unsure (1)..(731): unsure at all n locations
aggcctgaatgcaatcccatgagaacccattctgacagccgcagnngactctagaggatcccctgttgaataatataaccaaactgaacatatatatatgtccacaggctaatttaccacaatgatatatatatatataatatgagatgataaataatacggtgacactgccaatgttgcaagatcgatcgatcgatattacgtacattacatatggctggcccataaaacaaacttgctatacattcgatcagcgtgggactgaaacgggaacattaacgaactacgtaccgatccatcgatcgatcaacattgcatagtactctctcgttcgtttctaaatatttgacgcctttgatttttttaaatatgtttaactgatcgtcttatttaaaaaaattaaataattattaattattttttatacaattgatttattgttaaatataattttatggatatatatattattttataaaagtttttaaataagacaaacggttaaatatgtttaaaaaaattgaacgcgtcggatttttagaaccagaggaactattaattattcatggtgcagtgcatgtagatgtaacttacctatatatatattcccttcgttccaaaatatttggaggcggtgattttttttaaaaatttttgaccattttgtttattaaaaagaaattaagtaaatagttaaattttttgtattatttggaatatggtaaaaatag

SEQ ID NO: 24527 - DNA, 753 bp, Oryza sativa
  unsure (1)..(753): unsure at all n locations
ccggcaggatgacaactccttatgcccgcacgncgactctagaggatcccctgtccgtgcatcttcttcctgcagctgacgacaccattgcaagctcggtgggagtagcagtagctctgttgttcgggtgttctgctcaatggccgctcgagcactgtctgctgctgccgccgccgccggtcgccggatggcggacagactggcttccctcttcttgcctcctgcaggtaactggctataactgaaagaatgggagctctgattcatgtatttctcctgatttttttttttttttgcttcttcattggattgtttctgctatggtttatcagcgtccagtacgttagtttagtgtaggccgtgaatcgtgatgagctgatggcgaccccagtatcttgccttcgaacttctctttggactatttttttttcctctttggtttgcaaccctcaatcgatgataaacatgccacctttttatgtggaactctgaatgaacgttcatttgggctgatgaactctgataaactctgatggagaaagaaatgagccaagcaaggtcaagttcctttggagatgtttctctcttgtggttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 24528 - DNA, 1173 bp, Oryza sativa
  unsure (1)..(1173): unsure at all n locations
cgtggccttgtttgtttnnnnnnnnnnnnnnnnnnnnnnnnnnnnnnnnnnnnnnnnnnnntgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggtgtatccaagcatgttctattcagacggagacggccagtgattggcacacgcacgagtgctctgctcttattagcttcttctgaaattgcccccttgtgatgtagagcagagacttgtgcaacttggcctagaaatctaggagatcctcatggtggtctttatgtctagtttaacacttgcagtcgttttgtagttcagttattagctgcattaccatctgatagtagggtgtgactgcactggatgcaagtgtagttaactagttgttgcttttccactggtgatggtaggtaatgtttcgttctgtaagggtttggaacttttgttcttcttcacagcaatggtttggaacactaatgtaatgcttgtgcactttgtcttgtgatttggtgctgctccaaattttcttgcaggacaaatagattttcttgtactgggatattttctatgtacttctgaatcggaatcacattggtaactttgatctgtaattttggagtttcaggaagcagaaagaagcctagtgttccggtaatgggttgataaacatattggggcaattacaaatttaccacagttttaaattgttattgcaaaactacattcgaatagcattcttgcaaaatatcataaaaaccagagtcttaagttagattaagaaaaacaatggacaagtttgcaaatgccccaaacgtataagatttacggggatcctctagagtcgncctgcaggcagacgaagtagtatcatcaagacgc

SEQ ID NO: 24529 - DNA, 13030 bp, Oryza sativa
  unsure (1)..(13030): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacataaacttctcaccagaccatttcttctgcttgtcaggtaaaactactcctgtcttgattaatcgaagatatgccgacggcaaaagctttgttttggacatttctgctgacactgacaattctcatattttcatataattttcttattaactcatcaccgagctgaaaatccctaattattttactgactaggcaacacaattttgagaacacattaggcaccacaatttaaaatactgaattttcatcttcttctctaagactctaagcagcacatgatcacactgatgctgaccttaaactttcctactcttttttccatctagagaagaacaagactctggcgattgaggttctgagttctgactaagacatcaatcaatcaagatctctcttgaccatctagatacatttatatatccctgatagctgattagttggcacatcagcatcagctaacgatcacaagacggttacagtaagtgctccagcaagctgtagctttgcatcctgcccaaaacggctcccatactatagctgttgtccattgcaccatggatggattctctggtgccggcttcacgacgcgcatcgccgatgacgacccgccattgttttctctctttctttttcaaatgttgttcttgccattttcctgtttgaagttttccaagcaggcgatgcaagaaccgagctgtgcctgcctgcacaatcgcaaacatatattttcttaaaacataaacaaagatcacacagggatagtaaaatatgatgaaacaatattcagcatcaacttgattctttaaaatttgggtttgctaaaagtcttcagaattcagggcttatacaaatatacaatatctgcagtcgcttactgtcttggcctatcacagagccgcttccatttccatcgaaatttcgcttcaaagatcagaaagcgagtacaatctaatacgcctccgctgtcacaagcgtattactatctattacgcctttatgcggggaatgcggaagatgggccttatatccggcccacgtagaggatacctttgcttcgatatgggctggcccatgagaaggcccaactagagcggcctcggcttctcttctaaaaccccacctcgcctcgcgtcctcttctccaaccctagcgcgccgccacctcgcgtcggcatcctcctccgcctccgccgccgccgcctcgccgcccaaggtagggtgccttcccgtccatctcctcccctctcgcgcagcatttctggatcagtcgaggcttccagttcgatctagaccttcgtccattcggatctcggttcgttgtactgcgcgcgcgctccgtttcttgtttgtttctggatgtagtgagatgttgtggagctaggacgagagatctcactgttctgttcttatggcagcaggcgaagcgaagctcgtgatttgtaatttgtagcagtaatttttggttgattctcatgcgttttagtgggatctagaacagggtgttagccttttctttcagtaatctggtgtggatttttgctgcaactgttagtaagagctgttaggaaggaatcgcatgatgcttatggtttgtgtttgtttgatttggtgtaggtaaggtaagccatggtgaagcacaacaacgtcatcccgaatgggcacttcaagaagcactggcagaactatgtcaagacatggttcaaccagcccgcccgcaagcagaggcgccgcatcggtaaagtgattgatctcttgcgatctatctaatgattatgtgaatgaatgagcatgttagcttcctacttgctcgtgagattgtgctgtgtaacatatgcgtgaactgcaattgtgcttctaaatgcccgtagtgcttcttccctgggtgttcgtatgatattgactgccgatcacgcatttcttgctctgtagtgttttatttgctggtagctgcttagacactgtttacttatgtacatattttgcttttatgtctatttgatcagcagccatctgcggtaacatataagttaaattgctatgctgtttcttaattttatagtttcttctggtaatgtgttgtgtgatttattggtgctatcataattttagtttgctgcatagccagactagattaaaattcagtggtctggatcttgataaaccctcatctaacaatttgtgcatgtgtttgcgacaaattgtctactttatgctttggtaccagtcacttatcgacttaaactttacatgcttctggattctatttggttttgcatgtacaataagctaaaagatgctttgtgtatttcttttagttctgctccttctattatttaaaaccagccacaagatgctgtgagttatgcattgttgctgtctaaattggaaaaaaaaaaggaatgctcaagtgctatttgtagtcctgcatgaggcattaaattttatgtttgaagatgctgctatttcttttttacccagcatctaattttcttttggtgttggcttttgcagctaggcaaaagaaagctgtgaagatcttcccccgccctacttctggaccacttcgccccattgttcagtgccaaacacttaagtacaacatgaagtctagggctggaaggggcttcacccttgaagagctgaaggtaaatcagattgcttgtttgaatagcaacattgtagctttgacgccataatgccgttgaaactttaccatgtgttatatttggatcgtgattctgatctcaataaacctattgcacacaggcagctgggatccccaagaagtttgccccaaccattggcatctcagtggatcaccgccgtaagaaccgctcacttgaaggtctgcaggccaatgtccagaggctgaagacctacaaggccaagcttgtcatcttcccaagacgtgcccgcaaggtcaaggtgagggaactttacccgccttagccttacacttaaacccactgttctgaagatcccttacattaaccaactcctttcgcaggctggtgactcgactcctgaggagcttgccacagccacccaggtccagggtgactacatgcctatcacccgtggcgagaagcgctcggttgaggtcgtgaaggtcacggatgacatgaaggcattcaaggcctacgccaagctgcgcgtggagaggatgaaccagcgccacatcggtgcccggcagaagagggcggccgaggctgagaaggaagagaagaagtgaaaggattgcaacctgcaacgttaagaatagatgccctaagttttattaccattattgttatcagcttctcctgatgcgagactggcattctgatcttgctgctgtctgtctactcttcagtttgagcttgtttgggtttttgtctgaagtgaaccaaactaagtgcatactacttgtcttaagatgaattcagtcatttcgctacgtctcatttacctgccagccatatggatgatagtagatgcttgtgttttcattcgccatttggctgtcaaattctgttctttttactataccactgaatttgaaactgagtcgtcgtggtcgtgttgcgacttgtgacgaaacagatcgatctaaaaacgtgccaaatcgcaagtaatcacaaactggatcaaatccgaagaattttatattctgcaaaaaaatacaaaatggttgataatagattttttttatttttaattttttaaaaaatatttacagtaatattatactagagaaaatatttacagaaatagactctgcagccctccccgagggcggccagatcaccttgccgcccttcacttgggtgatagggtctattttttaaatatttttacgggtataatatttttgtaaatattaaaaaaaattaaaaatgaaaaaaaaatcttggtaataatgtggcggcccactaagctccagctagaagcccaaagcccacattagtttgggcccattaatatctcgggcggccgcttatcccctcctccaatcttatcgtctcctcgaagctttctcccaaactgctcgtccatggcgttcgccacactggtgggagtgggaggcctatcgcctgcccttttctccccctcccgccccctctcctgctccagctccacctccgtctcggccccgttcatcctccgcgccggcggcggcggcgacgcccggcggcatggcctccgacgcctcgtcaccccactgagagggagcgcctgcagggtaaactgtcgcctcctcctcctcagcttagcatttctagttggtagctcgagctgactgattggcgctgctcgccgttctttgtttcctgtgtattattttggataagtcacactgttacgtgttaattcaccagacttatcaagcgagtagctcttctttatggattcactgactcaagaaaatgcattttcatttctgtagatatttgatttgtcatgacattttcggttggatgtgtgaaatacatttattatgcaccatttctagaataaaagaatcctctccagttctgtagacgattaatttgatgtggaagaatgcatatatctatgtattatttcaacagggagagagtacgaactcacgtgtactccagtgtgccaatgaggctaatgtggtgaccgaggatgacattgtgaacgatggtatcgatgatgaaaccgcttccgatgctgaaatggatgaggatgctgaagcaaatggtgatgagtcgtcaggcactgatgaagatgcttctgtctcctggatagagcagcagcctcttccttatccttcagtaagtacacaaataccaatttgtggttttgcacagagtagtagtgacaactgtgtgatgggaaatgtaggatgccctagagccatacatcagcaaggagacggtggaacagcactggggagttcatcagaacattcacgtcgagaggctcaatggcatgattggtggcagtgagtgggaggggatgtcgctggggcagatgatgctatcctccttcaatgagggcagggaggcaccccatccccccttcttccatgctgcacaggtatcattccgtatgctgagctgtatgtcctccatatgactaattactggacattcttttagatatggaaccatgatttctattggcgatctatgcaacctggtggcgggggaaaacccccagaacgccttttgaaatttatcaacagggactttggatcctatgatggcatgattcgacaatttatggatgctgcatcaactcaatttggttctggatgggtttggctttgttgtaagtgatgtacagatgcttagcgacatacttattagcttcatcgtaccagtttcaaaatttgcatatgttggtgtgatgaactgaactcttttttctgtaactctctccagacaaaacaagcaagttgcctcatgtgaaatcaagaagcccaatcccatctgataattatggtagactggtcatctcaaagtctccgaatgccatcaatcctcttgtctggggtcactctgtgagtattaacttgaaacacttaccctacattgctatgccattcttctgtcatgattcgtatgcaatggctaaagttgaaatgcaaagcatacgcctggcactgtatgtctgctggtttttttttgccgtatgcatatccagcagggatctcatgaggctatttctttttgcagccactccttgcaattgatctttgggaggtatgaatattgcaatcaggtttctctttcttttcctggcatttttattaataaacaattatactaacaaaacctattactttgggcaacagcatgcatactacctggattatgaggttagatgacaagtgatgcttacatttagtacttaaaaaaaacattttgttttacttattttgttcatggctatatctttgcaggatcggagatctgactatgtctccacatttctagagaagcttgtgtcatgggaaactgttgagtccaggcttaagaaggccgtacaacgggcagtagaaagagatgaatatgttagcacaaagcatataaggaagcaacttttagctcgggcaaagagccaaatcagagctatgcctcagcaggtcaatggggatgcaagagagcagaccagcggtcaagagaagtccctaggggtgtgacaacggagccaagtaagctacggcaggtgggtcatgttgccgagttgaaccatggggatgatggacttgtaacacaggaagctagagcagctgatcaatcttcaaggtagcagtatccgaagattgtatgcacatactgtgggcaaccctttgcttaatagcaaatgttgtcgtacaggcagcttcacagtttctgtcgctgtcgatgaatagatctgtagttcgtgacactgcagcaaatacaagtcacaaacccagagtcatgtgcgagctaaattttgataggagtaattaggtttgagtatcatagagatagacaagaattagtcacttggagcaaatgagcctgacatcttgtattcctgtgctgtccatgtttgaatcctgaacttctgattgacaaaccaaagaaaattgtagttccgaagaaatacatcactggtgtcagtaatgtttgtttcgacaggctctcatgaattgccatggtggttgcttggtacttggtaatgaggacctacagttttgtcatagatttccatgagctgtgtgttattttctggttgctcttgtccaggaactcaataataatgtcctgatgcgttgcgctacatttttttagaaaacagtcaactttcattacccagctttgaaaccaaagccaaaagcagcagaacagagcattgctctgcatttacaatctggtttccaaaagtttacctgttgcacctgatgccagagattaacacactgttctctatttctctacttattctagccgtgttgttctacccttatattctttatctctctacttattttccttttatgtcatttgcgctgatgtacaaaatcctcgatttgcaagtcttgcgtgtattcctgaataaaaagaacttttgggagtaaggccgtgtttagttcctttccaatttttttttaagtatacggacacacatttgaagtcttaaacatagactagtaacaaacaaattacagattccgcatgtaaaccgcgagatgaatctattaagcttaattaatccgtcattagcaaatgtttactgtagcaccatattgtcaaattatggtgtaattaggctcaaaagattcgtctcgcaattttccgtcacatcaaatggcgcttagcaaatgcggcggtgccagaattgcctcttcctagcttggttccacggtcacaaaatctagtcagagattaggccttttgctccattctgtgtcctgtaacccgtcctcttcttttattttttagtttttgggtccgttgtacataaactttattcctattaataaaaaatgcgctgcttgcgtattaaaaaaaatctctactaataacctggtcatcacattgacaaaatgacaagtacaaaagcggaataaaatcgagtaaactattcaagcaagccagagaatgaagaaggccttagaaagttcactgttcctccctcaactatagcctcagtttgtttgtcatccctatatcacaatgattttcggcccttaccgttcacaaaaacctcatacgagatgtcatcctgtactgtccatgtttgacttctgaacttctgattgacaaaccaaaggaagaagttgcaagtgagatcgtacggttctcttatggttgctctggtccatgaactcaacaatgtaattagtcaaaaaaaaaaaagaactcaacaatgtccatatccattgctctgcatttgcaattggtttccaaaaaaatacttatttcatttaattgtttaggattcctacaggcactactatagtactacggagtaggagatagacaaaccaatcaaattaattagttttttctcaacagtttgctttaacctattagtagtaggcaacacataaagccttttttattccttcagtatcagggcaggactgtatagcacaatcttggaatatccaaatatctttctctctctctccaagcaaaatcgttgacgtgataaaatctaaaaacattaaataaaacaaccacaaaaaaaaatattttttccttctcatcgaaattatcgccacacacgagaggctttttgtctgtgccatccacgagtcgcacactcgtaagccacgtcgccaccgccgatcaggagtcaacaccccaccaacggccctgatcaggacacgtgtcctgaaaggctaaaaccaacctgcaaaatacccccttcctatataaactcataaaaaacgcttggacatggcgtccattgatcttcctcccccctccaactccaagaaatcgactgacgccaacgagaacgagacgccatcgctgccatgggtttgcaggtaaattaaacgaatcgtcttcctgcttcttcttcttcttttcccttctcgtgattttctttgtgttttcttgagcggatgcgcataggttgaatggatattactcctccgcttgttgaaatcaatctacctgcagatttgctggttgtttatcgtttaggattttcttccctttggcatgcaatatatatcttgtttggagtaccatactaccatgtggtttaacagtatgttaatttgtaattaaccaatctaatctacctgctgttcgttcctctgttggttaatttagtagtgacagtgttctggatcaagtagctaggtaggtgcagtagtgataaaagatcaaacctttttgtgctttagactttagaggagccatcagaaactgcaattgatgcctttgttatcctgttcttctgaactccaaatatgcagagcagtttcctgaggtaaacaaattcaagtcgattctgaacaaattagttgttgttcttgttgtgcaggaggagtttgaggagttcgccgagaaggccaagaccttgcctgacacaatttccaacgaggacaagctgcttctctatggcctctacaagcaggcaaccgttggcccggttaccactggtatatataggccttctgctcttcttgaaacgatgcattcatcaattgagctaattaatttgctgctgttcaagtgctaagattccatatgctttcatgatgatcaggcaagattagctttcatatagttgcatctgaatcactgttttgtgttttgactaaaaaggattatcgatctgcttaagttttgccacaaatttagtgcttgatgagtgtaaactcatctatccttgtaatctgcttgtcaatttggggtgtttaatattacaatttccagaggaattattcacctattacagtactaagtggtggttgtcatttgaaattgtagtaacatatggtattcttatgtttctccccgatggggactttgcttagcagctgttctactttttttttaaatcatgacctttcaagttccaaaggcaatgcttttggacttgtttcgtaatacagacaccaaagatcacattttatcctcgagttatcgtatctaacaattcagtttcatctttcagggcgcccaggtattttcaacctgaaagacagatacaaatgggatgcttggaaggccgttgaaggtatatgccgatctctttaagtcctcaaaaacatatatcagctaaactatataactttgtcatatctgcaaactcccatcaatgcttacaaatccaaatcatggtgaattcagggaaatccaaggaggaagctatggccgattacatcaccaaggtgaagcagctgctggaggaggcttctgcatccacttcttaggctattatgaacaacaccatcaatagtgctgcatatatgtaccaataaacataaatactataccatcatcaggcgctttgtgatcatcccttctctgtacttgtaatagtttcaagcagactcggtcctgttaattgatcatgactgttattaagtttgtccgtcttttctaaatttaacttgttgctaaggctacggtttggagttgttgggattttcttatacgcaaggattctattaagcatataatactataccctgtttagttcacgccccctgtttagttgacgctaaaattggaagtttggttgaaattgtaacgatgcgatagaaaaattagaagtttatatgtgtaggaaagttttgatgtgatggaaaagttagaagttcgaagaaaaagtttggagctaaacaaggccaagttgatgggcttttatgtttctgtatccatgatgcaatgaacctccactgctctttccattgtctatacatctactacaacggtactggtgtaatttaattttgtgggaactgtcatttcagtgtagttggtcagtaaatgcgtacaaaaacatactagcaatgatcaatgatatcgattgcatatgaacagcaagcgaagaagacaaacagtaacaacagtagacaatggaaactgtgaaggcaaaacagtaccaacaattaaatcaagcagtagacaataaaagcaaagaaagtgaactgttggatagagaacaacagttataaacgataaataaaacaaaacaaaaaaaataagtgctgcgttgtatgaacagcgaacattgaaactatccggttgattgcactaataactggtctgcttttaagaaaacatgaattctataggaaatagttcaaaactcgtaaaatccggtaggacatgctttacattgtcagacaacctgttgccgcggcagctgcttactatacaactatttactcaacaaatatttattttgcatatctaaattccctattctatattttttttatgtccatcactttgccaaaaaaaatttagacctatagtaatttagcttcttgaggatactttaaacatggttagacaactcaacaccgaattaattgacacacgccttcctcctatcgaaagacattccccttccaactggtcaatttcttctataaccttcctcaattatatatttgccaatccttatgagagaatttcttactcaatccatactttgttcatgagtataattaagtctgtctgtcttctctgaatttaacttatcgttttaaggctacgcttcggaattgtgggaatttttcctagctgttgaatgaaccgaacaatttgccttcaaattcctacaattctacgaagtttgtctgtcccttttgtgcttgtttaagccaacaaggattccacaagcatatactgtatactgcagccgtcgaccatggcgtgcctgccatactggagtggagtgcacctcctctcctgcagattcatggcatcttgagaaaagaaaagagtcagggagaggatgaggatggcaaaagatgatggtgtttctctctatccatccatctcctcttttgctggaataatcaggatgatgcaatgaacctccactgcccttctcttgtctctactcaaacacatctactatgtactactgaagtatagtttttttttcgaacgcgtaaaaggattgcacgtcaatatattagaagaatagagttttttgaaacacgacgcactcaaatagaccggcctatgccaaggaaggaagaaaaacaaagataaaaaataacgaaaggaaaggaactctgctccaaacaactggagggggcagagccactctacgctcccaacaattccccaaaggaagcgacggccgctaacgaccacagccggccctctgaaaggatggactctaggactactgcgaccgaagaaagcacatagtcaaagaccctagagttataggactctaggactctgggactactgaagtatagtaaagttgcagtagtgtatttagttggacaactgtcattttagtgtagtttgatagtaacaagtgtgtgcaaacaaactgtatgattgcttgaaaagtaaataatgaaagcaaaaggaggaaaaaccagtaaactatgaaagcaaagaaagaaattgtctcattgcatgaacagtgaacaataaaagtagagaaagaaaccgtttgattgcacgactggtaacggtttcttctctcttttgtttccagggtagtaactgtttcaaggcagggattttacatcatttcagcaaaacaagttcagattccggaagaaatgttccgacattatctgttctaagatctacacaacagaaacaaagaaaaaaaaatgttcagtcacctgcaagtgcatttctttaccaagttatcgttggaagaggggttacccttgctagtctggttacgacggttactatgcaaaaccgaaaaaaaaaatcagacaaatttcatcctaagtttaaatttttatttaattttttagtaacttattaaataaacctggtatttttcattaccacgccatggcaaacaagtaaccacccatatcttaaacccaagtcacaagcgctgcccactgacacctcggccccacaggtagataataatattattagtcaacgaggctgtcctgtgtagcaggagcaataggtgccagnnnnnnnnnnnnnnnnnnnnnnnnnnnnnnnnnnnnnnnnnnnnnnnnnnnnnnnnnnnnnnnnnngagctggcaattcaattnnnncggccccccgntgcggctcgcgtggaggtagttgttacatctagggacgaccggtgtacgtatgctacgccaacgagaggtacacctacggtcaacacccngtgtaggttgtttggagacttagccgggtagtacctccgtgtctcagggaggtgtt

SEQ ID NO: 24530 - DNA, 45237 bp, Oryza sativa
  unsure (1)..(45237): unsure at all n locations
atgtgncnttttgantnnnnnnnnnnnnnnnnnnnnnnnnnnnnnnnnnnnnnnnnnnnnnnnntcccaatgccacccgggcccacatgttagncttactctccattcaaacaatatttatgcgggacccaatgatgagtgagggtgatatgtgggcccgagtggcatttgggaatgaaattttgggagagtggcatttgggcactggcatttggcaaatagtaaattctcccacacataactaaccgctgacatgtggggcccacacagccggccgagacataaacgacccactgacatgtgggccccacggagccgtcccgtccccgcactttcccctacacacaccagatcccctcttctaatcccaacctccaaaactcataaaactactctaaaccctactccactcccgctccgctgtcactgacaaccatggcccaccacgtcgctcccctcctcctcctcctcacgctcgccgccgtcgccgccgccgcgtcggaggaggcggcggcggcggatacagaggcggctgcggccgtggaggccggcctgctggtgcggcgcgaggcgcagctcgcgcggctcgaggagctcaccgagtcgctcgccaagtccgtccaggcgctggagtccgcgctcgccagatccgtggagcccgatccgccgccgccggcagccgccgcggcggcgcccggcgaccggagggcgccgcagggggtggccgtgacgaagcggaggccctactggtccgagcggttccacttcgccgcggccgcgcggctcggggacggggcctacgccgccgcggcgaccgcgctgccctacgaggacgcggatgggctcaccaagtacttcgccgtcggcgactcccgcggccgcgtcttcgtgttctccgccgccggggacgcgctgctcgagctggagcccggggtgtccggcgagccgccggtcaccgccctgctcgcgtacctctcgccgngccgcaccgattgcttcctcttcgccggccacgccgacggctccatcgccgcccaccgcctcatcgagtcgtccccgcacggcgatgactggctcaccctcgccgccgcgtcgtcccgcctcctcgtccgcggcctcgacgccgcccccgtgctccacctcgaggcccaccacgccggccgcgcgcgctacgtgctgtcctgcgactccggcggccgcatccgcgtcttcaccgagaacggcacgctctacggcaccgccatcgcctcgtcgacgcctctcgcctttgtgaagcagcgactcctcttcctcaccgaggccggcgccgcgtcgctcgacctccgatcaatgtctgtccgcgagacaccatgcgagggcctcgctgaagctctcaatggctccctcccaaaggcctactccttcgatccttccgagcgcttcaaggcctatggtttcactgatgccggcgatctcgtgcacgtcctgctgctcggtgacattgccagcctgaaatgcagggtccgggcaatcaagaaggctgagatcgacaaccccgtggcgatacagacgatcaaaggctacctcttggtagccagccaagataagatccttgtgtacaacacatcaactcagtactatgggagggttggggctccccgcctgctattcgccacatcaatcaaggatatcaagtctgtgtttgcgggttctggtggcgtgatgcctgcttcaccagctgggaagccgcttgttgccgcggacagggagaagctcgtgatcttgggactcggagatggttacattgctatatacaggtccaacttcccggtgtacaaaccggagagcaatgctgtggtgtggagtggtccagcgctgctcttcctcctgttcttgattggcatttggcaagtctatgtaaagaagaaggattcgttgggctggactccggaggagacatttaacacctcagtcacagctcctacagggagcattttgaatcattcgaccagtgaccgtgccttcgctgatagctcaacaagaactggtgagcgaggctatgttgatggcacaacaagagccagtgatagaagctatgtggatgccaccacaagagcgacagaccgagcctatgctgaggctaccaggggtgtggacctacggggtggggcgttgagaggtgctccaagaaggtatgtgtcccctactagatatacaggggccgcaggaattccatatcgacctgtttcaacagagcctgtgcttcgaaccacaccggagctgaagtatcgaggcccaggtatggagccccctggttttcccaagaaaagagacacattgttctcaagcaaccagacagtagtagatgatcatgttgattgactgtttaattagcggtgtagacaacacgctaaattttgaaggggttttgaaaatcctgcaccaatgtgggcagcgatccacatgtgtgttgttgtaagatgtaactcaaaaatgttgtatttgcatgagtacattacagccattgatatgatgctgcagatggtgaaataactttgaaatttatgggttacattatagctatgaaagaagggattgttgagctgttttcgtatgacttccatcttcaacgatgtaggaaaattggacaagtttacaataatttttaacaatgataggctggtaggatgtactatggaattgctttaattatacagtggcgtgttgagcatcagaaaaattcagcaagttgcatttgcaataattttagccatagacactacaatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttagaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgctcggtctgcagactgcaactacaggattcaccggttcagccattttctgcaggacagcaaaaggccttgcattcctttgttcactgaagtactgtttagcaaaagaccagcgctgtcagcagccggatcaacatctgtcacaaccggaatatgacaaccctagagtttcagaagttgaaagcgggtggagcattcaactctttttaggtaggtaggttcagactttcagtagcaaatcgtttcgtaggcgagcaggatcagctgcctgggccttgcatcctggaagtaacttcatgcttctaattgtagagcaatgctcctgtcgttatgctaaaacaagttcagattcgttttggttaacattaacttccacttcctcccttgtagtgggtattattccgttctatttcagtgggcagtaattcattgctaggcccttgcattatcaaacaagatttcaccaaaaaaatgtagacctgatatatcatcgaaaataaaccggatagcagcagaactgaaactctgggatgacaacataatttgagcacaaatgacccactatcattgcctctaaaatgcagaaaccggaggcagtgaaacagcacaaatttgaacttgagcaacaacttactgaaacaaaaagatatgaatataggaaaacaatgtaattctttactgcccagtggaaatttttcaccgaggaacagaattcatcaaatgtgagtataatgtaagctccaatgtttgctcacaggtgaagtgaaaaatgcaaaacgtatcctgactgttgcatcttattacaatctcaaggcctagaaaacaaacttcatattcatggtaaaatcacgacactgaaccagtttctctcgtctaagtggacttaacgatgaagttttggcggctgatggggttcatgatgactggtggtccagcggtgcgaggccaggcctggaacttggtgtcagtggcttgccaccactccttgtcagagacagtctttggaatggaacctgcgtccaatgaatgaagcagattaaggtccaatcttccgggaggttaagcacatgcctgtaagactaaactcacctccaaatgccttcttgtcagaaacaaatgtgtcacacaggtaagcaatggcgaaggatccaaccaaggacccagcaatgtatccggccgtcatttttgctgcacaatcatgaaatggcatacagattatcaagtctgatagaaaatgaatgttacagattattcatatgaagagaagcatgagtgaacatcacagtctagaaaaacaagtcccctgctaactgtagttgttctcaaactataaataagcagctttcttgttcattggtataaacacaacagacagacaaaaggaaataagctccagcgtacatatagtcaagcgcaattgtgtagaaatgcagatagtcaaatatgattccaagatatacaacttaatctccagctagtttaacaagttagattagtgcaagatcaaatggcggtcctcttgaaacaagtgatatgataaataatactggacttattgtggaagagtaaatgtgcagtacgactcaaaccacagcctacatataccttaacagaatcagttatagataatagagtagacacatcatttattctactgataatactccactatctcacagccaaaatgcaggagcaaactagacccaagggggcttattgctaactgtcgaagttgtcaaaactataaatcagctgctttcttgttctttggtacgatggaataagttccagtcttccagcacatacatagtcatccacagttagaaaatataactatcacgcctcaagcgcaaatgtgtagaactgtagataaggaatatgcgattccaaaatatacaactgaatctccagctagttcaacagattagattcgtgcaagatcaaacagttgtcctcaaacaagcaatatgtgattcactggacttattgtggtagaataaatgtaattaaaaccacaaccatcatatatactttaataaaaatcagctgaagatatagacaccttgtttatttattctcctgacaaatgccctactctctcacagtctcacatagcaacatctagacccaaggggattattggttgaagcaacgggttaaaatgaaagggttggcttgggtgggagtggatggttcatccaatcgaaaccagtggtagtatcgatggggccattcttcaactataatggtgtcaaagtatatgttcacaacagcaattttctattcgtaatgtgtattaatagtgggattagcaaaaagtcatttgcctccgcccctgctccaattaatcatagtatttggttaagaggatcacagagtagactccgcgatcgatcgatcgatcatccctgaggaatcggtagcttgtaatcgatcaaacacgaccacttcaaatctcgacgattcatgcacaaattcatcagagaagatgaaactgggacccccaaaacgcaggcgagctcgctgcgcaaacacggcaggacccacgaacgaacgagttaggaagcccagcttatacgtagagaagtccgacggagaggcgcagcaccatggaggagatgaacggagagagcagatccgcgagagatctgggagccctaggtctaggggggcgggggtcggcgagcacgtaccttggttcggatcggattccgccgccgccgccgccggagagagaagagaagagaggagaggagacgcgttcctggaaaggaggagacggtggcttcttggcttctctctcgtgcgggttaatgatcgattcctatatgggcctcgtgggctttttttgaaggcccatagcatgtttatgcaaaatggcccctggattaaaaaaattgcaaatatccaaaaggaggaaggggcagaagtcagaactcacaagcaaaattctgtgtataataaacctgcagctagctgcagactgttgattaattgaaccaaactgaacatatatatatgttcacagcaaattaagcagaatgatatatatatatataatatgagatgataaataatacggtgacactgccaatgttgcaagatcgatcgatcgatattacgtacattacatatggctggcacataaaacaaacttgctatacattcgatcagcgtaggactgaaacggcaacatcaacgaactacgtaccgatccatcgatcgatcaacattgcatagtactctctcgtccgtttctaaatatttgacgcctttgatttttttaaatatgtttaactgatcgtcttatttaaaaaaattaaataattattaattattttttatacatttgatttattgttaaatataattttatgtatatatatattattttataaaagtttttaaataagacaaacggttaaatatgtttaaaaaaatcgaacgcgtcgaatatttagaaccagaggaactataaattattcatggtgcagtgcatgtagatgtagctaacctatatatatattccctccgttccaaaatatttgacgccgttgactttttttaaacatatttgaccattcgtcttattaaaaaaaattaagtaattattaatttttttctattatttgatttattgttaaatatactttaatgtatacatatagttttacatatttcacaaatttttttaaataagacgaacggtcaaacatgtttaaaatggttaacggcgttaaatatttaggggatgagggagtatatagctagcctattctagatgatactgattaataagcgcgacaaagccggcgaggtagaagacgatgagcggtatgtcgagaacgacgtagtgggcgaccagcatgtgcttgtagccggacgcggcgcagaccccgccggcggcggcgaccacgacggggaccagctcggagaggacggcggcggtgtacgcgccggcgaagtgcgccaccagggcaaagaaccccgacaggaaccgcgccccgttcgcagccgcccgcgccgccgtcgccgccaccgcctgcgccgtcgccgacagcagcaccagcgccgccccggcgcgcatgaacgtggcgccgccgctgccgccgccgtaggcggcgcagggcccctgcgacgacgacgcgtcggcggtggtgatggcgaggacgaagagggcgaacgccaccgccgcccagcccatcaccgcgtgcgcccacgccatgccgctcaccgacatcgtcatcctcaacactagcgaagctgggcagctagctagctagtgagtatatagtggttagtgaagtggagatcgcgatgcagcatgcatgagaacaaattaagtgcaagggctacatatatagtgcaaagggctaaagcacaagtcaattcacttgttggtggcataggaaatatgatgtgaacgaaacattacaggggcgtagctagctaggtggcacctatttaattatagtatatgttctagttaatataataaaaattgtatagtggaccacctatttaattgacatattacatacaaatggaccacctttactcaaaattatagctacaccactaaaacagattctagctacaccactaaaatataagggtattccaaaatcaagaaaagaccatgtcgcaacttctcaccaaaatacatgacaaaatcaagctatgaagcatgtggggggcaaaaaaaaaaaaacattgccaaaatacatgacaaaatcaagctatagagcatgtgtggggcaaaaaacattgcgagaatatccgcttagattttaatttagtgtgtgtttctttttatgttttcttcctgtttcttttattttcctctctctttcacgtcccttgatagtatttagtcccttggtaatattgtaaatactttctattctcttaatataacttcagtttagcgtggctacgatttcaaaaaaacatatatataatgctgaggtgagcttgcattggcatgcatgctcgatgatcagaaagatgagatatggatcagcagcaactaataacttaccacagctgatcataatctctgcaaagttaattaaacacatgatcgatcgattcatcggtcttcgagattggtatagtaggaaagattacttgatgaggctggccggctggcttttgagatgagcagagctagcacacatgtgaagtcgatcgtacttttttccccatttgcattgcattgcctgctacgaatcctaatcccgtttctcttaattacgtacgcgtccaatctctcttattaatttggctctgctcgatcgatctgctcttcgtcttttgcttaatttgttaatttgctcttgaggccatcgcacacatcatgagtgactacttgcttctatctttgtatacatctttcttctttgtctatctaggaggagtaggatttcctcatcacctcccacaccattaattgattgccaagaacgtatggctactttcttcgccggtaagcttaatgtccttgtcataatcatgcatatttcggcttgtttgcacctaatttcctcttctccattgattactactcttacttaggcctcgtttagttcgcgaaaattttttttgagtgtcacatcggatgtttgatcggatatcggaagaggttttctgacacgaatgaaaaaactaatttcaaaattcacctggaaaccgtgagacgaatcttttgagtctaattaatccgccattagcacatgtgggttaccgtagtactttatggctaattatggactaattaggctcaaaagattcgtctcgcgatttcccctctaactgtgcaattaatttttatttttatctatatttaatgctccattcatatgtccaaagattcgacgtgacgtttttttaaaaaaaattgagtaactaaaccggacctttttttttagataatggaaatgtgttacatctccggcctctgcccgtaggcacacagccaaaaaattcagacgtgaacagaaaagttaaaaaagacaagatgggacaaacccccaacttctgccgatgatatgatctactaaaataatattttttttcaaaatcacgtagattctatcacaaaattctgtaggtactacgccatccaaaatggaataaaagttccttggctactaattccaagcgtgtagcaccattgcgcatagtatcctgttgttcctgtgaaatcatcatacaccaagagtggagccaattggaacacatgaagataacctgcatgatgttagatatttttttatggttaaaaactatatcattacggcaacgccaaattgaccaacataaagcactagctccaaacaaaccggaccttaattagtctatttccatcgtcacaatatatgcatgtacaggatatatcatgtactccctccatctaaaaaaaagttaaccaaagaggggtcatacctcctctaggttgcctttttctgggacggaaggagcatgtaacttgggctccatgtgattcaattcctcgggcttggttcttgtttgatttcgatcgattaattaatttagtttcttggttattgcctctgctctgctccgttgcaacacagcttgtggtgttactacagtacattctgatagctccatccatcgacttgaaatttccagaggaaactcgcttgctaggtatcaccaacaagcacaacgatgtgattggatcctatacagataaataatttagagtaaatcacgtggccaatatctagatttgttcgtgtgtgtcatttagatcctgaactcttaaaatttatttttagttttttaaacttattaaagtgtgtcattctggtttcaaataggcacaactcctccaagatcaattggcgtggcatgtcacacggatattttagtcgtaaaatttatttttccttctcctttcttttcctcttcttttcttttttgccatacttacatgaaggaataagaaaagagagaggagatgaaaaagaaaaataaaaagagtcaatatttacgtggcatgccacataagtgtcacgtagaatcttagaaggatcatggcaacctcggaccggaatgacacattttatcatgttcgtagatctgaaaatgtattttaagagttcggaaatcgaaataatatatacggatgagtttacgaaccaacgaaccaaacactttgcgcaataatttaagaaaaaccatttagattttaccaatggagtggttacatgcatggctgatgggaaagaagggagcaacagatgaacagtacgtagaagttgggagtgtaccgggcaggacgtccaatctttttatttcaactacccacacaagatggtgcggaatttcatattgatataacagaaaaaaaaatcacaacactacaatcctataactaggaagaagaagaaaaaaagatcaccccaccacaagctagaggctccaacacataccttgagaagcactagcaccgaattggctgccgatgtgcgcgactgatcgccgctacccctacacggggaaaccaatttttcggttcaaaacattttcaatatctggtaaacattttaatgtactcgtcactgtaaaaaaacacttagaatttaggcttatttagattatctcaattacatatgattattgtagaaaaaaacacaatgaacgttattacttattggaaccaagatcatgcgaatgggcactggaaaatgaaacatatataaaaccttgtggtcgttgtctgatggagtatttttcttgtacttttttgaggaagccgatgcttcaacaacgctgagcccaagaaagtgtaaagtgtagaacaaatgtatggactgcatttcggaattcaccagtagaatcaagaatggattaattttgcaggatgatattgaccgcaatcaatctcaggagcattttctggcctaaataaaccatatcaagttcgttccatatttggagctagtgtttataattagctagcatatcattatggtttcttgatcagaactccacttagagcaacttcaacagactctttatttagctctccaaggtaaaatttagttaacacagagaaaaaacgagctccaatagcctctctatccggatggcttccggatggccaaattgctcctccggctagctaaatgtagccaacctcctccactggctaaaggtgggtcccaccaccactcccatccccatccaacatctctccctgccggcgacgaactgagggcatatgccggccatgagcgccccccgccaatgtcgtcgtctaggccaccgtccgccgtggcagtcgtcgtcgtcgccgtcgcgcctcacgcacgagccgtcgcagccatcgccgctgctgcgcagggagccaccgccgcctccgcctcgcgcgctggagccgtcgccactgccgctggatcgatgggtcgatgctgccacgcgggagaaaagaaatgggaagagaaagagaaagagaaagaggaggaagaggaagggaatggagatgggaggatgacatgtgggtttctttgtgattttggagatgtaaatagagagactgttggagcatacatctagtttgactacccaaatcagttggagagttggctaaatagatatttgaagagtctaatttaaagatgctgttggagatgctcttaattcagaaggaaaaaacaggtgaactaccagaaaagctttgccagcaaagtcatgacgtatacaactataagccatcttcagcgtactctaacagaactccatttatgccaattgaagaaatcgttgcaagttaaccgcagtttgagctaactattatgttataatcttttgagttgcggttgataagctgtggaaaataaacgaagcaaccaaaagtaatataacagataaatagcaattgaaaatttatatccatgttattagtgattgaaaagctagtcgatcgctagaaaataaactgacaaaaaaaactcaacataaaataaagttttaaaatctaaaatttggtcgcgattgatcagctaacgagagcagaagatggaaaatttgttgtccgaagaaaaaagaacaaacacagacggaaattaggcctgtttagatcccacccaaaaactttaaaccttgtcacattaaatatagagtatcaaatatagacaaaataaactaattacatagattacgtgtaaattgtgagatgaattttttaaacctaattagtccataatttgacaatgttgtgctacagtaaacatttgctaaagtttggggtgtaaagttttggcgtgtcacatcgagtatgccagcacatatttgaagtattaaacgtagactaataacaaaacaaattatagattccacctctaaactgtgagacgaatttattaagtctaattaattcgtcattagcaaatatttacaatagtaccgcattccgcgataacaacgcgaaaccgagcggtctggcggaatgaaacagcggtctcgctcaagcaatagcaatactagtgtcatgccgatttaattagcaattaattatcttgattagtgattaattaattcctaatccagatacttaatcactaattattattatttaattgttaattaagtaattaattactaatcaaacggagcccattggacagtgtcgttgattgcttgggcgaggtcgctcttccatccattatgcgagactgcgtggtctcgcgctttcaccgcactcgataccgctcgcgatgtcattttcgcgtaacggttttgcgagaccgacaatatgttttttgcaaaaaattttacgtctcgaatattcccgagaaaaaattgaatgaaatgtatattttcaaatttaattatgctttggtatgtcgaggacgacgtagtgagcgatcgacgagcatggacgcggcgaagacgaccccgccggcggccggcggcgaccacggcggggaccagctcggagaggccggcgacggtgtacactccggcgcagtgcgccaccgccgacagcaccagcagcgccgccgaggcgcgcatgtacgtcaggagcattttctagcgcctaactgtcactgcacattgaagaaaaaaatggcatgaaaaagtttgttcgatacttggaactagtgttaattacagtaccattttaatatggctcgtagataattcagaacgaaaaagtaggtaatttaattatcagtaaagctttgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggagatggagaggaaggtggtggtggtgtgcgcggtggtcggcttcctcggcgtcctctcggcggcgctcggcttcgcggcggagggcacacgcgtcaaggtgcgcagctacgtctctcgccgccgccgccgaggttcccggcggcggtttcttgaactgccttgttactactactactttctggatgaactcgctcgcgttacttttatagatctcggtgtgtctgctaagttgagcttttgtttggatctcgctgtttcccatcggggatttctgacctggtgggagtagatgcgtgtagcttatccgtggttgttcgctaggaaaatgcgctgtggcagaagtgaatctttgagcctttttatgcttttggttgattttcgctagagctagtgctgcgatcatgttaggtgtagagtggatgtttagttcaatctgattcgactagtgcgtgtaaaattatatggttgaatcagaatctgtccaagttatttccttttctggcaatgttcatcttgtttgtcaggatatagcactattagtctactatatatggtgaagctttacttattagaaatctttaaactcgttattctactgttcttttactcttgacaatgcggctagaacagcttaatcattgtgaaactcattacaaaccctagtgcctgtaagcacattgcagatattttcctctttgaggcttgaggatagactaattttgcactgaaatgcatgtaaaatcatgccgcgatgtaggaatataaggtggtacatgtttatagctttacataatgcaaatgcaaacctcaaaagtgtcaaggatcttatgctacgcagaaagttcttctgactgcaagtgaaactttactatagaataacttaaaaaacaaacagactggacatattaactgtggggctgtttggcagcgcttgctgcagctgcgctgcacggacggttagaagaaatatgagttcggttcctttagtagctggctgtggtgcagccgcagccagggcttctgaacaggccctgtagtattaactgtttcactatgtatgatcttagattttacatatagattcttgcaataacagtcataccatcgctaaagcaatatataattatcatgtcccttactctttttagagtgctagattgtaataattggctgtagctcttctgagcaaaggccgggatgttctattccattatctaaaaaaaataattatcatgtcccagttataatgcacattgcttaactcatgcaggtttcagatgtgcaaacttcttctccaggtcaatgcatatacccaagaagcccagccttagccctagggttaatatctgcggttgctcttatggtcgcccagtctattataaatacagtggctggttgcatctgttgtaagaggcatccagttccctcagacactaactggagcgtagctctgatctcattcatcgtgtcttggtaaaactctacccttgatgtttattgtgttattttacctttttcctctatcttgacgggtttcaacttatcttaccgatctaagagaattctgaatattattatgttatgttgaacctaacttagccttgacagtttgttaaacagtttttatggaaacaagggatcttggttgccaaatgcgttggagttcttgactctgtcattttggcactacaaaggttccttgcagttgatgccttatttcagtagtctttattaaaacatgtgtgtttttctgtgagatagcgtactagcattaggctgctgtttgttttattctttgcaaggaattcatatgagtggttcacatgatggctaaatagaataacttttgcatagatttcaagtgcaattagtaatgtgaagtgcaattctacctttttcttggaacatctttggggggttagctgtgctttattctaaggtagggttcagatcagaatgttgtggcttattttgcggaagtcctgattcctgaatgctatattttagcaaaatactctgctatttgttatttgccataacgtcgtcctggatattgttacattctgcagggccactttcataatcgcgttccttctcctactgaccggagctgcacttaacgatcaacggggtgaggagaacatgtactttggcagcttctgctacgttgtcaagccaggggtcttttctggaggggcagtgctctcacttgccagcgtggcactggcaatagtttactacgttgccctatcatcggcgaaaagtccaccaaattggggtccccagcagaaccaaggcatcgccatgggccaacctgtgatccctccacagagcagcgaaccggtgtttgtccacgaggacacctacaatcggcagcaattcccataaatcatgatctgtgcaagctgtttcgagggccattctgatacattatgtttggtttgtataggcctccaggttagaacagtagcagtaacaattgttgttaggtagagtcatgttttttgctttcttcttccccctctttcttgagcgctactgtcgcacgttctgcttcatcacagcggatattcgattttacatgaaccgggcaatgttgaagaaagcttgagtttcttgctatttgcaaattctgaaggttttacatgataattggatcatggatgtggaattacaatctgtcttacacctgtgggaacttgatgagcagtcattcagcacacagtggatgctagctgctccctgaaccgagcaatggtgtcgtggacgatggcgttggggcgcaccgtggcatcgaccacggtgatcccctccgcctcatcgatctgcagcaggtcgagctggctctggagcaagctcgccggcatgaagtgctccccttccattgatctcctcctgatcctgtcagcaatcacctctgctgatgcctccaggcacacaaacttcaccctgcagctggagtagctccctgaacctgacctgaagctgcagtctccttccctgaggatctccctgtacttctgctgcaatgccgagcagctgacggcgacgtcctcgccatgatccagccgctccctgacagcgtcgcggagggcctccagccacgggatgcggtcgccgtcggtgagagggatgcccttgctcatcttggctgttgtcagggacagggaagagcagagaagttcagaaacgaaaaagggaaatgtaggttggttggttgtgagatgatgaattcttcagagaagtatattgatcttgatcatgccagacctttgtttgcctgagaatggtagtcgtctgcttcgatgaagctgcagcctaaggtttcagcaagcagtgctgctactgtcctgcgaattcacaatgaaatgctaaattcataagaaaatgtgataaattttgctgaggacaaaaaaaaaagaagtaaattcaagatttaaagctgaacagtactattacaaaatctgaatgtaggtttgaaagtcacatcctaaaaccaactcttcagcaaatgcagaggttttctccgaggaaaagacacagcaacatccatttgacatcacaatgttgaattgttgacaaaatgcatatcagtgtactgataatgtctctttctgcttgcttctacttaatgtgcctaaaattgaccaacttgaccataatattaagcatgaactgagctgaggacttgaggttggtctaaaacaacacaatcagtttgaatacttgacagggtaatcagaaagaaagaagtaataatcttacgatttaccgcagccactgactcccatgatcacgattgccaaacctgcaaccccagatgttgaacaaagatgaattagcagacacccaagctctgctgattacgattagtacttgtaatgataatcccattccaagcaattccttgaattaagctttaacacttcaaaaagaaaacatcaattcagaaatcaacacagcacctattctgtcagaccaaaatcacaggtatggtcgcaatacatgtttgggatccatcacttcagttcgcaagaacaagaacatggtgaacatgcacatgaataacaggaaatctgaaccaattcggtgcagcgaaattgcgagaagaaactaaacagatcaaaagagttaaaaacgaaacaagcacgcactgatcctggtcactgacctggtcggtgcgtgagatcggaggcagccatagatgagcttggtggttcgtctcgatctgttcctacgacaaggagtacgacaagagcgtactaaacctgcgaataaacgaggaagaagacgacagcggcggcggcaacaactctacttggcttgattgctcttcctttattttatatctcgagattgaagaacaaaatctatcattttttgggagaaatttatttagtctagtctagaaattttgacttgcatgaacactgcaatttggcatttttgacgtagtgagtactatggccatcctcataaaaataaggagaatttttcacgaatccaaacatagaaagacaagattgttttaggattggacggcgaagaaagagacttgaagcgaattgtcgtctgatgactaaaactaacaaagatgagacgtagacgaaagcgtcttcagttcaaagcaagaccacctgacgtttcaactttcagttcaccgtcactttagactgggacctggtgtttccaaagactcttttacagttcattcatgtccatgctgtcgcattgttgttgctgctgactcagagcttatcacacatccttatccaagaggaacatttgtagtatcaccagaaatcatctttcaaaggatattgttgttatacaggatcctcccaagaaaatgacaactttctatagagaaaaacaagttaggacgagagttggtgatgatggaaataccaacttctctcaagtcttggttgattggattcaagttgatgctttcatgttcctctagctcagcaaagaccttggtggtttctactgaacttgtttctggtctctgaatctttcagcattgcttctggtttctgaagcaaggaagaaaaaagctgttgctaccggtgagaacaaagatgttaagatgaactcaaaagatgggggcaaaaacagaatccgagatatacataatcacatacagtaccaaattcatctgatctagtaatgtagtcacgtaagaacatgcaaacagctaggtaactatggctactttctgaaaaaccctgaatcctgaagtgttttgcaatattctaagatgacaggagatttcttcaccatgtcccagatcttcgctgagctcctcaaccagtcacgctcggtgagattcttcgagaatgacctcgatggccttgataagatctgcacccacagtaatatccacaactaagtgaattgtgtccagagtaaacgtagtactctgaaaagaatcgtttattctgcctttacatcagaatcaggacaagagtcatcattgtgttcagggtcagttctgcaccatattatttttatttttccatataccatgatatgcatctatcgattaataaggatatgcagaactattccttttcgttacttgggaaaaaaagaatgcgaagtgctaattctgttaaaatatgaaagagctcaacctgctgagcgccaacaaccagttaggtaaagctgcaagcatacctgatcacgaagcatccctaacatggatggacatgtccgatactcaaaatttgttgagttatcaggtgttcttaatggaagaagatatatgtcctgctgattggagctcagatcctcaatcttcatgcttgaaggaactgaggagtcagaaacttgaggtgttgctccagagcttccaatgctaaaggaggaggacttgaagtgtttttcaagaaccctcttcagaaccatgagctttgaaggagaaaagtcttgttcccgcaatctgttcagttagaaaaccacaccattctaagattatcaaattaattggtataaaagattggattgtagaattaagtgcaaaagtgttgtgttcatatcacaacaactaacttcactgccaaaataccggaaacaacaaaaggatctctttgttcatcaaaaaagaaatgagcatatgataacataagaaaatgcaaacaagcatgaaactgagcagtgttcacctagcatgcacaaaacagagatcagctatgtaatcttcaatgcctgattggttatcatttttgttttccttgtcttgggtagttgaggaggtcaataatgatggatcaggtatgttgtgcttcagtaaatcaacctgcaaaaattgtattaaatcaccctttcaactttctgccattggcagaaactaaattcatcaacacagcataaccacaaattttcataagtacaatatactaatacggagtttcaggtctgagctctctaatacgctggaggatataaatgtgttcttaactattcactgtaagaaaatgtgatcaagtggtatggatgataaaaacaaaggcataaacaaatatagacagacaacttaccgtaagaatgaggtcccacatggacaggtcattaatcccctccgatacaaccaacaaaatattgcaaacagatgccaagaaaacaccaagctacagcaattccttgcagaacaacataaaacactgatcaactattcggtactgtcaagctcagttagcagtgggtacaacccagtgcgagaattgaagtatagcatttacctggattcccattaactcatgagccaggtctgctgataatggatcaccactgaggataggaattgcggatgaaccatctggcttcatcatatcaattagtacggagggactgaatactggctgcaagacaaaaggtgattgttttttagaacgttaccagcaatatgtttaacagctctggcatttggaacattgcatagcagaaactgagttaaataactcttatcacctgagtgtctagaagtataacccgttcattagagatcctgatatcaatgccagcagtacagtgcttagccattgctttgatttcctcagtttgtgtagcaaaaggaggaagcattcctacaggcaatactcaactaaatgagcttcggtttgatctaggtgtccacatggaacaaattgctagccaaattacaactcttcactacgctttttcagcaagccaaaagacacaaaagaggttaggggaaaattgatgtatggaagaaaaacagaagcttaaggacttaatagagtgcatattatcaacagcagagtgcatctacaaaataattctgacaagcgcatgttttgtttgacacatgaaagtaacaacaatgaattgaactgaaactattggaagactgaatgctgaaactattggaagaatggatgattgtaccaggtgagcttccatcatatccataaagctcgttcatgatggttgacttgcccacaccagttggaccaattactccaatcaccatgaaatcattgttctcagtcaaatactgaaaaatataggccccaaaagaaacatgaagatctcgatcaatcaccggtttgacatttcaagaactctagaagttatgttatacaaaaatactttcatcaaaatgtcacaaaatatctgaatgttttgagggatatatctacagatacttttaaataatcttgtcatcattcaaatccagtttcatgcacaaactgtaacttttgacgtgctagacaaaggtcgcattggcatatatcatattactgcaagatttaagctttatcatcagggatagtattagaatgcatctcaagagaacctaggaaaccatgaactaaactgtataagagctacgagcctacaactaacaactgcattgaacaatggattattgcattaaccagacacaaaaaaaaaaattgtcaactgaatctagttataggatctcacacaattttatcacaatgcttgcatcgaaccagtaagtaaaccctgaacagcaaaaggaaatgaaagaaacaagaagcatatcctcgtagcaaagccacttgaggacgcacgcaccgggaggatcttgtcggtgtggacctcccacgcgtcggagacgaggctgagcgagccaggctgcgtggcctgccgcgagcggcccgcgcctcctccgccgccgccgtcgtcgtcggcgccggaggacgaggggggcggaagcgggggcttggcgagaaggatcttgggagggggaggcggaggcgggtgcgaggaggaggaggacgagccccggtctccgacgccggcgagcggcggcgctccggcggccatcgcgcgcggcgtgctgctgctgctgtgggcgtctctagttgaggaggaagccgtcgcttaattaatcggaataagttcacttgaggtcccttaacttgtcagcgaaatccggttttgtgtgggcccaactgtcagacgcggtgctaggaggcccggcccaggtaagcgtactctttgggccatcctactgggccggatttttttttctatactcttctgtttataccgtggtagaccaagaaataaacagagaaatttttactacggtcatgaatatcccgtccgttcctccggagcattttatgttttgcaagtacttaaaattaatttttattcttttttaaagttattttattagttaaattttgaattttgattacgtggattctcctcctcagcagcccattggctgaaaacgcttgatttccatgtatgagaatcggtctcataggaatgtttattttgggtataaaatttgaatacttaaaaatgcttagtatttaacatttcgataaagattcactcggtctttcaaattttggtcataataatttctaaaatgctcttgtagcacagtaataacactgttaacagtagtagtgcaggttcagccatgttgctccacgtaggagtatgttggtgtagtagggtgctgggaccgagacagctcatcgttcccctacctctctgctgcattctggaaccctctctctctcttcctgtgacccacaacactccaaccagacaggcagaaagcaagcaaaaggataggaaggagccaagaacaccaagaacttgttggagctgagacagcagcaccaagcaagaaaccggatccaatccatccatccatccataggtaatgatcgtcccttattaccttccctacttctttgaaatcttactgtcttcaattgctcttttgcccgtgaagttgtagcagttcgcagtttgtctgtttcttggggagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaatggctggcaagtacatcgccgctggtcttgttggttcctttgccatctcatatgtttgtgatcattttatcgctgagaagaagatatttggaggtatggaatctgatcccaagtacccgtttgtaaattgacagcacgcttaacatacaccgttggcaaatctgtctgtataaagaatatgtgcaaaacaatcatcttacttcttgatcaggcaccacaccacataccgtgtccgacaaggaatggtggcaagcaactgacaagaagtttcaagcctggcctcgcactgctgggccaccggttgtcatgaaccccatcagtcgccagaacttcatcgtcaaggatctcgagtcctaaggtagcactaatcgcgcaatatgcgccgttgcacccctcaatcaaaacaagagcccatttgaagccacgtttcatctttcatttgaggtgctgatgctaaagctcctttgcttgttcagattgtagtgggagcatatatgctgaaggttgcgccgtgactaagatggcgatggctgtggctacaaactacctacctatgccgtactcccgaaccagtacgtgagtacttggtctcaataaaacagaactattttgcctagtgcagcctgaacagaacctgaagcatatctgctttagacattgtcatcttggtgattgttcttatgcagtaacaacctctactttgtgcttgtgctattgtgagtgaatggaactatctgtctgtcacactggaatatgtgccttgtctactgatgcaagagattttaggccacttgtgtcaactccagaatccaggtggcctctctaatctcagtgtaggtagcaacagacagcatctcgccgttttcgtgaggcttcttcagtgattctgaagcttatgtgttttcttgcacacaaaagtagatcagctagcagaaacgtgttgctagtttggtcaagatttatgtgcgaaacatttgacactgctgccagtatttgtcagatgaaaacgctgagatctcctctatcttgggagattttgcacgcctgatttaactctgggtcgttttcgttttcgcatcagcatttcatcaaatacccatctgggaattttcccgagctttgagctgctttagaacaaggttcagatgctgatcatcagcagttcaggatgtgatctgaagcacggacagaaattaagaaacgaagtcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaatggccgctcgagcactgtctgctgctgccgccgccgccggtcgccggatggccggacagactggcttccctcttcttgcctcctgcaggtaactggctataactgaaagaatgggagctctgtttcatgtatttctcctgttttttttttttttttgcttcttcattggattgtttctgctatggtttatcagtgtccagtacgtcagtttagtgtaggccgtgaatcgtgatgagctgatggcgacgccagtatcttgccttcgatcttctctttgtactatttttttttcctctttggtttgcaaccctcaatcgatgataaacatgccacctttttatgtggaactctgaatgaacgttcatttgggctgatgaactctgataaactctgatggagaaagaaatgagccaagcaagttcaagttcctttggagatgtttctctcttctgtttttttactgttcattttccagacagatcctgatccttctagctgttatttagttactgctccatctctaaatcatttgggctgtgtttatggtttagctgttgattgagctgtcatgttctttttagatggattgagagtgttgttgtcttgtagagtagatgccatattttgagagaaaaagaatgttcattttctgatgaaagtctgtgtgagcaggagaggagatcaagctcatcagaattactcgattagcgcacaggcccagccggaggaggagcagaaggccatccacgacggcggcggcgccgccggagcgcaggtggaggcggcgctgaaccgcaagaacgtggaggtgcacccggaggaggagacggtggaggacgcgtgggtgcccgaccacgagaccggcgtctttgtccccgccgacgaggccgccgtctccggcaccgaaaaccacgaccactgcggagcggcggcggcggcggccgccggctcgccgtcggtgcttgaccaggcggtgttcgtccgcgaggaggacatggaggacgtcgagaggccggccgtcgacatggccgctgccaatcacaagcccaaatgagcatcaactcagcagtagcagcaataaccaataaagccaaataatgccttctgaaatctcatgtacaactagtactagaaaatttccagtgaaaatcttgcgtcgttggttgtatgaatcttgttatctacagtgatcaatcggataatctgttctttgatgaatcttgttgtggttttatcggatggaatttgctgggattgctttgaattcgtgcacgacgccgtcgatctcgatgaggctgcagccggggaccttgtcgatctcgttcctcctcatctgccccctcaccttcaccgcctcaccgtgccggccattcgacgcgtacgtgttcgacatgagcacgtagtcgccggcgtccgcgtcggccacgcgccgtcgcatcacccgctcggcgcgctcgacgtcgccgtgcgcgcggcatgcggcgagcagcgagctccagatgagcgcgtcggagtgtactggcattgccgcgatgagctcctctgccttgtctagtctcccggcgcggccgagcatgtcgacgacgcagccgtagtgctcgatgcgaggttccggcatggcgttgagttgctggagcccctcctcgacaagtccggcgtgacagcacgccgtgaggacgccgaggagggtcacctcgttcggcgtcacgccggctcgttgcatgccggcgaatagagacagggcgtcctcgccgcggccgtgcattgcgagccccaggatcatggatgtgtaggtgtacacgtctcgccgcgccatgccgtcgaacacctccgtggcctggtcgaccgcgccgcacttggcgtacatgtcaagcagcgcgttgccgacgacgccgtcggcgctgtgccccatcctccccatgtatgcgtgcaaccacctgccggtgtccagcgcgccgagctgcgcgcacgcgccgagggcggcgacgaacgtcgcgtcgtccgggcgcaccgccgcggcctgcatcttctggaacagcgcgagcgcctcctcgagctcaccggcgcgcgcgaacgcggacatcatcgtgttccaggagacgacgttcttcttcacgggcatcctcctgaaccaccggtgcgccgccgccgcgtcgccgcacttggcgtacatgtcaaccagcgcgttccacgcgacgacatccatagcaacctttctctccgcgacgcgccggtgcgcctcccgacccagcgcgaggtccccgatctgcgcgcacgccgagaacgccgcggcggcggcgacggcgtcgatggccacgcagcggtcatccgccatggcgaagaacagcaccacggcctcgtccaagaacccgtgcctcgcgtggccggtcaccatggccgtgcaagagacgacgtcccggccggcggggaacccgtcgacgagcgcccgcgcggaggcgagctcgccgcgagcgaggtagagctcgacgagcccgtcacggacggcgcggcggcggtcgaggccgagcttggccgcgtgggcgtgcacggccggcgcggcctcgccgtgctccgcggccaaggccttgatgagagcccggaggcctcgggcgtcgtgaggggcgccggaatccacggagacggtgccgttcttgtagccgccatgggagcgatgaggcggtggcctcctcggcttgctgctgctcgccggaggaagctgctgctgcggcggcgacggcggcggtaatggataaggcgccatggccggtgcccggtgatgaggtgagaatgagtttgggtgggtcaaaaagtcaaaacataagtactgacaggtggggacggatacaggttgggacttatgtgccgcataagaaactaaggcccataaaccaaccggcccaatacatatgggcctcacgtgagaagaaatccatgagctacgagccgactaacatgggtcggactcaggacttcatcaagattcagatgaacaacatcgcgtttgatttcatcttgattttcagataaacagcgtcatgctgaatttttaccttcatcatccatctgatcctggaaagcctcagggccatcgaaatcatcttcatgtatccaggaatacaaaagcatgtgcctctggacatgcatattttcagcaagctggaagagctgaaagcctgaaaatgctttttccctttggaagaaccaagctgtaaatgcatcgatcacatccaaaaaaacatcgttgcacacatctcatgcataataaacatgttggaaggaaaatcaaattgaacgcacaagtaatactgcatttaacacggaacaggatgcaataccatttttccccttcacaacaaggtaaatattatttcttgtagagagataaaacaaggttcagacattcagagtaacaggcacaacagtttgcctccagaaaactaacccaaataacaaaacaaccattactattatttctaacagacgataattaaaacgaacatggcagttcaccaaaaacataaacatcctgcaagccatcccttgcagcctgttcagaattcagatgccatcatagatatagtagcttgagttgcaaaagcccttctgctctgcagcacttgaggagagaatttcagcagaagataaacccaaacaaagcttccttgtagcagctaatgatcgcaagagagtagcatcctgggcttcacccagttgggcagcaaccctctgcgattgccttgatttggcgccaaggatgacacacagtatgaatcatagccgatccctccccatctctgtgggttcttgcaagacaatggtggccgtggcctgaaagcctccctcttctcatcgaagaagaaggcccattccttcaactcttcctcttccatcttcacccacattgcaggctgggatgacaggtcaaggcagaaggcctcgccgatggaggcggcgagcaggatgagcatgtcatcacacaccaccagcgatggctcgcagaggtcaggctccgacatctcgacgctccagacaacttgtacttcttccaggctgagctggggttccagcttgacggtgtaaagctgctgatactcgagggcatagagctggcctttgaagggcacaaactgctcaagagctttagaattgggcgggcaactgcactgcgaccaatggtcgcttccaactcgccatgcgaacagggagtgcttggcctcgacaaggaaatgcgagttgtgataatcaaggggagctgtgagggcacaagagttgacaaaagtaaagaatgggcagggtggaggtgaaacactagtgccggtgaacacgtcgacgatggcgaaggttgtgtccttcagcgagggggcattgccagagaagatggcatggccataagaacagcattcataatccatccccgccagaaaatctggcggagtcacgcggtgtatgcagatggttggcttggctggatcaaagagctcccatactactggatcatcgccagaggaagcgcagctgcggatggcaagaggacggaagagggtggtgcgtaaggtagattttgcagacctgaaggcagcatgccaattggggcaggtggcaatgaaggcagcaaggtcactgggtgaactcaacagagcaaggacacactgcagtaggtcatctgggaggtctgcccatccttggagcactggcatggagttgggggtgttggagatcctcttgcaggtgttttccatgatagcaggctctgcaagtcaataatgaagtcaatgggagcaatcagaacaaagaagttctggttaaaggacaagcaacatagtccactaattcactacgtcatgtgggcgcatgaaaaaatgagtattagaaatcctagccactaagtgacaaataagaagtggagtacagtggtgctacaatattttgcaatgttatgaatgcagtatgtagttacaagactcgacaattgaattcattcacatttcaaataacattgaagaaaacggatagttaatgctttatttcattctataatatgcatgaatttagtatcgacacattgcatgtgtgtcatgttggtagcaatacatccttgacttttttatatcgtttataacttaaaatattacacacaacatataagtaataaaaacctgtatcgttataaaataactcgtgttttagccatcaacatacatactaagaaagtatggggtacccccttctaccttgcttgatcctcaaccacaataactggtcctttctttgttccaatcataccaaatatcatggtaaaaaaaaaacatatttgataggatgttagtatttactatgagaacctaaaacattgacaatttgtgatacaaaatagcctaatccaaagatcacacttttggtggagacgtattaagtattaactgctgaaaaacataactctataagtatcttcagtatttctaaaaaaaatcttcaataccaagacatcagtggaagttctcttatttgggatttgattaatagaaaattaatgaacaaaaattgcgtacatattattttgttgataatcaaatattgtctcaccaccacccgagtcagtatagattttgaagacttatgatgtactcatagtccttaagaattcccctatcctccaagatttgaacgtacatcttagaggagttagcagactaataaatagaaacaacgagacaacacaaaatgggtggacaaagtacgtggaagaagaagtttaccgatgaatgaagataacaacgatagtgagggcaacaaagaagccccaaaatggttgccgtcgatgttaatgaggacgtatcgagggtctgcaatggttacgactagcgagtagggaagacgaagcggcggcggaactagctaatgattagggtttggggggaacgaggcaaggggattcaatgggttttatatggtatgacatgttaagagataagatgcatatgtccctcctcggaaccagttcacatacacacacacctcctggtaccagtacacacatagacccttttcattattaatttggtagtaaaccctaggctttgctattccggaaatttctttggtaccagttcacacatagacccttttcattattagtttagtagtataccctaggatttgctattccggaaatttccttggtaccagttcacacatagacctttatcattattagtttggcagtgaaccctaggatttgctattctggaaatttccttggaaccagttcacacatagacccttttcattcgaaatttcgttttatctgtgggtaccggtagggagttcttccgatcgaaattttcaattcattcgaaatttcgttttatccgtgggtaccaatagggagttcttccgataaaaattttcaatatgatttgaatttagaaaaaaaaaatagccgtgtcagagtatagaactcctgtaatggggaagctaagtactccccctttgtgagttcggccgaggtgcaagttttgagatcgagtgtttgatcgcacggtaaagataaacacaagcacatatacaggtttaggccgcggtggactatggatgattggaggaattataaggtgacgtaggaggagaaactcaactccttgcttgctgaattctcggtggcatgaattctacttatatacatgaaggagagtccacaataccgttgcatgcatggagtggagcctactcctctaaacttgatatgcttagtcttgtaggtcttgacactcttcttaaaaccttgaagatgtagatattgtagatctcgataatcttcttgaaaccttgaatatgtagatcttgtaggtctcaaactctcaatactcttcttgaaaccttgaagatgtagatcttgtacatctctatactcttcttgaaaccttaagtgcttggtggggctcgcagtgccccaagcccccctacaccttgagctctccagggtaaagggaacccctgctcccacttctccgacaagcagaattcctaaaattttgccaacaccgcccctccccctaggtttatgctttttgaaatagtgaaccctagtacaccttgttaatgcttttttttttgtcacatcaccaacacaattggagatccacctaaagccttgtggtgtgataggagtcaccaaccaccttgaccttgagaatctccttgatatccccaacgagctgctcagcgaccttaaacttgtgctcaaatattcttccattccgctcttttcaaatgagccaacaaaccatcaggaagaaagaatcaaaagcgttcctatagcttggccgaaaaaagcttcgcgcttgctgcgaacactctgctagctgcaaaccgctgtggcccagtgggtcaaaagccgcattaggacaatggtattatttgtcatgcacagcagatcttgcaaataacgtcaggtttagtttagtttcaaggatttctgaaccagcacagttacaacaattggtttctactctgtatccgctaaaaacttatgggcagctgcttccaagcgtaaatgggggaaaaaacttttcgtgtgtcttgcaattcagagattgaatgttcaacatctgaaaatctaagcaaagagtggtcgatttggtcaagttctggtggctacaaaacaaccagatgtgtgtcatcaaacaagaaaggtgcagaagaacatctcaaaatgttaatcatatgttcctaaggacataagaaatctgcttttgataggtgcaacagctttttgttggtccatttggctaaacagaaacggggtaatttttgacaacaagatggtgacttctcctttgcaggttattgctttagtcacccagtggctatgcatctggtctatcctccacaaaccaggtctttaggatactattgtggtggtatcacgtcgtttggatcaagtggcacgggagttttttttaccctggagcatgggtggtgatctagtctacggcttgatagtcactaatttctttgttttgtgttgagggtctagttagatcatgttttgtagctgtgtgcatttcatgcagaggccgggagtgagctcagttagaatgtatcatcttggtgtatttgactgagttttaataaagcttccattatcgaaaaagaagaatatctcgaaattaagatgatcatgcattccacatagaaggcgatggtcgaaaaatcaatggaatagttcagagaaatcaccttttgctcaaccacatatcctgattgcaggtgcattcccttcgtccatgtgagcaattgagcatatatcgacacgacatggccgttttctgtcgaaataatgatctgagagcaatctagtagtgagaaacataaagcacgcaaccgatgaacgcactgatcttcagcaaagtgtatagttgaagagcttttcacaactgattcacaaacatactgaaatcaactcaactggatatattgcagaacagtatatgttgagttgggataatacctcccctcattgaagaagaagaagaaggtgcatttctccagtttgggattccttctacaccttcactcgcgttgcaggttcagctgataaagaacggcggaaggatcccgcgagattcttcgacgaggacccggccacactgccgaggaagaaagatcttgcgccatggctgacgcatccaagaaccagtggtgcctgactgcctggaatggccggtggtcaccatcccatcccataatgcccctgtgctcaacaaacagcgcactcgcggcggagcgcctcggcggctcggcgccctcaggatgccgtagtggacggacggccgcggtggccggcgaggcggcggagctttggctgtggggttgagaagcggcgggtggacaggtgggggccagaggcagggcggttgacctagtgcgagggattcggaaacgaaggtggtacaagcggacggaggtgccccatggcgtccctgaggctgagggtggtggccgtcgccggccaggacgccgtcgccggtgaacgcggaagcccggaatctcggcccggtccaagccaaaaaaatatatgggccgtacgtacgccggagtcacataaatgggccgcacgtaggcggcactagaggtgaaaactgttggaattgttagcatatcttcagaaatgatgctagatcgatcgataattaaccatatttactatttaaattactcagtattgatatttatatgatgaaaaataaattagaaaaaacaaaaattataaataataaaaaacagcacggtcggaaacagtgttaagtcgaacgggaattttcatgaccgttttcaccccgcaccactcttccgtccgcgctgctgtctccatttcccaactccgcgcgctggttgttcacaattgctaactatttatttatgaaagacataccggaaattctcgatagatcgagcgtcatttctgtataagcggtgagacgtcatggtactgtttttcgattccattcatgtataaaatttgaattttctatttatttttaagcatcatatttttatgcacgctaaatattggtaaatgtggttaatttcatatcaaccaagaatctctttttttaaaaaagatgctcaacatgaatcttttttctaccgatctggaccattctgctagccgatgtacaagtaggttgctgatgcgacgacggcatggatgcagcatcacatcacaaagcttgagacgaatcatggtgcaaaatcccactcagcaaattaatggaatagttctcttacattggatgtgaggatcctctcaaattccccacaggcactgatttttctcaattatacttctgaacaagcacaaaaaattggaattgggttgcagctagcgatcatcgattcttgagaaactaatctcaagacgtgaaagaatcaagttgctagaagcggacggaggtgccccacgtctggacgtcgcggagggtggaggccagccagtcgaggccgccgtggaggccgtcgccggtgagcgctgaggctccctgacagtgccacctccggttcttgagctcctcgtacgcccccagccgctggcacacctccgacgagctcatcgcccctttctgcatcatgcatccacatgtcaattgttgtataactaatcgccattggcaaattgttcattgattcgtcaagcttttagcaattaccaggtcctgcttgttggcgaggaggaggatgacgctgttgagcatgagggggtcgcggatgatggcctggaactcctccttggctactcctatcctttccctgtccatcgaatcaaccacgtagatctgcaactccccacacattcagtttcagacattcagatttcagaagcaaagcaatgatcgatcgagagagagattcagaagatgagatttaaccagggcgtcggcgtttctgaagtattgtctccagagaggtcggagcttgtcctggcctcccacgtcccacaccgtgaaggccacgttcttgtactccaccttctccacgttgaaccctgatggaattcgttcatttcacaggatgaaagaatgtatgtctgtcaatgcaggtccaggaatggattatgtcatgcccatttcggcgatgaaataaatgacaatgaacacgatgtatcactaccgattgtgggtatggaggacagaacttcgccaatgtgcagcctgtacagaatcgtcgtcttcccagcagcatccagcccaagcatcagaacctgattaagcatccatcagaagagaaaaaaattctgaacctggttaagcatcagaaaggatgaaaaactgagaatggtgaacgatttcagaatgctgacatgatgttaccttcatctcctttgtgcagaagctgtcgaacagcttcctcagggactgccccatgcctgaatatgatatatgattatgatctatctaccattagttctttcctcttgattaatctctgcttcttcttcttcttcttcttctgattcaggctgccttttattgctttgagaataggaggtagttctcatcgtgcaaatcagcagatgacaccccattactccgattgtttttgcaatgcgcgcgttgccgtttgacttgcacctaccgacgaactgaataataataataatacttgctttgtgttgctgggatgctggtcgatctggagatgatggaaccaccagacagccacaaccgacagtgtttaatctaatttatttattgccggattctacaacattacaacgtaccctgtttcaactagacatagtaaacttttgtttggatctaagcatggtgattgatcatacctcttagtgaaaccttggaataaattacactccatgccggtcgaactattagtatttttaccttcatcctgtacaaaaatgcaatttactcttcgtaatcatctgtttatgaagtataaactacactgtgaataaatgattaacggttaatttaaaattgatatattacataatcaagcaaggtcgttgtagtatagtggtgagtattcccgcctgtcacgcgggtgacccgggttcgatccccggcaacggcgattttactcctttttttaatttgggccatattagattggagcccatatcgatcagcccacgggccgaaccgctatatggcgcccatgttgcccatattagattggggcccatactcctatcggcccacggcccgaagagccttatagcgcccacgacaaagcgttgggtcgtcgcttgctgcttctagacagttctacaacggtcgaggctgctccgtgctctcctccgctctgctttcattctactccccggaaaaatgtcctattcactttggtgcccctgagtccgagatgcttgctgattctccctctttttgtttccacagtttggctttattttgttgcttttgtgttgttatgaaaaggatctactatacttctttttctttccacagtttggctttactttcctgcacattgagtaggattaaaagaagagctagtaatgatgcaatacatgtttatgtacattatcacattgggtttattcaaaagagctaactgctgcagcgctgcagcaatagctatagtggctatattagtcagccagcaatgggctacaaccaacacaaaccatatgcatatgtaaaagtattgtatttaattttattcaaaatgcagcctagcctaaatcgctgccactgaacggttggatgtgcaacacagtctagacaactgctattaagagctaccgaacaatcattaaggccctgttcggctgcacatgcttcaactgtggtacagccaattcgaatagtactatgtgtctgtagctgcagcagcaagggctgcattgtagtgcagccgagcagaacctaagtgattttgtacctatatacttttataacttttgctctatagtttttcatcgagagtataaaaccttaatagtagttccatgtacggtattgaccaagtttaaagatctagtagaagaattcttaatttaaccatactatgaaatgaaaaccaaccactgggtgtacatgttacataattgaagcttcatactacgagattttgtacttctacacctttacggtttaatacgttctatagtttttcgttgaaaaatatttaaactttattagttttgtgtacgtatgacagagttttaagatcttatagaataactcttgttttaaataaaccccaaaccaaacgttgagtgcacatgttacatatatagtcaaaaacaaaaacaataaattgaatacgatttacaagtaaacatagtgtatagaaagttactagctcagctgtgtgttgctgcggctgcaaagcaatgacaactacggtatcaacatgagcaccaccaatgctaggtaatgcagctgttgcgtttgtgtaaaagtagctagcagaacctagccatgtcgtgggagcttttggcaaccgtactgctatagcttctttcaaagtatcaaatttcttgtacggtctaaattatcacctgaactttaataattcatatttttagattttataaaataaactacaagacaaaagataggaaaaacaaactttcgaaattctcatcgtatgcttctcggaatttgagctgctacaaacattccattttttgcctataatcgattatcatttcagacttggaaaggtattataacggcccatcgtctctcctgcttatttaacaaccattatttttaaatcttatatacatatatgtgtttgtgtgttttttagcaactttattaacttttatgtttttttaattcaaatttaaattatggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggtagcaagcgcttttgcaaaaccctggcgtgtatttaagacctaatccttcccctcccccttcccccaaacccctcctcacccgcagcgccccaacccaaccctccccgaggtcgcagccttatcctctcctctcccctccgcgaggtcaggtgagctcaaaccctatcccctcctcctccacttccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaaagctgccaaggagttgtacttcaacaaggatggctcggctatcaagaagcttcaggtgagctccaaagttcttggacacatcttatcaaattttggtcactatgattcttagccttgaccaggcactcattagttatttctacatgtcagactggagtaaacaagcttgctgaccttgttggagttacactgggaccaaagggaaggaatgttgttttggagagcaagtatgggtcccctaggattgtcaatgatggtgttacagttgcaagagaggtatattacagtgtttattgcgtcaaatagcattgaatttccttacaatttgcttgtttgctgtatgctatacttccacagaaaaaaaatgtttgttttgaaaagtaaaacagtctgcacatttgctcacaagtttcatgcgcaagtgtatttctgtttactattgctggttgcatttttgcacaccatgttctatcataataacctttgtgggttctaatatatgatcctctgacaagatgaactaaagtttgatagctggtcattgacttaactatagtgattgtgcaccatttgttttagtcatgatataaagaatttttcaattttattttcttattgaacaagtcaactggaggtttctggattatctgtgtaacctagttccagaatttgagcagaattttcaagtaacgatctctgtactgcaggttgaactggaggatcctgttgaaaatattggagctaagttggttaggcaagcagcagcaaagaccaatgatttagctggagatggcacaactacttctgttgtgcttgctcaggggctgattgctgagggtgttaaggtatgctattagttgagacatgagacctctattacttgtatggtcaatctgttaagagtcgttaatttgtgaactaagtgaaaataattcatttgctctttttcaggtcgttgcagctggtgccaatcctgtgcaaattacacgtggtatcgagaaaactgcgaaagcactagttgaagagctaaagaaattgtcaaaggaggtaaaataatcgtcaggctctaatgctttcagaatgttttagttgtggttgtggcaacctggtgtttgttgcaacaatgcttagctagactgagtcaaatcagatgatttatctatgtagtatatgcttttttttgttctacttataaaaaacattttcttgctttaggttgaagacagtgagcttgcggatgttgctgcagtcagtgctggcaacaattatgaaatcggtaatatgatagcagaggctatgagcaaggttggcaggaagggtgtggttacccttgaagaagggagaagttctgagaataatctctatgttgtggagggaatgcagtttgaacgtggttatatctccccgtattttgtaactgacagcgagaaaatgtctgcagaatatgagaactgcaaggtagcttcagcctgagcacacatacccctgctgtatgctgctttaatctgtttcagtttcttattgcactatgtttccactatttttcagcttcttttggtggacaaaaaaatcaccaacgcaagggatcttatcaatgttttggaggaggccataagaggtgcatacccaattctgataattgctgaggatattgagcaggaggctcttgctactcttgttgtcaacaagcttagagggtcattgaaaattgccgctatcaaagcccctggttttggtgagcgcaagacccagtacttggatgatattgccattctaactgtaggtgaggtggacttgcgatctggtgcatttggttgggtgatcattaatgctgcttatttatgatgattctggagcatctggctggatgattaatgctgcttatttataatgattttttttctctgcagcaactgtaatcagggatgaagttttttgtcacttgacaaggcgtgcgactctgttttaggaacggctgcaaaggtggtctttaacagagagacaacaacaattgttggtgatggcagtacacaggaagaagtgactaagagggctgcgcagataggggatcctatacagtagacttgccggcctgccggatgggttaagcaaacaaattctctc

SEQ ID NO: 24531 - DNA, 42769 bp, Oryza sativa
  unsure (1)..(42769): unsure at all n locations
atgcgccctttgatgacancttgtttgtaatcgacaaaatgccatgttatctgtatctgttctttttcttggttctttgtttggaaagatagatagatgtggttatgtgggtcgtaatccaagttttgttacttttgataggtgggagcacaaacagagaccgaactaaaagagaagaagttgagagttgaggatgccctaaatgctaccaaggttagtctgttgttataactgctttgagatagaaatagattaatgtttgcttcttaaggaagaaaaattaaggtagtttgttgctcactgagttgatatcaacgttcttctggctttggatctttaaaccgcttcctctttgtcaggctgctgttgaggaaggtattgttgttggtggagggtgcactcttctgagactggcagctagagttgacgccatcaaggacaacctggagaatgatgagcagaaggtttacaaccatgatctactttattcattgtttttgttcgagtgttctataaacctcatctctcaaaagttctgtttttgtgcctgctactatgtatatgggttagaaatgaccatctcgaatttgttgtcctttctaattgacttgttgtatgtattgcttgaactttttaggttggagctgaaattgtaaggagagcgctgagctacccgcttaaattgattgctaagaatgctggtgttaatggaagcgttgttaccgagaaggttagatcttgttcactaacagaaaatcatatgttcacatgtacatctgaataacataaaagatgatgttttaccaggttctctctaacgataacttcaagtttggttacaatgctgcaactggacagtacgaggatttgatggctgctggtatcattgaccccactaaggtctgttgctccccattgatttccgatatttttgcataaaaatttagattggtggattccctatattttagctgaaataattatagcagtgtggactgtgcagttacttttgtgttcacccttcagttcttacacatacagccattgttttgtgttgatgttagtagtttctaatgaaggttctagatccaaggcttagtgttgtggtcctagaaagattgaattggatgcaccatacaatttgctaggtttgatttagttactgcaagagagtgaaattaactttgggaaacgctaaaggaaaagcatgaacacaagtaaaagaacatagaattagactgtagcccttgcacatggttgacacactacgattgttgattcccttttccctaccatgcttcatgagaactgcgatgagctaaagactatgctttcctgatgatgggcaacaggtggtgagatgttgtcttgagcatgctgcgtcggtggccaagacattcctcacatcggatgtcgtcgtcgtcgagatcaaggagcctgagcctgcgcccgtcaccaacccgatggacaactccggtaaatgatattggccaaacgcactacacttcaatttcatgtgatcaaacactccctgaactgttgctaactttaaatctgctccgtctctttctgtccaggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttaccgttgacattcatccatttctggcgtaatttcctacagcattttcttggcaggcaggcaaagcagcgcagcatgggcttgcacgtcttcaactcttcatgctttgtctggtgactcgtgtgcatcagtaagaatttcatgcgagtatacgtttgtgatgacagcaatatccgatgaactcctgtattattacacggaccgatgactgataaagatgccgccggcgacctttcaccgctagtgtagggcctttttctttcaccgccggcgacctttcatcggacgtcgccggagcgagagaaggtatcgttaaaaaaaaaaaatcggatgagtattctatcaaatgccatataccaaatccgttttctctaatgctgtaagaacacacgcaaattaattttagttcagtagaaaaactattgcgctccatcagttctcgtcgagagagaggttaaaaggcagtcactgaacatggggcccacatgtcagttagaacccaagagaagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtactcccttaattccgtgaggcaaatgtgactacttccggcatacttgatgccagcctggttttaggtctagtatgaggcttacactatgtgctgcatcagcacttaatttaagtcgatctgttccagatggctttatgcctcttctgttatcctgtgaacttatgaatgattctgttatcctgctctagtactcgtatctactttgtagaaacaaaaaattgtattcagtttatcggaatctggtggtgttgcaggtccgaaacaatgtgcttgctgatgtcacaatgtatataggattggcaacatgatcagaggctatgagcatggttatgtgctgaaaataacctctgttggtgatggtaggcagtttgattgggttattctccatagtttgtaatagttagtgaaaaatagatcagttgagcatgaaaactacgatattatcgtctaactggtattatcttccaattgcttagtcgcagatatcagtattctggaaaatggcataaaatgtgggcatccagttctgttaattgctggtaatattgatcaggacactgtttcaatccagtccttgtggccaataagattggaagtgtatcggagtatggagactgcaagaaaacctggatgatatcactttccaattggaggtgatatgagcttcaacatctatatactgtttttttctttcaagaatacaactctatgtaatgtgaatagtcaagtggagatacactctaaccccccccccccctacactctttcagtcagattctgtatctatatttctcaatttctgatcttcctgcttgcacttattactacgattggcatgcaggctgaaagtgagctcaaaggagaagaaattttgggtggaagatgctttgaatgcaatggaagtgttatggttggtacccactatagtccatatcagaaggtgaatgttctttttagatcttcaatccatcactcgtggtgcatgtattgttcatcagccgtcaaattccctgtgtcagcatttagcagtgtcagttcatatacttctggcacttttatgaactgcattattgtcttagttgcactactttcttttgtaatccactgctaattcagttagttgtttgctttcttgctaggatgcagtggagaaagctattgctgttgctggtgtctatactcttttgaggctggcatctaaagttgacttcatcatagaatctcgagaatgattagcagaaggtgggtgaatgaagctatcatttttgcgacacatcgaaagtgattatttatgggttcatcttattttctttggtggagattattttcatggtggcatattgtagaacctttttggtcaattaacaacagatcgtatcgcccttcctgtaggttgaggttgaaattgtaaggaaggccttcagtataatccctgaaaaggtttgaagtttgaacaccattttagttactccaagcattattaatgcatgattcaatattatgcggctgcgtactactgaaaataatactattagatctctacagtcaggttcttgctaatgacaacttaatgctgctactggcaagtacgaggacttaatggttgctgggactattgaccccactaagagcaagttttatagtatagtccattgctagctctaattcatatatagtcaatttaatagccaattcatataatatttgtttactatactattaatatctggtcccacctaccatacgcacattacgttttggagtccgtgctgtagctggctacaaatctatagtctgctgcttttctctatcttcttttatctttttaaaatatgtttacagctagtttatagccttctattgtacctgctctaaggcatgccattatttgatgaattctagttcctggttactgtatggatcttatcatttcatttaagccatgctcaaatactcacaataatttttgttaactatttttctcctttttcttttattagtcattttatttttcattctgatgagctcattactcattagccccgtagtagtgttttcttggtcagtttaagatgtttgatagtacgaaacattaacctttcacttacatatccataccctaaatctttttacttattatttgtgcttagagagttacttttgcaaaaggaacataataggcggtgagttgaggtgtcgcttggagcattctgcattggtggcaaattaagacattcctggcttgagagttgagacgtggttgtcgacgccatagagagcgagaacgtacacctggtcttctgcaacctgcaaaccaatggcagctagctctggtaatctctgcacctgatcccatgcacgcctttgactgtgctatcttgcaaatctagcatagggataccacgttgcagaatatggattctgattgagcaacggcacttggcttttctgtgaaactgtggcaactaaatcttttgcttacatacagataggacggctgcacttagcaacactacacccgtagctaagtgaagtgatttcatgaatgggtgtagcgttttctttaaccttcagtaaaagaatacttgatgccaaataggagtagttttcaacttaacatagggatagaaagtaaagtaaaatgggggtgaggggttcattggatactcaagagaagtctgtgattatgtaaggcccggaattttaaacaggtgcgtgcgcatttggcttgtcacacacacataggatgcccccctctgcttggctgcgtgttcgcttgtttctgcgtgcgcctgcacagctgcaaattttcaccagtgccagcagttgggaggtagcagtagcagtggtaaactagcaaaggcaaattcacagtggggggcctggctatccatccatctccttgaccttttttacctggagcatggaaggaaattccaaaaaccctcttgagctctttcgtgcttagacaaaaagaaaataccgtttgctccaagtccaaaccattgtacttttactgtaaggcaacccaagcacacatatagatactgctacattatgtctgcgtatgcatatagtgaccgttgttttgggtctttgtggttggtaaccactccttgcactgacagtatgactctacttattagacctgtgctgccgtgcattagatgtagtagtagtataacgttactgctagtagtattttgtttgtgaaggttagtaaaataattgatggattgtaaacaaagtctaccactatagtagcagtagtaatacaagaatagtaaaaaaacacaagatccgggtcggccggcctaggggtggaaggtggccgtccacgctccgtgcaaatgtgatcttcttcttcatcctagagaagaggagaggccaacggccggccattaatattccctcttcgatgcctgcataaaaagctgtgtactgtactactacccctctctctctctctctctctctgcctcactggcacctgtagtttagcgccgttgcacgctgcctctgtgtgtgtgacctggctggctggggctgtatgactttgcctatttggtgcctcgctgtactcttgggcccggggtctacttgcgaaaaaattttttaaccaaacaagatggaggaaaaagggcaaggattgaggaatatctctgtggtggagatgggtgattatacttgaatttgctggtgtttttttttctcattacttttgcacctccaatctttgcaactttcctaccttttggggaagaattaaatgtctgttcaagtctacaggggaatttaggccctgtttagttcacaccaaactttccccaaacttccaactttccattacatcacatccaaaactttcctactcacataaactcccaacttttttttccaaactaccaactttccccaaacttctctccaatttcagaaactaaacacacagttagtttttttttctatgcacagagttgaatagaaatttcagttaccccaagatatactattttaccagccatgatttttgaatcagtagtgcattagacatatcccaccaacaaatgaatgtagttgtagattatcccccaactaataatgtgcgtgtgcaatgattctgtcatttgcaaattgcaattgccgcctcaaaacgcaaatgccaatatgtgacacctgtgaagtgaaaatggtgttggcatcataaaatatttaaccaaccccaaagcatgggtaccttctaagttagccacacaactaatttaacagtgtactgctatcacacagctgtacaactggcatatcattgctatacaccagtacaaagtgctcgtgcccaccgttttatgctgtaatctctctcaacaactgaatagaaaatcaaccacaaaactccagctggtcaattcttagggatattcttgatgcggcgaaaatctctgaaagccaatctttggtgccacctgggtattgtgcactttgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtaatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaaaagggaggaggggccttttgtgaaaataatgataagttttggggagcaaaaggtgagaggggagagggttttccaatccagcttccaagtcaaaagggtcgcccgggaacgaagaagaaagctcaaagttaagctgggctggctgctgcgggcatgccagcatcattgccgctcttttctgctctgttggcatccgagacgcctcctctgtaaaggcacaccaaagctctcttcttggaccctcaacaaaaattcagcaactgcaaatactattagttattatagttatgtcagttagtagtattagatacagggatcaattatcccttatttaattctccctaatgatccttttctgtgttttgtttactttctctctggatatatggtgtgccattcacaaagtgattgacttgctttatttcattgaggattctttccaaccttgtttaggctctggcttgtttgcccgttgattgagttggtccaagaatcaggatatatgatattcatgacttactggaaagctgttaagcaacagcactaacactggtactaagctaggcatgttcttttaccagatcagataattttcatctgtttactttctgttatgtgaaaatgatccgagatttattgctgtggagagcacacaagctggaaggaaaagatgagtatgggtgccatttttgggcttggagggtggtccttttctctgctgtacattttttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaaggtaaggtgaaaaccagactctcaaattcactttcattttttccagttccattggaagatgtttcacatgaaatccaactgcatgatcctaaaaggcacttattactcctgtagtacattgcttgtaacatctctaataatgcgcgggtcattgtcgccgaaatcttaacccgattcccttttatgtgtctgtactcctattagtatatactaaaacatccatgttgttcatgaaaatggctcattgctggtgacatgctgatgatcgcatcacgggcgtatcgctgtccgcagcaatacgttttgatgcgaactgaaaacattttatctgtactcgcatgcctgcttcgtaatgtaatgtaatgcttgtgatgttattgcaagcgatgtttgatataattgcttggttttatgtcatgacagggaagagagggaggtggtcgccgtcatggactgatgagggccgtgcgtgttcgttcgccaggccaggacaacccagcaagcatgctaactggtaagcatccatcaaagcttttctctggaaaacaaaacttggcctcagaaagtgggttctgatgaagaaaatgggtaggaaaaacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctagaagataccaaccttgtgaactatttcgtctcatgtgctgctaatatgctatatacgagctacgtgttgagtacctggtatattttcacaacacaccaatatctctagtatttcacctcactgcataaaatcgcaaaacaccaaagaacaccctaatacggctgcaactaccaccataaacatttggccatatgtaaaaacaaacgtcaccaaatcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccaccttttttttcccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgaggaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgccttccccgcctccgacttcaccccggacaccaagtacatcgtcaagggcgccacctgctccatccatgagatgtccatgtaagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttgagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttgtgtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctgaaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaacaaatttgcgcaatcttgtcacctgatttctggagggtgaaatgcaagatactattgtcactatttcctgtcaaaacaagaattattaaaaataagtccgggagctggaaactgaccggtgtaccaggcaacattgttattccgggtcaaattctattattttttttccctgtactctatttgaagttacctttgaattttcaactttgcccagcaggttctttagggttagggtttagggttaaactgaaagagcactgaggcttaaactgatttcgtgttcttgaaacctggataagggctcttttagaacgcaagagcaagaatttacaagaaaacataaaatccctatataatttctctatatcaaataaaacataaaaaaaaaaacttatgctaggtatgctggataggtcatgttatatcatcctatgtattttttctttttcagtaattatatcatcctatgtatttttttctttttcagtaaatctctattctgaatttttatttgcacgtttcccaagctcttaaacgtcatgttttgtgtaaaattttctatataatttttttagaatatttttctaaagcaactttccaactttgcaactagctaattcattacttcatatcctcaaatagctatcacaggagtcggattatccataaattttagctattttgttgttcggatgaaaatatagatattatcaactgttagagacacatggattttggcatcatttgtgatgccatcctaatgacttttctgccaaatgataaggtttgcagtagccgttgtaaactgtcgaacccttgaggataccctccatacctttgtcgaaggatgcatccgggcttatttccagacaaatgtgatgtaatccttctgactttatcagctgatcattgcacaaaacattgtacttccaaccatttgtttagtgtaaacatcagcacaaatagttgaacacaagcagttactagttcttacttaaaagctctggataattttttctatgtgcattacgaatgatgatcacctgacacatcccctttgcatgacaggttaatgaagggtttaagagaacaacctcatggcaaaatgaagccttaatttctctttcagagtttgttgggatgaaatcagctttgtacattaaatagtttgtattattttttctctaaaatcataaaagagtttgtttttgtgttgtgttcttctacctcttgcaattaaagaaaatgtacctgctcaaagaatctctcacctcatcaagacatcaacagcagaaacacatcacaaaccaggagacgacttatccaaatcaacaaccaaatgggactgcaatttagctcaagttgcagtccatctacggcagaattaacaataaaaacaacaacaaaaaaagagaaaaatttaaataatggtgattaggtcaagaagcatacgtacaatgaggtttacggagccgtccatatcaagccgtctcgacgtacacatcgggtcatgagtaattagtctcgtcggctgcattaatatactaccagtactactactaatgacttcattattctcattgcgcatgaagggtgtgatggtcaactcggttaattaattactatttggacagatcatttggagaatttagaaaaaaaagtacactatgatttatgggagttcatatatagtccaaaagttgcttatgaaaatactctatttgacaatttgtgccaattccatagtccaaaagccatcaataaagtggactattgtgcaagctctagatgcttgagtggccatgaaatcatccatgcatttttataattttatttagtggtagactttggatgcgtgaagagcaaagtttatgggggcgtattagagaagattaattgtgattttgggggtccataactgtgactttttcctacccaataaaacaattattgatggcaaagactaaactataagccagggaggcaagttgatcttcccccctattatcaggatttgttttttttttgaaaatagaatttgaatttaatctttttacatatatacacccggctacatatgtactaactacaagtaaagtaaagatatatacaaagaatttgtattattcgaagctgaaatcatgcttgaaaatttctaagttccaaacaaagccttggactaaaactcatattaattgtcacttcaacttaaaacaaagtagtcaagcattagctttacagaagaaacatggttagccatgtgttgatggaccacttgttgagttgagaataattatactagtttatgatggtaaggttggttaacctactcaaggagtagatatttatgtggtgttggcatgacatatttagaggcagggagacagggaggcaagcagcatgggttgggcatgatgatgagcccctgtttcctaatgtgcctgccctggccctgccagtggccagtagtaggtaacccatgatttctgtgggttgcacaccattgcttgttttcctctcatcacctcaagaatggagtattcttgtttttaaaatatcaccctaagttctttattattttctttgaaaaaaagaataaaatggccatgagttattttccaatggagtagtgtttttttctactgactccatttcataatagtgcttggcaatattaactaactaactaacaaacaaatggtttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccgatcagacacttcgtatccggctttctataacaagcaattgtccttttaccgttttatctgctattgcttgttatagccgttacgctgaatttaccacaggtcactcacgtatagatactaatactgtagagtgagctgtagtagcagtaaacgtcgcttaaaaggcgggaaaagctaccgttgtaggcaacaacactgaactacatgccggccattgcctggcttcttcttgttttaatcattcaatgaccttcgggttttcttgcttaattcatccctgtggacctttcatttactttcattttccccttttttcccccaaaaacactgcatactattactttactccattgcattcttgtttacaagcttaatcaccataagttattactagtcagggttaactaatgcaagttgataatagccgttctctgatcgccggttggaaggtaaagatatgaaattaaggagttgaccagcgcaatttctgcactagacaacaaactgatgttttggagtcattcatacatcagattataactaatcaagatgcctctaacccaaccaaagcctgcgtgttctcttatctgcattaagccctgcttgctttgttgtttctttcaggaagaatgacgaaacttgagccggcaagattccttcctgcatcaggttcagttcagaattgtagtttaagaacaagtttcagttgatcagcagcagcatcagctgaggccaaattctcctgtttgtcaatgctctggccaacagtttcagatcatgatattattatctaaaaaagatagtttcagatcatggtcagatttcagagggtaagaaaaaaaaagtaagtgataataataatacaattggttaaggacagttttaacaagtaagctcacacctgaccttgagagcaaaagttctagagctgctctgattcaaaaggccagccatgctcagattgctttatgatgtccttttgattaatcaatccaaactaaactgatactagtactgcaaagtcatcaccaacacgaacaaaagaaaataagaaacaagaaagcaaattaaaggacagaacagtcaaagcgagcgcgccaactctttttgaacggcggaaaaaagaaacaaaaaccagcacaaaaggtgaaggaggaagatgaactcattcctcaatcctccagcgtttacctgtcgctgaaattggggcgaccctgcaaatctctgaagaccaggatgatattcagatttgtccatacaaactattatattgtttttgtaaaaaaaaatcagattaactgttgaattagattgtggtggtttcaactttcaggtgtggagtcaagaacaagtcatgtgaatgcaaagtgcccaaaaagcctagatttgaagtcacataggacacctatcctgagcactaactgaaatctgttgtcacttgatgcataagatttgtgtacccatgacagccaacaatggctggataatgttagacatattggttgacatcacaccaggccacgaattcctaatccctaatccttcttccttttagtgccaaagttggtgtaggagcagtaaacagcaacatgagtatgtcctaagaattcagaggtactgtagaaatgattaacatatcttcatttattttactgttctactaacttgtattagctcaaattaatgcctagcaatcctttgatgggttttgcaaaaattaaaaaaaaacgtactttttttctgtccaaactatagttgttgtaggacaatagtttataaacttttcctatgtgcgacatgattattattttgaaggtgattggaggttacaaaaaaaactttctcatgcagtagctttcagtgtgaacagtaagagaacttacacatgacatcttccatctagaagtgcaggtatcatgaagaaaaaaaaggacatggcaacaaatccatttatttcagccaaaatagattatgtaagcagcagccagccatctctctgcaatctagataagaaaagagaaaaagaaagaaaattaaagttgaggtgacaagtgcacataaaagtcttttaaacgtctaggtatgaaattatgtgatcctttcgcatcttccaaactccaatccgtctcatctgctcctcctcacatcattttcggttttcctgtgagcgatgcaaagtctactcttgtgtgtgcatgtgtggagactcagagaccacgattctcactgcaaatatatcattttctttctctctttttttttcaccaccgttcaactctctctttttgacacaacagcgatctccctgtcgtgttgtcaacttgtcatttaggaatatgtgtgtgtgtttttcttactggatttcacctatatattttgttcattatgatctgtactttttccatgttatcaatttgaaggtagccagggtttttgggattcactgatcttacttaccatctgagtgcacactcacaagaaccataaaaaggcccttgcatgatgcgtcttccatgtaatcgaaaaaaatagctcctgcaagacgacaaaccatttagttacccatactcttttcgtacatggtatctccaaaccttgtcacataatatttaattcagttctagaaccggttgaccccaaaacataaaagcggcaccctccatttccatctagtggtagtcaaatacgatgaaaaatccgggtgcaggctagacttgaatttggacccggcgtacatatctacatacaatttggtcaatactctcaatcttttccatgaaaaaaatcaaaacttgtccaactcatgacgacatagaagctgcatctgatggtcacattcagctggctgggtctggaagtacaaccgctgggccagtgttgatttcttggcacaccaaagccaaagaaggccacaaggttatcttcaaagtctcaagtctagtcttgttccatatgaacacttgccctgtttgtcatttctcttttttttttctcacttgatgcaaatgttgcaacatcatcaagatgttgaggcctcacagggctccaaatgatggggcatgctggagagaaattaaaaggtaaaaaaaaaagagaggacaaaagatgatgctgatgagctttattccagtcattgttaaacagcaactggccggctaggtgtgccgtttggttttccatattggcaactaggtgagcatcaagccatttttgacccaaaaaagggatcaaagtgatcacatctacatgtaaaagaagataagagttgtagattcttacggagtacattttactttggatgtataattggagtgatcttttttaaaagcatgccttcgaaaaaaatcttgctgatgaactaggcatgtggttggtctgagaaaccacacatgtttggctgcaagaatacctttttttctctcagtgagatttttttgtccacatgaactgtaaacattgatagtgaaccatcattttgaggtcatgttggttacaggtaatactgtagcaaattttagttgggcttgcaagaacaggtggtgaacatcaaatgattagctttatgaagctgtctggatggtgagattaaaaatagttagtaaaagagacgaacttgtctattgtagagtggatatgcatgtactattgattactgccaataaaaaggacaggacagccatcatagtgggttaatttagaagactagcacaagtgctcagtgatttgtttgtgattttttttattttaaaaaagaagctgaaagtgagaggatggacacaggacaggagaattgtctgctacttgaagcctgataactacagatgctacaaacatagatcttttggcccagcccaacataaccaacacatatgagctttaggcccagcccatgtagccaaatagcccagatggaataaccagaaactggctaggctgcaccagtggtctactctgctgccaacgatttgtcttgtaaatttcaataagaaatcttttactagacaatcttttctcttgtaatctaaattgtaaaacaactgaagctcagataagtacaaggagcagcagagcacctatacattctgcatttatatacatgatcagtgtgacataccattgcaagaattttcactggaaatgggtttcagatatgtgaactgatgacccatagatagcataaacccccagagaagatctcctagcgtatatattcttccctaatgcgtctgaaaatttgatcagagatgcataagtcatgaattttatttaggccatatgataattcagaaggagcatgtagagttggagataactaatagtgaaatcgagactaaaaatatcaacaaaataatccctaacccaaactgcatgcataaacaatatcatggcccgtggaaattaaattcgataactgtatctcacgagataggtaggtacctgagtgcctgaatttcaaatctgtcgaaattaaaaaaaggaatacccactgatgaacacacacctgaatgtcatatgctcgtcagaaatatatttttccactgcacatctgcattcgtcatactgctcgatcaggtggccggcttacgtcatcgtggatgcaggatgcatatgcagacatggccggagaaggcagcgacggaggctgctcgtcgccggagatccaagaaggcgggggttccccttgcgcgactaaacaatacaataggagataattgtagggacttttaaaaaaatagaccaactcccggtttgatagtggatttatgcataaacacccctgttcccgttcgaatttacataaggaaacctccactgaactgcacgcaaagtttaagaaacgaattcaacttaacagttggattccgtttcgaattaacaaggaagcaatcggttcggaataacagttcaaattagatccggattcaattcaattcatcatgcaataaatatatgagctcatggcacctgatcggcaatcaatcaccaaacgtgggtcgtctcagagatcgatcagcttcagaattcgccgtcgatcaatttagacatctatcagctcgcgtgacatcatcaatggcggcggcggcagaagagaagaacaagaagatgatcaaggtgatcagctccgacggggaggccttcgagatgacggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggacccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcgcttggatattttttttagaaaatcatgagctgtaattaggagtctgacattaatcattaggagtctgacattaatctcaagttagtatgtaaatttttttaaaaaatatttcttatacgactccttttatattttcaaaagcaaacaagtttaaaatccgactcaaacacaaatatgtattttcaaaagtgaacgaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggttccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatcgatcgatcagcttcttcaataccaatttcggggacggctaatgggcgatcgatcccctcgagaatttagactatttaccatcaaattcgcgtgcctcaatttttttaccacccaatccgtatgccctttataatatgtcattaggactgctaattagtttatttggtaccacttttatctatctttttatctatcttaactgtaattttcttttcttaattttatttgtatatattttcaagatttgtggacatttttacccctgggcccacctgtcagatcaaagaaagatactctgggtctggatcgattcgctccctccaggcgtagcgccaccgccgccgccacgcgcttcttcggcgtcgcgtcaccaccgacccgctgccttgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaacttgatgggcgtggagggtgtcctggagctggccgtccagcgaacggcggagctgatcaggggcaagtcgccggaggagatcagggacaccttcaagatcgccaacgacttcacgccggaggaggaggagatcatcaaggagaacgcgtgggccttacagtaaatcataataatttgttaggcgtagtaataataattagtaataatagattttttttgtttatgcttttgcttaattattggtagtatcttttgtaattgaaatgttctcgagtcctaatcgatttgattagttacatttttgcaatattgttcaatttaacatgtgcatgttttggcgccaagatatctgagacatggccattattccccagagaacaatcataaacaatctaattcaccttaattaatcgtcttggttgcatatatatgatgcttcagtaatgcagggaacatatgtttcagtacactgcactcagcaggctggtgtagcaacatcaggagaaattttatggacatgatccttgatcagtatgtaaaagaaaaagggcataatcattcatgaaacaactctcagcgacatccctccggcgtcacacaacataaccattaaccaacgataatataatattaaggcagcattcacatggtcacagaacatagaccaaccctgcacagtacatgcaagaacctgcatttctcatactacagatacaacttcagtgtactcttacaagaatccatacatatgccacaggtcaagaaaccattaaatcacactagcaagtacggatatggcttgtgcaacgctggctaaaacttgatgagaacatcattggttgacatcataaatcaaactgggtaccacccacatgttgtctacttgaaagtctgggacgcggtctattctactaggaactggctgaccgagctcgaccgcagtccaaggttcaccagaatctccagatggtttcgcaacataaatccagttactctttccgccccatctttcagggctcgtgcaagagaatgtagggtccctcccatcaaggttgacaaagagagcctgattttccaacctttccatcttcacacactcaactgtttcagcagaaaactcaagacgaaagacttgaaaggtgcgaggcaattggtcgcggtctgttgacaaatcaaccatgagaagcatttcaccacaggccaccagccatggcccagaacgtgggcctgtaaccatttcttctcgtcgcagaaccgctacttcctgtatgctgagctcaggtgcaaattgcatggtgtgaagcctgccaagaacatccatcgcaaaaatctcacctttgaagagcacaatctgaagaatgtgctcaccgccataaccgtgctttgtccaagagtttgttccaacctgccaatagaatatggaagacctcgaacaaagtatcagatgtgagttgggtgaattaagtggagccgtaaggatgccgtagtagatatccctgtcgcccatgaagttgagtttgggagacttcagcttagtgctagtgtaagcatcaacaaagaggcagttcttctcatgataggagaagatgagatatccatatgagcagcccaaatagcgcatgcgatttggagcatctggcggagctgaacaacgaagggatatgtttctcttggatggatcatcaagctgccatttgcagtaagataaaagattgtccttcaaaaggacgcgaaggggacggatattaggtgtatttagtttgaggcagagaggtgggaagttgaaagtatatacggatggaaaggaagatagcgcagctcgccaagagtggcaggtggcactaaaagcaagcaagtcctggaatgagctaagcaaagcaatgatttggtgaaggaggctttccaggagacctggccaaacatggggttcacacaaggtagaagatgtaggcactgatgagtggcaggttttcttaaagggcctttctgcagcagcaacttccctgtcaaacaaagaaaaattcagagattactggagcagagaaaacattcgaagataaaattactacttcctactagtaaagattgagagatagagtggagtgatattgatccaactgtgttgtttcagtgaagcaatataaagcagtaacttcacctacagcttcttgagtcattacagtgacccttatgagttatgacacattgaggcaaataaaactgaccatttcattgaactgtaagtctgtaacgaactaacgattcccagaataagatgtgcatcaacgtcctagatgccaaccaaaacaatatacgccagaaccacctacagctttgatatcttgaacaataccacaattgtaataatctgtttatattgtgccaaacctatttttgtttttttcctcccttcccttcaaaataagacaaaatggtacttcgtattccaccctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaaaaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtactctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgctaatggatcgttccgtttttcgtgccagagccaaacgttcccaacctgctctttcgaacagagccttagatgtcttctgcatgtatttggtagctgaaattctagcaggcttccagattagtcagtttcatccttctaacttgtgatcaaattcgttatgtgttgcagggagttcggcaatctgccatcatgcaaagccccagcaagatctctgatgcctctggctcaatgccccctgccacgtctgtgcgcaaaggttccaagaagaactgcttcactccattgttcctctgttgggctccttcgtcgacattctcgcctttgctggcacctgccattcttggcgtgctgccttctcatcatacccatcaaaatctgcctttcgcaccttactcccaccactcctcgtccgacccaatgtccgcgtcaaatccccttgtatcccttctaccagcaatggtcctcacaagctactacgctcatgtcaggtcattgatctagccaaccgaaacaccccgctccgctgccagattcctcgagaaactctgcagaagatgctttttgcaggctcttctcatggtcaactcatatgctgccgcagtggttactgtctcgttgttgatgtgttcaccggtgctgaggtttcaccaccacgtcttccattcagcaaggaccatgaggagatctacttttgtggcactctgacggctcctatcacgtcacccaactcacatctccttatcagcaaccggtcatctctgttcgattggccggttggaagtgactcctggtctgagctcaagcttcctgttaatcgggtcgatcagattgtggaattcaatggtcagctcatcgccgtgattgaatacaagctgtacactttgcagttggcccccaagcttcgcctgaagaagatgaaaaccctgtggtgggatgacatgagtgaatgtccatatttgagaccatggctagtggtttgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggtgtatccaagcatgttctattcagacggagacggccagtgattggcacacgcacgagtgctctgctcttattagcttcttctgaaattgcccccttgtgatgtaaagcagagacttgtgcaacttggcctagaaatctaggagatcctcatggtggtctttatgtctagtttaacacttgcagtcgttttgtagttcagttattagctgcattaccatctgatagtagggtgtgactgcactggatgcaagtgtagttaactagttgttgcttttccactggtgatggtaggtaatgtttcgttctgtaagggtttggaacttttgttcttcttcacagcaatggtttggaacactaatgtaatgcttgtgcactttgtcttgtgatttggtgctgctccaaattttcttgcaggacaaatagattttcttgtactgggatattttctatgtacttctgaatcggaatcacattggtaactttgatctgtaattttggagtttcaggaagcagaaagaagcctagtgttccggtaatgggttgataaacatattggggcaattacaaatttaccacagttttaaattgttattgcaaaactacattcgaatagcattcttgcaaaatatcataaaaaccagagtcttaagttagattaagaaaaacaatggacaagtttgcaaatgccccaaacgtataagatttacataaacccctctcgatcagatcaaatccactccccgcaaaaaaaaaagaaagatcaaatccactcaactgcacgcgtgtgcatgtttcagaaacggattcatcgcaacagttcgcattgaaattagactcggattagatcggtttcatgcaattaattgatttctccgtgcaaaccggtcgctagctcgctggacagttgtcgtcatcaatggcggaagaagatatcaacaagatgatgagctccgacggggagatatcatcaatggcggagagggcggcgagcctgttgcggcaactgatcgaggacggctgcgccgccgccaaacccctcgctgagatggtcgagtactgcgccaagcacgccgccggcgaagctcaaggtaaggaagaggaagtattagacggcgagtccagcgacgaggaggagacggacatactcaggctggaggccagcttgatgggcgtggagaacatgctcagcgcacggcggagctcatcaaggactaggacaagccgccggagccgtcgccggagaacgtccccttccacggctttcacagtatacattcatttattgagcactgctacacagactaaattttcttattaacaatcatctcaaccatcttattatatagtatatatagtaaaagcagcaagctatattacacgagaatgcgccacatcatcacaaatataatagccatcagataaagggtttgggtaaactatagccattggatcaaacggatacatgtattaaaaaaaacataaatgggctaaacatatggaaatttccggaggtttctgttacctcctctagacacatgataaaaatgagtggggataaagagagaagaaagatgaggtttctagtgatttctcttattataaccatatagtacaacttggaaatcaatactttgtaaaataaaattaacttattatatcaaagccttcttcaaagcttacctaaactaatagaccatatagaaaagttcttaaacagattaaaagtcacgcaaagcgtgactacgaggctagtttaatttagcactgctacacagactaaattttcttactctctccatcccaaaataattttcttactccatcccaaaatgcttgacgccgttgatttttttaaacatgtttgaccgttcgtcttattaaaaaaatttaagtaattattaattattttcctatcatttgattcattattaaatatacttttatgtatatatatagttttacatatttcacaaaattttttgaacaagacgaatggtcaaatatgtttaaaaaagtcaacggtgtcaaacatttatggaaggagggagtattaacaatcatctcaaccatttaatttagttatatgaaagttataaaaaatcaacgtacactcatagcgtgacacgtcagttttagtaagaaaatgttaatacgtatagccttttccttgtttatttattattagttaaagacattattattcagagtaattagcaatagatttttttattccttgtaaaagattttgaatcctgattaatgatttatagtattttgcaacggatttgctaaatgtgtcgccagtttttttaggtttatcaggttttggaaaataatatcgctcagcagataaacgtgccttcctgaccagtataaaaaagaaggcaaattttcagggaacaatgctttcatgaggaatccatttatgccgagtcaataaaccgtagttaaatcacacaagcagtatggctaaaaacttgatgacaacaaaacgaagatgatagatagatcactggttgatgcaagccgacgcttcttcattcaggattccagggatgtactcacacatgacacattagtgttagtgttagtaagagtttactaataaaatttcagtgagttagtaaaccattactaaagcaaaagacatgattaaatgatcgtccgattttcggttctggaaactagtgttaacctatctatcatgcgccttcttgatcgctaagagaaggtaaagtaaattgcaatgccaaggcgttccgctaacgaagtcaatcatgaaacaactctcaacaacattcatagtacaatttagcctaaagatatatatatattgtgcaactcatgcgtcacataacattgtcagctatataatgtaagtctggaactgtcgaaacatgaattcggcaataataaaaggggtagtgcacgagacctaaaagtggatggatacggagacaaggatttagacaagttgaggccctctcaatgagaggtaataccctactcctgtttgggaatttgaatccgccgggtgtagtatagatctgacgatcatatgtgctcatgccccctagagggcctcctgcccaccttatataggatggagggcaggattataagatagaaaccttaaccaatacggtatcggtttactaaatctactttacaatcttatcaaaccaggactttagaccgttccgtaatatacaaggaaacgtaatacccaagtcatgatatgttacatatttcatagatatgagttatctcctataactagtcggataaccatgccgtgtgggtatggggtacccataatctccacagtagcccctaagaccttcgcagtcgaaaagataatcttctcacgaactagattattccaaagccgagtgcttcaatcatcttcgctatgatctcccgagtacttttaccgaatcagaagaccgtggagggctgaaaaacaaagtcaggtgcatcgactagatgcacctaataggtgtagccccgactatgtggttaattgaataaaccaagcatacagtcagggaataaataatccaaccaactgagtggtttttgatcattatagttaaccaagtgacttgatatcaatatatagcatatgcggtatgaatccccaaataacatgatccaagtgatataccgactgctttgtaaaaattgatgcgagcaatctaaagttgactacatcattgaaaattcacttagcaaaacagctataaaaaagcttgaatgcagtgaataaagaaatttccaaagtattgggcatacaccatgcgcacactgctttaacagatgtgcttaagtccttaaaagacacatggtttcaccacacctggaaatatacggcatatgtggtgtaacatccgagtaaataaactcataaggatttaccaaccgcctggaaaatgaccacaatatataatcagcctaagccataatattggtcaataaaaatgcacacttacgtggcaaaaagcaatgatattgtatccaatcaattgcttgataaacccaaatagcgccttgactatataaaaaagtcagcggggtagctataaaaaacttcactgttgggcaccttttaaaatgcattgtaccaactcctaaaaagttgagtaactatggtataaaaagattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacatcctttaaaggatgacgcatgtaacatgctcccgagtaataaatctttcgggtgatatagaccaagtgtagctcatatgaatagcttatgatctgagtgattatcccttatgggatactcccaaatagatataataattgaatcccgactggcgtaagtattcggttgataacccttacggggaataataaatagtccagtctttgagcatagaaaatattggtggtagtgaagataatgataccaatcaaaagtgatgaagttgcacagccgtggaggcgaataaactagtcgatagcagtcaggtcagccagcaatgaatatgaaggcgcccagcgataaagttgcatagccatggcagcaaaataatcagtcggtgacagacgaggcagctggtgaagaagatgaagatgcccattagcggtgacataataagtcatccgtgaaggcgaggatatcggtcggtggtgacgaaagcaagccgagggtgaagatgtagacacgcatcaaaggcgatgacgaaatccaccaatcatgaagatgaagaaaatagtcggcgacgacaaacgcaaccgacagtaataatgattagcagcaacaaagatgatcgactatgatgacgaagttgcccatcaaacagcagtagaataggctatgttgaagaggcttgacaggatattgatgaagatgacgatgtcggtaatccagtcaatagcagtgtagcaaccaatgataatgactaagacgctcatcagcgtttgcatagtaggtcaaccgtgaaggcgaaataacaagccagcaatgacggaagcaaccggaggctaagacgtagtcatccattagcaacgacagagatgtcagggccgatgaagtagaggtgctggtgatgaagtcagtgacaataatccatcaaactgttaagaagatatcaaagctcaagtaattttcttgatgtgtgcataacgaagattgatgcaacaccccttgatttgtaaagatggtagtagaacttggagttgtagctgttgcagatgcttcacttgaagaaaagtaaatactgttatccaactcatcaaaactgagctgattggttgataactctaaactcccggacatgtagatagaatctcaaactttgatacttggaaaaatttggagcagattgtggcggcgtgaagaagccaaaattgccggtgtaataataagagttgctgaagtagaacgtctgctctgaagtgaagaccaaactgatgactcccgaagtagattccatagaactcgttggctgattgattgattgcttcatcttgacataaagcttgtcgaattttgagagtcttgtatttgtgtagcccccgactctttggttagttgagaaacaactgaacatagagtcgagaattgtagcttcttgtcgtcgagtagtcattgcttgagtgaagatacgcatagaagatgtccgagtaaaaatcttgaatattggaacaccacttgttatagtaaaataacacggcattatacttgttgacgcatgccgagatgttgaggctcttgtagacgtcgtggtcggcgaagtagcaaagcttgcgaagtaaaggcaatagagtttgccggtgccgaagataataaagatgaagttgctcgaagaagtagagtgatgatgaaaacaaagacgttctttaaccgcggcaaaataggccagccatgaaagtgaagacgccatgggcggcggcaaaggcaaactggtgatgacgatgacaccagtcaatgttgacgaagacatgtagctgtggaggcgaacaaaccagtcggcgtcagacaaggcagccagcaatgaagacgatgacgtccatcagtagtggtagcggtataaaccagccgtagaggcgaggacaccagtcaatcagtagacaagacgactggcggtgaagactataaggccaatcaatagtatcataatcatgcagccatggaagtgaagaaaccagtcggcagcagacgcagacaacttgtgttgaagataacgacgcctattagcggtggcggcgacgtggccagccgtgaagacgatagcaccagttggcgtcatacgaggtggtcggtcggtgaagatgtagatgtctaacgacggcggcataataggccagccgtgcaggcggagacaccagtcggcggcggacgaaggcaagccggcggtgaagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtgacaccagtcggcggagacgaaggcaagccggtggtgaagatgtagacacccaacaacggtggcataataggccggccgtgcaggcggaagcaccggtcggcagtggtgaaggcaagccggcggtgaagtcgtagacgcccaacaacagcggcataataggccagccgtgcaggcggagacaccagtcggcgacggacgaggcgggcggtcggtgaagacgtaaacgcccaacaacaagcggcataataggctagccatgcaggcggtgacaccagtncgcggagaccaaagcagccngcggtgaagatgtaaacacccaacaacggtggcatattangccagccgtgcaggcggagacaccaatctgcggtggacgaggcaacccgtccgtga

SEQ ID NO: 24532 - DNA, 22379 bp, Oryza sativa
ggcggaagcaccggtcggcagtggtgaaggcaagccggcggtgaagtcgtagacgcccaacaacagcggcataataggccagccgtgcaggcggagacaccagtcggcgacggacgaggcggccggtcggtgaagacgtagacgcccaccaacagcggcataataggccagccgtgcaggcggtgacaccagtcggcggagacgaaggcaagccggcggtgaagatgtagacacccaacaacggtggcataataggccggccgtgcaggcggaagcaccggtcggcggtggcgaaggcaagccagcggtgaagtcgtagacgcccaacaacagcggcataataggccagccgtgcaagcggagacaccagtcggcggcggacgaggcggccggtcggtgaagacgtagacgcccaacaacagcggcataataggctagccatgcaggcggtgacaccagtcggcggagacgaaggcagccggcggtgaagatgtagacacccaacaacggtggcataataggccagccgtgcaggcggagacaccagtcggcggtggacgaggcagccggtcggtgaagacgtaggcgcccaacaacggcttcataataggccagccgtgcaggcgaggacaccagtcagcggcgaatgaggcggtcgacggtgaaagcgaagatgcccaccaacggtggcataataggccagccgtgcagggggaaacaccggtcgacggcggcaaaggcaggccggcggtgaaagacgtagacacctaacaacagcggcataataggccagcggtgcaggcggaaacaccggtcggcggcggcaaaggcaggccggccgtgatgacgtagacgcccaacaacggcggcataataggccagccgtgcaggcgaggacaccagtcggcagcagacggaggcaggccggaggtgaagacgtagacgcccaacaacggcggcataataggctagctgtgcaggcgaggacaccagtcagcggcgaacgaggttgtcgacggtgaaagcgaagatgcccaccaacggcggcgtaataggccagccgtgcaggcggaaacaccggtcggcggcggcaaaggcaggccgacggtgaagacgtagacgcccaacaacggcggcataataggccagccgtgcaagcgaggacaccagtcagcggtagacgaggcggccggcggtgaagacgtaggcgcccaacaacggcttcataagccgtgcagacgaggacaccagtcagcggcgaacgaggcggtcgacggtgaaagcgaagatgcccaccaacggcggcataaaagaccagccgtgcaggcggaaacaccggtcggcggcggcaaaggcagtgtaacgtcccgccttcccccaggccgggcccgcttatatctgatagctttcataggtcatataacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagccgtgcaggcggaaacaccggtcggcggcggcaaaggcaggccggcggtgaagacgtaaacgcccaacaacggcggcataataggccagcggtgcaggcggaaacaccggtcggcggtggcaaaggtaggccggcggtgaaaacgtaaacgcccaacaacggcggcataataggccagcggtgcaggcggaaacaccggtcggcggcggcaaaggcaggccggcggtgaaaacgtagacgcccaacaacggcggcataataggccagcggtgcaggcggaaacaccggtcggcggcggcaaaggcaggccggcggtgaagacgtagacgcccaacaacgacggcataataggcctgccgtgcaggcgaggacaccagtcggcggcagacggaggcaggccggcggtgaagacgtagacgcccaacaacggcgacataataggccaatcgtgtaagcgaggctgatttgcatgtagattcgtctctctgattttgttgacatgatgggcttggtgcagccaaccggccttagaggtgttgtgtgtggcatgagcgaacgctgcatcatcaacatcagtagtcgagccacgcactatgtcctggcgtacccctctcggcaacatggttacagtaggaagcattgcaccgacggccatacatgcaataaaaaatcatgagaagattaatatgcgttagtaattaatctaaatatataaattacaaggaggtcaggaaccgcagcactgccaaatcccatcactcgttaatgaacgattttttgatctcaattgccatcctgggcatgcgaccaaccatgcatcgctccagtatacatgcaaaataaacaaatataatttgattagccttaaaatattacatgcttaactgtgtaatacatatatcaagctagggtttgatattaagccgtgcatatcagttgatctgcatgtgaagcactcaattgctgttgatcccatggacatgaattgttcccgtgtcgtatgaaggttacgccggtacctatacagatcgtactgggcgacgagaagacacaccgggacttcgtcttgatctcagccggtgcgtgaaaacaagaaaaagaaaggtaataggagattagtctgcagttagagaacaatctaactagtgaaacgacaaagccaatgacattggagattgaatcgatgaaatcaccgagattgatcccttcggctggattgaatccgagatgaaaaagacatgcttgatgaatctggtgatgtcgcacattggttccatcacactcgtgacaggaaactcgatgctcccttacctgacgcgccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatctgccgggtgtagtatagatctgacgatcatacgtgctcatgccccctagagggcctcctgcccaccttatataggatggagggcaggattacaagatagaaaccttaaccaatacggtatcggtttcctaaatctactttacaatcttatcgaaccaggactttaggccgttccgtaatatacaaggaaacgtaatacccaagtcatgatctattacatatttcatagatatatgagttatcccctataactagtcggataaacatgccgtgtgagtatggggtacccataatctacacaggaactttttgtgctggaagtctggaacttggtactgttgaggatttccactggtgatgctagataatgtttcattctgtaagggtttggaacttttgttcttcttcgcagcaatggtttggaacactaatgtaatgcttgtgcactttggcttgtgatttggtgctgctccaaattttcttgcagcacaaataattttggagatattttcttgtactacgatattttctatgtacttctgaatcggaatcacattggtaacttcgatctttaataattttggagtttcaggaagcagaaagaagcctagtgttccggtaatgggctgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaatcgaatcgtttttcatattgcttttaattttctcttagtttgtccatctttgtcgatttgcaccgaaaattgtccaccgccgctgcgagagtgcgacacccctttgttggtttatcctgaaaaccttccgttttgcccacgagacgggtagttatctagaaatcggctccgctagccggtttagttatcaaaacccatcttggtctagcttttggctagatcgaggtggttggcaactccaaatcaccgcaaggcgtttaggtgctgcgatcgtgcttgtcgacttttcacaaaaagttgccaacacgaattttggcgactccgctggggaaatccgttcaacgccatctcaacttcgacatcgccatgacgaagcctccatcaaccaaggcggaggtggatccatccaatgtgctgccggtgatgatggagagtcttgatgaggaagcacgcatggccttcgatgaacacatgaagaagtatgccgacgagcttttaaagacatgctcaaagacccgtcatggcgtagtcttcaagccggatttggtgtcttcatctacttttgacaaggtaagtattgaggaattatcacaatctcttcaacaacaagttgctcatacaatagatgcatctatggttgctttcaataacaaattagaagcatcttttgaaaataattgtgaaaagtttatgagaaataaactcggccctctcgtggccgattttgtaatcaaagataaagcctctaccagtgctagccaagctcctatagatcaaataaatagtaaaaccgatggagcgaagacacaacaaatcggcgagggctttccggcgcaaactgctgatcagaccgggccagataaagccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggcctgataatatagagcacttgattagtggaattattagggataaattcaggattgaagctaggaatcgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatctgttagaccatatgagaaaaagcctaatgttaattcaattgattactttgaggctagtgatagtgatgatgagggtgatcatgacatatatgttgctgagtggacatggactaacaaaaataagccttttgtttgctctaatttaatgccgactcctcgtaaagatcggcaaagtgagattaagtataggtttgatgtggccaaatgtgataagatttttgattatcttttgcaagaaaaacaaattagattacctaaaggccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatctagcgttatctctgatctcgccgggcacgagttcgaggaggaagactaccctgttgtcgactacgagttagcacttcagactgccaagtcgacaacagatagataggctaccacaaatattgtactggtgtgattatggtgaataagagcaacgatcggcttcggccaacaggatgtagggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttccgaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtatctttgtggaccggtcagaccgggccatagggcggtctgaccaccgacccaatgttggtctgaccggcgcttctagccggtctgaccggtggtctacgtccggtttgaccgggcttcaacgccggattgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatctcaaaggtcatgttgatgggaagccagtctctaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatgggaatatccaatgcttatcggggagggatctttctagctatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgagatgccaggtcttagccgtgagtttgttgagcatcggcttccaatcaaaccaggttttaggccttataaacaaccacctcgtcgttttaatctttgctatatgatcgagtcaaagaggagattgatcggttgttgaaggcggggtttattaggccatgtcgttatgcggagtgggtttctagcatagtcctggtggagaagaaggggagtggtaagattagagtttgcatagattttagagatttaaataaagctactcccaaagatgtatatcctatgcctatagccgacatgatgatcaatgatgcctcgggtcataaggtgattagttttttggatggtaatgctggctacaatcaaatctttatggcggaagaagatatgtacaagacggcttttaggtgcccgggatttgttggtttgtttgagtgggttgtcatgacttttagattgaagaataccggtgcactatatcaaagggcaatgaatttgatctttcatgatttgctaggtattatcttagaaatctatattgatgatattgttgtcaaatcggatggtatgaagggacatatagccgatttgaggttagcttttgagaggatgcgccggtatggtttgaagatgaacccacttaaatgtgcttttggtgtgtcggcggggaggttcttgggattcatggtgcatgagagaggggttgagattgatcctaagaagatagaaaagattcgtgatttcaaagcgccgacatgcaagaaggaggtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctttttggttgtatattgcttccgaggataaagtcattggtgctgttttgccgcaagaggaagatggcaaggagtatatcattacatatttcagctgccatcttttggatgccgaaacgaggtatgtctttatagagagactttgtctatacttatactatgcttgtaccaaattgaggcattacttgttatctagtacatgcatagttgcttgtcaagccgacattattaaacacatgttgcaatggccaattctaagtggaagaattggcaagtgggcatatgctttgattgagtatgatttggattatgaaccgttgaaatctatgagaggccaaattgtatgtgattttatagtagaccatcatgtagatattgcttatgaagaaggggtttgcttagttgaagttataccttagaagatttattttgatggttcttcatgcaaagaaggtcaaggtatagaagtagttttattttcacctaatggcatgtgttatgaggcatcggttcatttggagtattattgtacaaataatcaagccgaatataatgctttattattcggcttacaagtgatggagatgattggagctaagcacgtggaagcttttggtgattcggaattggtggtgcaacaagtcgccggaatctacaaatgtttggacggatcactaaataggtatcttgattcatgcttggacattattgctaatttcgataattctagagcaaatgatttggcacaacaagcatctggctataatgtgaagaagggattatttctgatactagaagagccggtgcttgatttttaaacctttgtgcaaaattggcaaaactggagaccaggggcggtctgaccggcgttgcacggccggtctgaccggtgagcaggggcggtttgatcggccacatgccaccagtctgaccagccaccccgggcggtctgatcggtcttgtatggctggtctgaccgattctggacagagcgatggggggcacgccgcaattgattcaaagaccgaattagctgtgaattcggacatttgtgcccagggaacagaagagtccagatcggctacgaccagatcggctgagtccaagtcagatagggttagccgatacagccgattccgacaatatgaatcggtttacattatcgagctgagttaatgtgcttcacatggattgccacacatggatagagttctaagaaggcaattgtatctattaattaggatattttatgtaatttccttagagataagtttgggcaaaagtctgctgcaaagacttatggtatcttagagtttgttagagataatagtcgtgtccgacaaaggacatattttgtagtctcgggtataaatagaccccgagtcccatgtaatcaattaacacacgttcaaatacaatcttggcgcatcgccacccttttactttcgttttgtttcgacgagttcttgctttcgggttgaactgcatcggtttcgatcttcaactagaggtatgacttgttatggtggcttgcgttctcgagattggtgcttccatcattatgatactctaatcctatctatgtaagttgttgagttatcatatatcttatataatctctgacaatatcgctatctaacctccaatcggctagtgtctatcgctggagagcagccgattaggttaagtatcgacgttggcttagattatataggatatctaccactttatgaagcttccaatagcttgattgcctaaatattgtctttcttttcatacttatggctgcatcagttgagtttgatctcataagtcgtgcttagaactataatctctagcctgcttcttggttgtcgattagagtagtatcggggtttcagccgatcttacctaatttagccttatatttcatgtgcttaattgatatgttaaatctgccctttatgttaagatcttattgcttttaggtgtgttaaactttacgtttgatatattttacttgctttaatatcttaaggtagagtagtatcggagtattagccgatacaagctagatctatttgatcagctatgctgtgaatgattatagtttccttgttaatatatatttcggtctaagtgatttatactgtctcggcatggcgaccgatctatcccaattacttgatttaagtatatatcgacatgaagattatttatcattgatatctacagccgattgaatagatttagtttctttattattgcctcgcacagccgatcgatgcaaagatgacatcggctcgagtacaaatgatacgtcatcggcggctggtcgatcggctatcatttatggactaactactatttctttgtctttatttcttgttgattgcaggatcaaatcaactggcatgctcatgaacctcaaaggcaagattttggacctgcactagagttaagcagatctcccaggcctcgtgtttttacatcaacactctcttggcacgcccggtgggacctgagttttcaacgacttcatcccgatggccgaaaaaccaccaccatcaccgggaacaggagtcaaacctcccgtaaataaaatgggggccaaaaatccatcagctgaagtggacccaaccaatattgttccaatcacattggataggctgacagctgagcaaagggatgaacttgaacagatgatgagcaacgtgaagaacaaattcatggattcttttcaggagacccgcagaggaaccatcgtacaaaagtacaagttgaaggtggtcgcagccgatgaggtcagcccaagttcatctcagggtgacaaaggtactgcaactggctcaggtaacaaaagtgatattcctcaagatggtacagttgaagaccttggtgcagatggcaaccaagagccactgcaattcaataattttcaagataggatcgactatgccgtgcaacatgccttgatcaatcagtctggagtattagttaataccttaaccaatatggtaaagactgttgtcgatggttcgatagccgaacatcaagcttcaggaccagtctatttaccaggaggtgtttttccaaattatagaccattggtcacagcaaatcagtcgaatgtctcccatgcattaccggctcagccgatggcttcagcttcaacttctgcacaagctacatcatcagtgtaacgccccgattttcgttcgggattaaaaatcattaaataatgcattttctagaaattaaataaaagttaaatcaacttaatcaagtgaattattgggagaattaaaattttcccttaaaaatcattggccgggaatattttgtaatatcctttgtgccctaaaatactctccggaattttccgtgaattttcggagctcaagaaataattttaataacacaaagatcattgtatcaattaaaataaaaagaaaacaattaaaatcctctttcctctctttgggcccctttcggcccaacccctcctttctctccctctcgggccggcctcctccctcggcccgctcggctctctctctccctcaagtctgttttgcctccccagccggcctctccctccctctctctccgacaggtgggacccgtggaccccacctgtcatccccaacctcaggccggcagctgccgttgccgccatggccgcccgagccgccccacgacgctgccgtttccgcccaccttcttcaccccgcgcgcgcgcgttcgtccgtgggacctcgccgcccacgtccgcgccgttttcccccatctctcccctccaaaaccgccacccacaccccacgatgccgcccacgcttcccggcggttgccgcccactccgccgcaaaatccgcaccaccccgccccttccgctcgcgcccaagtggtggaactgcacccccaccaccttctccaccgtttcccccatttccccccaagaaaacggcgccggtttgccccgccacgagctccacgtcgacaccccgcttcccgccggttgccgccccaaatccacctcgctcgtgctctctcccaccctctcgaggctataaaaacgatccctgtgctctcctctcccatttccccaattttcccgggcccgtcgcgccttctcccgctctccccgcgtgaacccgagctccgccgctcgtcgccgtgcttccagccgcacgccaccgccgctccagtcgcccccgcgctgcgccgccaccatcattggcatcgccgtgccgtgccgcaccccggcccctactccttttcccctctccgcctccgaaacaccactgcaccgcgcgcccgagccccgccggccgccagcgcccttcagccggccgccaccgtcactcccgccgtcgctgctccgcgcaactgtcaccgacggcttcgttgcgtcgtcccgtaccccggcatcccctccgctcctccattccgccgctggaaccgtcactccaccacaccacccgaaccgccatcatagcagccgcctccggctgccactcgccggcgctccaaaccatttccggcctcacgtcctcctccagtggcatcgcagcgtcgataggaagcccggcgttcccctcatccgagctccccgtcgccgatgcccgttcccgccacgcgaggtcgcggccgccctcgtccgcttcctcccgggcgccgcttgtcgccggagcagcgacgccatcctccgcccgagctccgccggccgccttccgtcgccggcgcccctcggtgaggaccccctccatctcctctccctttcccctcttttcgtcgcctcccgcgcgtgctgtcgcgccggtggtcgtcgccggcgaccatcgggccgtgcgccgtcgctcccggccggccgatcggtcagccggctcccgctcgcccgtggccgcccgatcccccttcggggcgatctgggccgtccacgtggccctcccgtgccgcccgagtcggtgcctctgtggcgccacgtcggcgccacctccgctagccgtccgtcgtggccgccaggtgtctgccacgtggtgcgcccgcggaccagcgcgtgcgtggactcggtccacggtgtgcccgccacccgtgagtcaccgacaggtggggcccgcttgccggcgccacctctcccccgtcggatgacgtcataattgatttaaattgcgcaataaatcggtaataattctagaaatccattaaaatggctcaaaacttccaaaattcatatctaattcattcgaattccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagtttagaagatccaagtgaagaagcaaggcaagtcacacattccccttgagcatgttgatcctaatttataaatgttttaccgtttacaaataaatatgcatgttttgctaattacacggggtcagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagctgcgtgctcgagacgtctggccatgtttcatggtcgtaattatccaactaaaatacgactgaatggtgggctgtgggtgcatggttttgcgagtcgcacccatggcaattaaggaccggttcacgagaaaccctggaagacttacagtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgtcactttaattattcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaatcagcaccaagacagatggttaaccccagattgttgaccagagaacaaccacaacatgctgggcaaaatgtcaatcggctgactcaggagcaagttgctgcaatgttcttgccaaatccgacaatagccgacccaacacagccgttgccgactcagcaagcacagccgaggtagcagacagttcatccgactcagcagcaaaacttacaacatgcgtcagcgagattgagaacacctgacaatcggccaatgcagcatactgtgaaccaagttattcctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctagagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttgatttctaccccgagttggacgtggaggagggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctggacagttgtcgtcatcaatggcggaagaagatatcaacaagatgatgagctccgacggggagatatcatcaatggcagagagggcggcgagtctgttgcgggaactgcggcaactgatcgaggacggctgcgccgccgccaaacccctcgccgagatggtcgagtactgcgccaagcacgccgccggcgacgaagctgaaggcaaggaagaggaggtattagatgatggcgagtccagcgacgatgaggaggagacggacatgctcaggctggaggccagctcgatggacgtggagaacatgctcagcgtggccgcgcagcgcacggcggagctcatcaaggacaaggacaagccgccggagccagagccgtcgccggagccatcgccggagaacgaccccttccacggctttcacagtttgcattcatttactgagcactgctacacggactaattttttttattactaaacttttactaataatcgtctcaaccatttgatttaggtatatgaaagttatgaaaaatcggcgtacactcatatagcgtgacacgtctaccctaaagttcaacaaatatctaccctatagttcaacaaaaacaaattctttcactcattcactcatcactcattctttcattcctcactcaacggtccagattacctcactctgatccaacgctccggattcaccccacctccctccccaccctgacagcccgacctggtgacctgcgccccctcccccaaccctaatccctcctcttcccctctcacgcgctgccgccgacgcccttcacctctctgccaacgccgcccgcgtctccgcgccgacgcagcccgcgcctccgcgcatcgcccttcgcctcgccatcaccgccgccgtcgattgcctccaccctctttgatgccctatccccgccacgcgcagctgcctcgccggggatgacctcgcgtcagtgacagtggtccagtgctcaatttgctgctcggtctgcgttgacactactgaggtctacggcgaggctactcccctcaggtcttatctcaatcccccgcctacggtggtgtatggttcgcatactttgtagtgtcctgttgaacttcgagtcatttttctcactaagaaaatggtaggtgataagatatcaggtacttcggttttattgtctctcaaacatcagtagttcggttgtgtgtttaaccaaatgaagcataatataatgtatattcttatgacaatgtattagatcgaacaatggtttttttaggagtattaatttggcactgttattagatccaacaatggtttttttaggagtattcaatttcaatgtaatctggttcttgatctacaaagggttcacgtgtactgtgttggcttggggtccagtctcctcctcctgcacgtgatgtgtgctgaacacggcggagaaataatggactgccaacatgatcggacaattcattgcttcctttagtttaacttgcagtgtgaatgattttcctattaagaacgcatgaagtcagaattaactgaaagaaagatattgcgtgtttaattaaactatccacagaatctgagtaattcagttcattttcttcacattcttttcaagaatagtctctgatatttcgtattagaattgcatgcatatatacaaccctgtctaattatatctgttcaaaataatttcagccagcttgacaagcaataatttctcaggaacctcaattggcaatatcaccacacttctaggaggaggagaggctgctccgcgggcttcgtagggatcccggcgagctcgcccccgtgactcctgcttcctctggtgtggctaaatcagttacggctcctctggggctttgcttgtgccttctgttctgattaggttaggacaaatttgtaacggctttgtggtctaacatttgctctgtgcggccgaattttttggtggccctataataattgagttcaactaatctaccctttagagcaactcaaatatcgatctgtcttttgttaatccaagcaacacatatgctgcaatggataagaacaaagaatatggtgctgttataatttacatgtttagaaaaaaaaactaatgcagtaaacacaattattcatggaaccaatgataatttacacttgctatggatataatgtcctgtatatttcagaatagagtaaagtgcacgagcggtccctaaacttgtgcgggtgtgtcacctaggtccctgaactctcagaatgcacttttgggccccttaacttatcttgggtgtcatataggtctaaatgggctccaactcactccgtgtgctaatgtggcatgccatggtagcgcctatgtgtcagtagaacccatatggcagcgatgcggtcacaagttccaccacggtgagtgcctttctgcgttcatatctccctgtactgatttgatcttgactagcataattatatgcctccctagaatttggcccagagaaccccaggtattcatttttttggcccacgaaaaaagccttgcccatcaaaacaaagaaaaccctaactcctctccaatctggctgtctgccccgtggctctctcccctgccacttgatggggtcacggcgactgcgctcccatgaccccgtgacctggacgcgagcccccaggctatccgccggggtgaattcggtgcctccggccgttctacaagctggccaatttccgtcaggcccgcacacggcgcccaatcctggttgaagaaactggccaatggcccgatcggccgaatactttattccgtccgc

SEQ ID NO: 24533 - DNA, 890 bp, Oryza sativa
  unsure (1)..(890): unsure at all n locations
nttaggtaaaaggctaaaacaaaaaaaggttcacccaatcccacccccttagtaagaagcaaatgcaatatgcatgtcaaaccaacccacgttaacaaatcttattcttttctgaatatgggatccacctcagaacacttagaatcacattttgtattttgaacatcagagaagccgggccatgtgagcagcatttcagtttatctttcagcaatgaattaaaagaaaaaacgagatttggagggagagacgtctctccaaacatttttttaaaaaagaaattgttagcatgttggggattgaacacggctgtcagcagtgaattgtggagcctcaggtacactctttcactcaaaattcaacaatgcggaaccacctatttccttttccctctaggttgttcgcttacaagttcgtggtcagggctccagaatcgtcaagctaggatagattctaccgcatggtgcaaacaaaagatttggccgaagagaatgccccaaagttttgtcactttctgaatcgcttgaacaaaacgagcgctagtacagcacagaccacgaacataagaacgaatcgggacagatttgtacaaccagtggctgtatcatcgcgctctccttgaccagttcatctaaattgcgtgggaaagggggcaaaaaaagatgaactttttagggatcgacacactcactccccaagaaacagacaaactgcgaactgctacaacttcatgccgggaaaaaaacacccctttgggggggcctttttcaacttcacngcaaaagagcaattgaagacagtaagaattcaaaagaagtagggnaaggtaataaaggggacgatcattacctattgatggatggatggattggatcccgtttcattgcttg

SEQ ID NO: 24534 - DNA, 747 bp, Oryza sativa
  unsure (1)..(747): unsure at all n locations
aggcgcctttgtttgatgacanactancttggnacccggcgtgtggtcgttcttgatcccgaacatctccctgatctgctccggcgacttgcccttgatcagctccgccgtgcgctgcgccgccaggctgagaaggccctccacgcccatgaagttggccgccatgatcaggtcgtacagcatgtcgatgcccacctccatgaactccacgtcgaacttcttcagctcctccttcgccttgcggctgctgctgctaccttcggcggcggcgatggcgtgcttggtgcagtactcgatgaccttggcgagggcgctgccggcgacgttggggagagtgatcccggcgccgccgtcgccggtgcagccgtcctcgatcatgtggaggagtatccgcgacatgctcgccgccgcctccgtcatctcgaaggcctccccgtcggagctgatcaccttgatcatcttcttgttcttctcttctgccgccgccgccattgatgatgtcacgcgagctgatagatgtctaaattgatcgacggcgaattctgaagctgatcgatctctgagacgacccacgtttggtgattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24535 - DNA, 1514 bp, Oryza sativa
  unsure (1)..(1514): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagccgtgcaggcggaaacaccggtcggcggcggcaaaggcaggccggcggtgaagacgtagacgcccaacaacggcggcataataggccagcggtgcaggcggaaacaccggtcggcggtggcaaaggtaggccggcggtgaagacgtagacgcccaacaacggcggcataataggccagcggtgcaggcggaaacaccggtcggcggcggcaaaggcaggccggcggtgaaaacgtatacgcccaacaacggcggcataataggccagcggtgcatgcggaaacacccgtcggcggcggcaaaagcatgccggcggtgaagacgtagacgcccaacaacgacggcataataggcctgccgtgcaggcgaggacaccagtcggcggcagacagaggcagggccggtggttgaaagactttaataccgccccccaaaccaaaccggggtcgggaaccacattaaaaaattaagggggggcgcgccccccacaaaaaaaaatatttttcctgtagggaggctgatttgcatgtagattcgtttttctgattttgtngacaagatgggctttggtgcaacaccaaccggcctaaaaggtgttgngtgttggcattgagcgaaacgcttggattcag

SEQ ID NO: 24536 - DNA, 802 bp, Oryza sativa
  unsure (1)..(802): unsure at all n locations
ccgtcnttaagactgcactgccccataaanacaactgaatntncagctagttcaacagattagattcgtgcaagatcaaacagttgtcctcaaacaagcaatatgtgattcactggacttattgtggtagaataaatgtaattaaaaccacaaccatcatatatactttaataaaaatcagctgaagatatagacaccttgttatttattctcctgacaaatgccctactctctcacagtctcacatagcaacatctagacccaaggggattattggttgaagcaacgggttaaaatgaaagggttggcttgggtgggagtggatggttcatccaatcgaaaccagtggtagtatcgatggggccattcttcaactataatggtgtcaaagtatatgttcacaacagcaattttctattcgtaatgtgtattaatagtgggattagcaaaaagtcatttgcctccgcccctgctccaattaatcatagtatttggttaagaggatcacagagtagactccgcgatcgatcgatcgatcatccctgaggaatcggtagcttgtaatcgatcaaacacgaccacttcaaatctcgacgattcatgcacaaattcatcagagaagatgaaactgggacccccaaaacgcaggcgagctcgctgcgcaaacacgggaggacccacgaacgaacgagttaggaagcccaacttatacgtagagaagtccgacggagaggcgcagcaccatggaggagatgaacggagagagcagatccgcgagagatcttggagccctatgtctagg

SEQ ID NO: 24537 - DNA, 797 bp, Oryza sativa
  unsure (1)..(797): unsure at all n locations
cacgcctgatgattgacatccactcttacaccgncaaancatatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatccgatcgatcangctttctttccacattaaaccaaaattttttccggggggggggaaaccggggggggcccttttttttaataaaaaatttggcgacgatccctcgagaattagactatttaccatcaaattcgcgtgcctcaatttttttaccacccaatccggatgccccttataatatgtcaataggactgcttaatagt

SEQ ID NO: 24538 - DNA, 1629 bp, Oryza sativa
  unsure (1)..(1629): unsure at all n locations
cgccttgatggcgtcaactctagctggcagtctcagaaaagtgcaccctccaccaacaaacaattaccttcttcaacacaagcctacaaagagaagcggtttaagatccaaagcgaggaaaaaaaaaaagggggggaaaacaccccccggttttggaaatttattccaaaaccttcaaagttgaaggcaaacaaaacctacctttaattttttcttccttaagaagcaaacattaatctatttctatctcaaagcagttataacaacagactaaccttggtagcatttagggcatcctcaactctcaacttcttctcttttagttcggtctctgtttgtgctcccacctatcaaaagtaacaaaacttggattacgacccacataaccacatctatctatctttccaaccaaagacccaagaaaaagaccagatacagataacatggcattttgtccatttcttattatacctgaatgactgcaacaccaccagcaagctttgcaatcctctcattgagcttttccttctcgtattcttgttcggcagcctgcaaattggatagataaaaaagcaatcaggagcaggactgatgcttttcttttcttgtacaaacaacacattcaatatacagcctcataatagagaaagctttcagtttgaaaccagatgaagcatgtaaccaatcaagctacatttccagatatgtacagtctataactagattaaagaaatggtggaatatagaaccactattgtgccaaaaaaaaaaatttgcgaggcactattgtgccaaattaaccatggtaaacagatataacatacctcgatgagattttttatttgtgcaaccctcttagtcacttcttcctgtgtactgccatcaccaacaattgttgttgactctttgttaaggaccaccttggcagccgttcctaaaactgatttgtctgccttgtcaagtgacagcccaacttcatccctgattacagttgctgcagagaaaaaaaatcattataaataagcagcattaatcatccagccagatgctccagaatcatcataaataagcagcattaatgatcacccaaccaaatgcaccagatcgcaagtccacctcacctccagttagaatggcaatatcatccaagtactgggtcttgcgctcaccaaaaccaggggctttgatagcggcaattttcaatgaccctctaagcttgttgacaacaagagtagcaagagcctcctgctcaatatcctcagcaattatcagaattgggtatgcacctcttatggcctcctccaaaacattgataagatcccttgcgttggtgatttttttgtccaccaaaagaagctgaaaaatagtggaaacatagtgcaataagaaactgaaacagattaaagcagcatacagcagggggtatgttgtgtctcagggncttgaaagnctttaccccttttggcccaagggtttttcctttccaaaatatttataaaattttttttttccctcagacatttctcgctgtcagttacaaaatacggggagatataaccacgttcaaactgcattcccttcacaacatagagattattctcagaacttgctccttcttcaatggtaacc

SEQ ID NO: 24539 - DNA, 760 bp, Oryza sativa
  unsure (1)..(760): unsure at all n locations
cagcccaaaataatttgggagatattttcttgtactccgatattttcttatgacttctgaatcggaatcccattggtaactccaatctttaataattttgaagttccaggaagcagaaagaaccctagtgttccggtaattgggtgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaannnnnnnnnnnnnnnnnnnnnnnnnnnnnnnnnnnnnnnnnnnnnnnnnnnnnnnnnnnnnnnnnnnnnnnnnncaaacaaacctaat

SEQ ID NO: 24540 - DNA, 1415 bp, Oryza sativa
  unsure (1)..(1415): unsure at all n locations
ntggttgccatctgcaccaaggttttcaantgtaccatcttgaggaatatcacttttgttacctagccagttcagtaccttgtcccctagataactggcatacctataggggcccttttggggcccccgggaaaacccccacccctttttccaaaaactttggtaactttnttggaacgaatgagttcctnctgcgggtctcctaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaaaagagtgttgatgtaaaaacacgaggcctgggagatctgcttaactctagtgcaggtccaaaatcttgcctttaaggttcatgagcatgccagttgatttgatcctgcaatcaacaagaaataaagncaaagaaagtagtagtccataaatgataccggtcgaccagccgccgataacgtatcatttgtactcgagccgatgtcatctttgcatcgataggctgtgcgaggcaataataaagaaactaaatctattcaatcggctgtagatatcaatgataaataatcttcgtggggttttcccccccggngaaaattttaattaaattaaccctttaaaaaattacagagttanatttgggggataggatcgggtccgccatgccgagacagtataaatcacttagaccgaaatatatattaacaagaacactataatcattcacagcatagctgatcaaatagatctagcttgtatcggctaatactccgatactactctaccttaagatattaaagcaagtaaaatatatcaaacgtaaagtttgtcacacctaaaagcaataagatcttaacataaagggcagatttaacatatcaattcagcacatgaaatataaggctaaattaggtaagatcggctgaaaccccgatactactctaatcgacacccaaaaagcaggctagagattatagttctaagcacgacttatgagatcaaactcaactgatgcagccataagtatgaaaagaaagacaatatttaggcaatcaagctattggaagcttcataaagtggtagatatcctatataatctaagccaacgtcgatacttaacctaatcggctgctctccagcgatagacactacccgattggaggttagatagcgatattgtcagagattatataagatatatgataactcancnncttncatagatagggtacagagaagtctatcaaaggtcg

SEQ ID NO: 24541 - DNA, 884 bp, Oryza sativa
  unsure (1)..(884): unsure at all n locations
ttcgcataaccctcccctacccatccacncngngttaaggtttcaccccccacccctcaaaagacagtgggcggtcccctcttgcgcccggtaaatacgacagctgaacaccggaccaaaaacccaccccccccccccgcggggggtcccccggaaaccccccaaaattttccccattcaaacggcccccaccccttcgcccaccggtgcctaggaaagggtcgagctatacttcagatcaagcagttacccactcccgcttgtggtaagcactgtaagtcttccagggtttctcgtgaaccggtccttaattgccatgggtgcgactcgcaaaaccatgcacccacagcccaccattcagtcgtattttagttggataattacgaccatgaaacatggccagacgtctcgagcacgcagctcaacaagatactagaatgtctaatactgcaattatcccatcgactgagctagtggtaattaagcatggctaagcatatagttctagctaggtcacataagtaacacgagctagtcaatttatcacccaaggttgacaaaggatagatatcaagtaaccatggcacaagcgagcagataggtaaaccctgaccccgtgtaattagcaaaacatgcatatttatttgtaaacggtaaaacatttataaattaggatcaacatgctcaaggggaatgtgtgacttgccttgcttcttcacttggatcttctaaactcttttcctcgcgaccgcggacttccgaaacgacggattctacacgctggcacgcaaaacgaggaaannnnnnnnnnnnnnnnnnnnnnnnnnnnnnnnnnnnnnnnnnnnnnnnnnnnnnnnnnnnnnnnnnngggtagtgattcgaag

SEQ ID NO: 24542 - DNA, 948 bp, Oryza sativa
  unsure (1)..(948): unsure at all n locations
ttgatctcacttcagctgctgcacccattcgagatcatcatccgtgctgatgctgttcgcatgcacctgcttgggttcatcatctgccttttgtgtctgggctggttcactcaaaaaaagaaaaaaaaaggcgcccccccccaaacaaaggggtttgaaaaggaaagccccgcctccacaattccattgtganntcgcttctttgtccagagcacagccaatggtgtgctgtactcatttggtcgcattctgctgctcgatgcctcgccaccagggaagaagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatgaaagacgagaagaggctgggcatggagaaaggggaaggcatgagtgcggttgccgattccggcgagggaagggggagggtatgatgatgattaaatgggcttgtggaagaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaaccctggggatcctctaaagtcgncctgcnggcatcaagaatagttttcaaccgag

SEQ ID NO: 24543 - DNA, 1754 bp, Oryza sativa
  unsure (1)..(1754): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttactgaaaaagaaaaaaatacataggatgatataattactgaaaaagaaaaaatacataggatgatataacatgacctatccagcatacctagcataagtttttttttttatgttttatttgatatagagaaattatatagggattttatgttttcttgtaaattcttgctcttgcgttctaaaagagcccttatccaggtttcaagaacacgaaatcagtttaagcctcagtgctctttcagtttaaccctaaaccctaaccctaaagaacctgctgggcaaagttgaaaattcaaaggtaacttcaaatagagtacagggaaaaaaaataatagaatttgacccggaataacaatgttgcctggtacaccggtcagtttccagctcccggacttatttttaataattcttgttttgacaggaaatagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgcaaaaacaatcggagtaatggggtgtcatctgctgatttgcacgatgagaactacctcctattctcaaagcaataaaaggcagcctgaatcagaagaagaagaagaagaagaagcagagattaatcaagaggaaagaactaatggtagatagatcataatcatatatcatattcaggcatggggcagtccctgaggaagctgttcgacagcttctgcacaaaggagatgaaggtaacatcatgtcagcattctgaaatcgttcaccattctcagtttttcatcctttctgatgcttaaccaggttcagaatttttttctcttctgatggatgcttaatcaggttctgatgcttgggctggatgctgctggaagacgacgattctgtacaggctgcacattggcgaagttctgtcctccatacccacaatcggtagtgatacatcgtgttcattgtcatttatttcatcgccgaaatgggcatgacataatccattcctggacctgcattgacagacatacattctttcatcctgtgaaatgaacgaattccattaggggtcaacgtggagaagggtgagtacaaggaccgtgccttcaccgtgtgggacgtgggagggcaggacaagctccgacccctttggagacaatacttaagaaacgccgacccccttggttaaatctaatcttttgaatttctttctcaaacaaacattgctttgctttgaaaactgaaagtctaaaactcatgggtgggaggttccaattacccgggtgatct

SEQ ID NO: 24544 - DNA, 879 bp, Oryza sativa
  unsure (1)..(879): unsure at all n locations
ggtcccctccaataacgtgaaattcggttccacatttttaaaccttatagcttagagggcccattcatactcctgcggattgctcctcctcttccgcgtgtggtcgtcttgatcccgacaatctcctgatctgctccggcgaacnttcccttgatcagctccgccgtgcgctgcgccgcaagcttaaaaaggccctccccgcccataaagttggccgccatgatcaggtcgtacagcatgtcgatgcccacctccatgaactccacgtcgaacttcttcagctcctccttcgccttgcggctgctgctgctaccttcggcggcggcgatggcgtgcttggtgcagtactcgatgaccttggcgagggcgctgccggcgacgttgggaagagtgatcccggcgccgccgtcgccggtgcagccgtcctcgatcatgtggaggagtatccgcgacatgctcgccgccgcctccgtcatctcgaaggcctccccgtcggagctgatcaccttgatcatcttcttgttcttctcttctgccgccgccgccattgatgatgtcacgcgagctgatagatgtctaaattgatcgacggcgaattctgaagctgatcgatctctgagacgacccacgtttggtgattgattgccgatcaggtgccatgagctcatatatttattgcatgatgaattgaattgaatccggatctaatttgaactgttattccgaaccgattgcttccttgttaattcgaaacggaatccaactgttaagttgaattcgtttcttaaactttgcgtgcagttcagtggaggtttnnnnnnnnnnnnnnnnnnnnnnnnnnnnnnnnnnnatgagagtactatccannnnnnnccccat

SEQ ID NO: 24545 - DNA, 1062 bp, Oryza sativa
  unsure (1)..(1062): unsure at all n locations
aggccttggacctttgaaatgaattacnatgcttgctgcccgttgtcgactctgaggatcccctggtatctaacctcataatccaggtagtatgcatgctggtgcccaaagtaataggttttgttagtataattgtttattaataaaaatgccaggaaaagaaagagaaacctgattgcaatattcatacctcccaaagatcaattgcaaggagtggctgcaaaaagaaatagcctcatgagatccctgctggatatgcatacggcaaaaaaaaaccagcagacatacagtgccaggcgtatgctttgcatttcaactttagccattgcatacgaatcatgacagaagaatggcatagcaatgtagggtaagtgtttcaagttaatactcacagagtgaccccagacaagaggattgatggcattcggagactttgagatgaccagtctaccataattatcagatgggattgggcttcttgatttcacatgaggcaacttgcttgttttgtctggagagagttacagaaaaaagagttcagttcatcacaccaacatatgcaaattttgaaactggtacgatgaagctaataagtatgtcgctaagcatctgtacatcacttacaacaaagccaaacccatccagaaccaaattgagttgatgcagcatccataaattgtcgaatcatgccatcataggatccaaagtccctgttgataaatttcaaaaggcgttctgggggttttcccccgccaccaggttgcatagatcgccaatagaaatcatggttccatatctaaaagaatgtccagtaattagtcatatggaggacataccacttaatatacagaatgatacctgtgcagcatggaagaaggggggatggggtgccttcctgnccttattgaaggaggataagcatattttgcccagggacattctcttccactcactggcaacaatcattgcatttgaccttttgacgtgaatgttctgatgaacttcccaatgttgttccacacgcttcttgctgaagtatgggtctagggcactcctcaattn

SEQ ID NO: 24546 - DNA, 756 bp, Oryza sativa
  unsure (1)..(756): unsure at all n locations
atgggntnnnnnnttgattatctcatctgtatgcctgcaggncgactctagaggatcccctctctcagaacgaacgcacccttagtttactgctgccaatgcagatgatgcatgtgcaagaagtactaaactgtgatgaaggggaagaaggatcaagtaagtaatggcgtggtgacacgcgggaggggagcgtggtggatttgtagtggcgacggggggtcgaatggtcggtgcggcagaaggaccgaccgactagggaatgctgctgcatggtgccacccccttcttgccatcatcctatcacaatcacagaatctaatgacaaatacttcttcgtccccccacccccccaaaaaaaaaaaacctgggaaggggtatgaccccttctaagataaggaatctgaactactatttgtccagattccatcgaccatcgagaccaaaatattataacaagtataatactcccttcgccccaaaaaaacttaacctaggagaggacatatcataggttaagtttttttaggacagagagaatattatacccgttctaatattttggtcccaatggtcgatggaatctgatggagatggcatgtaaaatgataatgtcattaattaagttttagttattataaacctaaaaaatagattcaactaatattttaaggccacatttatacataaaagttttcataaaatatattacctccatattttaatgtatgacggcgttgctcaaattaaaactttttn

SEQ ID NO: 24547 - DNA, 905 bp, Oryza sativa
  unsure (1)..(905): unsure at all n locations
ctccctccgtttcgaaatgtttgacgccgttgactttttaagcacatgttttatcgttcgtcttattaaaaaatttaagtaattattaattcttttcctatcatttgatttattgctaaatatatttttatgtaggcatataattttacatatttcacaaaagtttttgaataagacgaacggtcaaatatgtgttaaaaagtcaacaatgtcaaatatttcaaaacggagggagtatatgtgattgttctatgggggatatataatggccatatattgatatcttggcgccaaaaacatcaagagctacatttcccatcggatacgggtagtggtgttcccacgttcgattacccggggtcacatgactccgaataatttattcaatcctaactaaaataatttattcgatcggcaccgtaaaatatcgatacgaaggcgaagaagctgtccgatctctataacctatgttaatttggtgattgattgccgatcagatgctacgtgcgcatccttttttttccatgaattcaatcgaatatcgagtctaagtacattgcaaatacaaattaggacaaggtaattaagcaatggcaatgcatgcgagtgataaattgcacaaaatcaattactaattacttctgaataataactactaactnnnnnnnnnnnnnnnnnnnnnnnnnnnnnnnnnnnnnnnnnnnnnnnnnnnnnnnnnnnnnnnnnnnnggggtacgatccatccaaannnccggcggcggcttctctttggattgtatgtgattttcatacgtacgtgtagggaagttgtcagagtgtcgacgagaaggtgggtcagtctacctctgtgatgtcatcaggggaggctcccgtggattttaccggcgtgttgccgaacttatggc

SEQ ID NO: 24548 - DNA, 706 bp, Oryza sativa
  unsure (1)..(706): unsure at all n locations
ntgagacgcctnnnnnnnnnnnnnnnnnnnnnnnnnnnnnnnnnnnnnnnnnnnnnnnnnnnnnnnnnnnnnnnnnnaatatcagtgagatctttttttttttcagaattcactaaagttattaatgacacagtttgcaaactttaaagctcaacacatcacgtgtaacattttaacttgattttctatcactatctgatctctctattacctttttgcttccaagataaggaggatctgctgactgccattgcagatattttttagtggttgcaactgctacatcatcttaagttggtgacaatgacatggggcttaaaatggtagcctgtgttgtctaatttttgtgttcttttagcatgacaagtgattccttcaatctgattcccatctatagatgataaccaatttagttatctgggagatatcataccagaatttattctgacagttttacatgaattagaatttaatctgacagacatgaactctgcttggtctgcagactgcaactacaggaatcaccggttcagccattttctgcaggacagcaaaaggccttgcattcctttggtcactgaagtactggttaacaaaaaaccaacgctgtcagcaaccggatcaacatttgtcacaaccggaatatgacaaccctatagtttcaaaaattgaaagcgggtggagcattcaactcttttttaggagg

SEQ ID NO: 24549 - DNA, 712 bp, Oryza sativa
  unsure (1)..(712): unsure at all n locations
ctttgaattgctcgtccnnnnnnnnnnnnnnnnnnnnnnnnnnnnnnnnnnnnnnnnnnnnnnnnnnnnnnnnnnnnnnnnnnnctntgtcgtcacggatgggcgcgctgctggcggcctgccgggagctggccagcctggatgagccgcgggagcacctgagtcactgccggcggatagcctgtctgctcgcgttgaggtcaccgagtcatgggagcgccttactcgtgacgtcgtcgagtgggatgggtgagagcgcactggggagacagccagactggagaggagttagggttttctttgtttctgtgtgctaggctttctttcgcggccctaaagaagaagacctgtggttctctgtgccacactctatgtgagcatataattatgctatggaagattcgcataacacaggtgcgaatgatcgcgcaaaggcactcactcgtgtggaacttgtgatcggatcgctgacatatgggtactactgacacattcgcgctaccatagcatgccatattatctcacggtgtgagttggagcccatttagacctatatgacacccaggacatggttaggctgccacaagtgcattatgagagttcatggacctaagtgacacacctctacacgtttaggggccgctcgtgcactggactctattctgaaaatgcaggacattatatccatatcaagtgtaaactatgagtggtn

SEQ ID NO: 24550 - DNA, 1082 bp, Oryza sativa
  unsure (1)..(1082): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtacggccgagcgcaaggccggtccggcagaaagtgcggcgccaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24551 - DNA, 845 bp, Oryza sativa
  unsure (1)..(845): unsure at all n locations
agctatatctagtctgatgcctgaggtcgactctagaggatcccatggttgcggttgaggattacattctttgtggttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtcttttgtgttcctgaggagcaaccagacaagattccggagtggaccgccaaacctgccctaactccctcccttcagtctttcatcgacattatcgatgacctncgagtacgcgggttgttggggtatgaagtcgctgccgactttcatcgtaggcggatccaaccgctccaggcccgagcccatatggcctttgattattcggggccaaaggacgcgacccgggtttctcctcggggtatttntcttgtatttagaattcattctttatngtgcatgtnctnctgacttatcgagtgcttgttctcgatcctacaggtttgaacagcgaaatcgtggagcgccgtgccagtcaagtgatgatcagcggtcctacaacggngaagcacaatcccgtncccattttgcaagaaagggaaggncnantgcattggctgcgaacaaaag

SEQ ID NO: 24552 - DNA, 1384 bp, Oryza sativa
  unsure (1)..(1384): unsure at all n locations
cgatgagatactcagtgtgnnnnnnnnnnnnnnnnnnnnnnnnnnnnnnctgcctagctggagagtcgaggccaaataccatatagatgtagtgtgaatggccttaggttgtattcttttcccctctttcctaactcacttttatcattttttgcgcgcgtgctcttcaaactgctaaacggggtactattttgtaaagtttttttatatgaatgttgctttaaaaaattatattaatccatttttcaatttttttaggctaatacttaattaatttcattataatcatgtgctttgtttttcgtggtcaggaggcaaccttgcctcccgaacgtagtcgagttgtttcctagagttgggcttgtcctgttagttgtagtcgtcaggcttccagtggtctgcgttttgcccggcctgccagccatggataccctcgctgagtttcttgtggtctctgagacaatgcgctctgcgtagactccagcttctaggtgcatggcagagttgcaggagatggaggtgttgtccagtcctccatctctctattcatcaacaaggtactactagcctcctaccttccagtgatcagccttctttcttacctccaaattccaatgatggactttcaacaggcaagtgaagattgaagattatgcaaaaaatgccacagcctccaaatccatgaggtctcaaaagggtttgcaactaggccttttttttttttgctggtggtcttgggttctctggtattgcatcgccatcatcatcgatctggtcggagcataggaataaatagagataattgcttttttagaattttggagcccttctttttatgtttggtgtgcaatatcaaaattgaatggtttttcggagcttctttacaaatctagctatgtacccaactagctttaataaataataatattctgaggcctttagccttaggcctgtttttctttaaaagaaaaagggataagacattctgagatctatttagtatttgaggtgggttatgatagatctcgttttgcactaaaacttgtaggtattttggcccttggcaaacttattttgttttaatctaatctattttgcaaaagatagtatttctgctctttgataatattaggagattcatgatagtggggcaatataaatttgaaccttaattttcacctgtgtaattactataaaattgtaagatttcatttgacatcaacttaaaaaacagacacaacatagtaactcctcatcagtttgttgcaaatatggtgtctctaattaatttattgttattccctctagtcaaaagaacatgttagtgtgtacccggggtaccgagctcgaattcgccgtatagacatcggatcaaaaatcccag

SEQ ID NO: 24553 - DNA, 1621 bp, Oryza sativa
  unsure (1)..(1621): unsure at all n locations
cgcttannnccnnantgtataannnnnnnnnnnnnnnnnnnnnnnnnnnnnnnnnnnnnnnnnntatagagccacacacaacatccacatcccaacgaaataccccagtgaccacagctcacactcatcttaacccattcataataagctagacactactggccggccagctagctgtggcctctgggctctctataaagaagaaagagtatgttgtgtatgagagagagagagagagagggtatgaagaggagaggtggtgatggagggagaacattagacatgaaggatgaagagacgtcgacgatgaaggagcggggcgagatggaagatctgtgctcaaggcttgtctctctcattccacaagactacttgctgctggaaaccacctcacagcaggtactgtaaattagcaaaactttttacaaatttatatcctgctggcttatatatatatatgattagactagaaaaaatgcccgtgcattgcgacggatgaaggttatttttattttattattgttatacagtttaattaagtgaacttcattgggggaattcgcttaaaatcatgagttgtaattagagtccgatcgtctcaagttagcatgcgagtttttttaagagattttttatagatcaactcttatgtatttccaaaagcaaacaaacttaataaacgactcaaatacggatatgtatttctaaaagtgaacaaacttgaaaaccgactcatacacagatgacgtaccaaagtactggcaaaaacatctttaatttttataatagtatagatgtagatatagaagaaatagtgcattggtgatacaagtcgggttagaaagccgggttaacgaataatctgatttccaaaagaaatgaaaaagaattagctgctgctgctctctctctcgtttgcacttgtttgatcattaaagagattttacatacacaaaacaaatttttactacatgcaatctatgaacgtttttattataaggttgagatcaacagaatcagttaccaaaaaagaaaaaaagattaacataatcgggtatggattctacatggtgagatattaaaaaaagaaaaactatatatggagcatttatgtagtttaacatgcgtttttcacgtcatacaagttggagaagtggggaaacattttttattaggaagggatgtggtgctaattatgtactcaccaaacaatgtcttcttagaattttgactagtatgggtcctatctgggcatatgaaaatgatataaccaaatttatcatggaaattctttcatagtacctaacttgtccagatttgtgcaagaaaattcgatggtgaaagttatgttatgttgactatagaaaataaaatattagagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24554 - DNA, 2988 bp, Oryza sativa
  unsure (1)..(2988): unsure at all n locations
ngtgnnnnnnnnnnnnnnnnnnnnnnnnnnnnnnnnnnnnnnnnnnnnnnncgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgctcgcccccgagggccggggcgccccgacccctcgcgtttctactccacgtgtatgagttaggtgagcacagcggggctcaccttaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaagatgttatttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatcttcgtccatttatggagagaagaaaagtccagtttggaaagggaggggtgcatgtggtatccccttaaaatataaaaggaggaccttggccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatttggcgcgccaggtagggggctcagcgtgtgttttctgagctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggctgccactccttcgtcgactccttcgacccggaaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttcttccctatggccctgaaggggcaagcgcggggttggctaatgaacttgccacccgcgtcggtccactcttgggaggatttgtgccagcagttcaccatgaacttccagggcacatatccgcgcaccggtgaagaagcggacttgcatgcggtacagcgaagggacgatgagtcacttcgatcgtacattcagcggttttgtcaagtccgcaataccataccatgcatccccgcacacgcggtgatctacgcattcagggggggcgtgcggcacaaccgcatgctcgaaaagatcgcctccaaagagccccagaccaccgcggagcttttccagctcgcggactgtgtggctcgcaaggaggaggcctggacctggaactcctccggttccgatgtggcagctccggtcgcccccgggtccgccgctcggtcagggcggcgggacatgaggaggaagaagaggtcgggccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacaactcctccacgacctcgcggactggcgcgcggtcaaaattntgctg

SEQ ID NO: 24555 - DNA, 877 bp, Oryza sativa
  unsure (1)..(877): unsure at all n locations
agtgatgttaacccnattgnatagacccactcgngcangcctgcaggancgactctagaggatccccgacttgtatgatcatgtatagacaaacaaccatgtaagaactggtcatgtaagagttctcgccgtgcgtattaaccaatcagaaactaagttttccaacttcacggctgggggctagggtcagagctttttcaactgaggtaggtcaagggtccaagagccttattctccgagaacgtttctccgacgacaaggctgggggcttgggagagtgtatgactcaagtgactgatcgaagtcgcgaaatgagaaaacactcacacagcacatccagagtaagaaaacttagttagatagatcccttttctatttcacgagtacttcttacaattcataattgctccaaaatatattacacgtctccttgagataatttttataggatataaagactaccaggaaggccaacgccagtccatggactggaagactttctctttaagcggtgccatcgacttcgccagattatctatctctgcgggagtcctccgagaacgtgaaaacccttcgtggaggaactcgaggtgcagctgcgggcagtgatctcggatacaggccagcacgtgccctccagcatatcggctcgatcgacgacactcctgcttcagggccctggatgatacgcttgccgatgccttcaagcttgacgcacgccccgttcaaccacgagatatacccaccnccccgactcctccgggattccaaccggggnacctcggagctgctctgcagacttccaaccatcgcttgaacacagcttctgaaggtccgagttgaaccaccacctcgcgacctctcgagagcttccccg

SEQ ID NO: 24556 - DNA, 1238 bp, Oryza sativa
  unsure (1)..(1238): unsure at all n locations
acgtgtnccnnnatgagaannnnnnnnnnnnnnnnnnnnnnnnnnnnnnnnnnnnnnnnnntttggatgtgcccagatgtgtgattttgatgatttttatggtttgtgaatttgtaagatgaatgcaattgcaacgagcaatagaatgaaatatattttgtttttttttcattggtaatctacggcattgatgggtcgcattgggctacccgttacaggtgagacacctatgatgggttgcaatgccaccagtcaatggggtcaacatcacctttgacgagtaacaatttgcaacccgccagaggtgtcctatactagtgatgagtcttcacctgttagagatgagtttagtcatcactaaacactcatctctaactagcaccctatcggttagaggtgtcgatttgtgtccatatatcattgatgacctgaaccagcatagcgaattgcgaatttttagcgagtcatgatgtgtcatgtttgcatgttaagtctagagctactgcgttttaattatatagaagataaaaatatcgctagaggcaatcgtgttcctctttaccccctatcacgaacagcacaaaaaaccttcgtgagaacccgaaccggcctcaccttccaccctaccaccctttttgaagattaaccaacctatgaaagcaaataaaaacaacttaaaacctataaaaccattattttgtattctttcagatccgttacaatgcacgggcatagcactagttcatatgtaagaaaaagataaccaatggtagttgatatcctgtatgtatcttgatgccttgcaagtaacataaaaaaaactgtcatttattactaagaataagatcaagaaggtcctctcgtagagagagtaagcacaacttctacatagcagctcagctgctcaggtgaaaaagaagaaaatgtttccactcgggagtaggcctgccactgggtaatcattacccattcccatatccatacccacattatttagataaggtatggataaaacaaagtttacccatttaaattttggatatgaggagggtattatccattttacccactttgtccatacccatttgttatgggtaaaactcggacctaaaatttttaaactcaggttcacattacaaaatcttatcaaatttgattaaaatttgaannnnnnnnnnnnnnnnnnnnnnnnnnnnnnnnnnnnnnnnnnnctatcaaagggtnctcaaaanggccat

SEQ ID NO: 24557 - DNA, 713 bp, Oryza sativa
  unsure (1)..(713): unsure at all n locations
naagaaacatattttctaatagaaataggcttaaaggtactggaattatggtatnttcaatgtttaatgcatttttaaatanctgatctttccttcttcatgaaagttttacattcggataaatttaaatgtaaaaaatttagtgtgtatccctctcatagatccgtatgtataagtcaagtgaggtaccaagtggcatataattaaggaattatcgagtactcactttgtccctaaataagtgttaatttagtcaaaaatttatccctaaaagaatttagctttagagtggtgtagtagaccactttacatcattttctttttatttgtagtcattaactaaaccaatagtgttccttcatcctccttgttttcttcccctcctcattttctcttcatattagtaataaatgtgtcagagttacggataagatataccctttacccttggatgtatgttgtataccgatacggtatacctgcgcgtatacagatgtttcctgtaatccgtcacgtaacagaaacggagtccacggatgaaaggagtcctactcggacagaactgggtcgttactatatcgtgtggggtccgatatctccgagttctacttggagatcaactgacccgcggtataaaagggannnnnnnnnnnnnnnnnnnnnnnnnnnnnnnnnnnnnnnnnnnntcactcaangnggnctcaaatngccat

SEQ ID NO: 24558 - DNA, 1912 bp, Oryza sativa
  unsure (1)..(1912): unsure at all n locations
aggnnnnnnnnnnnnnnnnnnnnnnnnnnnnnnnnnnnnnnnnnnnnnnnttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtccgagtaggactccttccatccgtggactccatttctgttacgtgacggatttccttaacgtgtacaggaaacatccatatacgcgcaggtataccgtatctagggatgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgccatccctaaccgtatcggtatacaacatacatccaagggtaaagggtataccttatccgtaaccctggcagtagcccccgacttctgcttaaatnnnnnnnnnnnnnnnnnnnnnnnnnnnnnnnnnnnngtacatctatctgcgccg

SEQ ID NO: 24559 - DNA, 738 bp, Oryza sativa
  unsure (1)..(738): unsure at all n locations
ccgcggttagttgtacnnnnnnnnnnnnnnnnnnnnnnnnnnnnnnnnnnnnncagaaacccagcggtcgcaaatcgcgcgcatcggncagggaaaaccgaccgacaataatgagcggnctcttcaagaccgctacattactcgagcagcgcgcgaatcggggcgagccggttcgtttcgcctggagacgtgatgatggcgtttttctcggttggcgagcgtagttaatgcgcgcacgatctgccccatctaaaccgccacggccgcacatttgccgtgtgcgccgcaaacggacgaatggggttagtggaggcgtgggcgcgagaaacgagagggcgaggtaatgggcgcgggaagcgaggagccgggcatagcgttggcaaggaaataaagacgccgaggaaaggattcgtttccttcctctcgccactctttcccttgccttcgccacttgcgctctaactcttcgtttcctatgccctacccttgccgcactcgctcgctctcaagctcctcctccaccggcgtcatggcacggggctccgcaccgctcgatggtagcgtgctgccgccttcccgcatcgtgagcgagaggtaagccgggctgccgcgccgattcatgccggaatctgccaccggccggaaggtggtcgcgctgggcgagggacgcccgacgccagactacccggggcggnnctttttctaacctctttaatgatgggggtgatgctgccctct

SEQ ID NO: 24560 - DNA, 1220 bp, Oryza sativa
  unsure (1)..(1220): unsure at all n locations
atgttcnnggacgcngtctccaatttagaccgcgtcgggcggcaggcgggcctctaggncggncggtgcgcgaagtacgccgccaacaaggggggtctcgcccagcgcctctcagagatggcggggcccctccgncggctccncgaggagctcgaggagacgatctagtcatcctcgagggacctcgcccggggggcggtggagctcgtactggcaagctacaaggcaagggaccctgacttctccccgtgggcagcgctgtaagagttccctcccggaacccaggatggcgcacgcgcgcaggtccggaacgccgccgaccacatcgtcccaagcttcgaaggtacggcccctcggctcgcgttcgccctcgactccgacgagaaggcggttaacggtggtgcgtacgacagcgacgacgaggctggtgacccgggcgcgtcggagtgagcccccaggcccccgccaatcttaaatagctttttctttcttcttccgaggctttcgggcccccttcttgtatagactaatttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtgggcctttgccgattcccccccggagttcaccacgccccggggcatggctcggttctgggccccttttggcgattttagccggccgaaccgggcccccgagggcaggatcgagcacgagcgtgctaatttcaagtcaaaattcttcaaaaaggaaaaaacggcacagacacagcccttaggaatttgaaactgcttttattgaaatactgaaataagagaaaatgagaatgtgcatgtgtggtagcccccggccaaccctgcacacccgaggggggggtgcggggttggcccgagcccgaaacctgacacccgaccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcn

SEQ ID NO: 24561 - DNA, 736 bp, Oryza sativa
cgtttttggtctcactactataggcgaattcgagctcggtaccctttccgtctcttagagcatgggttaggggacgcattcgcgaggatgtgagcgtggtgttgtgtgtatgcacctacttttggaggttaattaaaaaaatgtgccaattaacatctgtatagcttattagcatctgtgtaccggtgtgaatagctaagtgatcgtctcaatagctgacatgatgctctacagttttgtcaaaatcatcggtggggtaccactaacacagaagaataagatgctgaattttattctcttttatgccctaagataaagtacttcctctagtccaaaaggaattaaatccaaatgataaatctagatacagattcatttttaggatttaagtttttttttaaatagagagagtaggaaacatagaagctgacctgtccatcaattgtagtcccagagcagtgaggggtcatagcatgattgggcatgtatcgccatgggtgatcctttggtgctggctgggggaaccagacgtcaccaccatatcctgacaacacaaggatgagggtttgttctttcagagacagctaatttacataggtgcacaacactctttttctttctgacaaaattttcttcaataatttgggaaaaacaaaatatcatgcttgacagatatactgccttacttggttattcgagaaaaaaaaacagaatactgccttacttggttataagt

SEQ ID NO: 24562 - DNA, 753 bp, Oryza sativa
  unsure (1)..(753): unsure at all n locations
naactgacatcaggccagcatgaaaaacataagataaaattaattccagccggctgccaaccaaaatacacgtctacatgctgatagatgctacggaatgctcaaaaaaagtttatcgaaattgttcgtagaaactacctcttgatcacagctaatactccttcagttcaacaacataagctttgactaagaattactcttaatttcatgacataaatttgatcttatttgatttgtattcaaaagtagtctttaagtattatgtgaaggctttattgtactgaaacaaaatacatacttcttaatttttagacggagggagagtactactaaccgcagtttatcccctccttgtcatcggtgacaatgtagcgatgccccttagattcaagccagccgcgaatgccgagagcggagtcgacgcagccgacgaagttgggattcttgtcggcatactcgccacccttgtagaacacacccacgaccttcttgctgcctgctgatgtctgcggtacaaagagggaaaccaaaaggtgtcattcgtcatatcgagctgcatagaacaaatttgttgatcaagtggatttgttatatttaggggtgtaagtgggtcagttgtgaacaacttataggttaaaataagcgggttgatggcttgttttagcctataagtggatttcgcgggttagccacttannnnnnnnnnnnnnnnnnnnnnnnnnnnnnnnnnnnatacgattatacaggcgcgcg

SEQ ID NO: 24563 - DNA, 729 bp, Oryza sativa
  unsure (1)..(729): unsure at all n locations
cgcgcnctagatcgtctacnnnnnnnnnnnnnnnnnnnnnnnnnnnnnnnnnnnnttataatgttcatgcatgtagagggtcatcacacagggaacttgagcaaagaattctatgatagtgtacgggattggaaccttgctaggaaattgcttgcacttactttggacaatgcatcagccaataatgtatgtgctaaggggttagtacaaaagctcaacaagatacaacccttgatctgtgatgaggccattttccatgtgagatgtttgaatcatattttcaatcttgttgctcaagatgatttgaagcaaatttcaattaatatttcaagtaggacgaccaaccgagaggagaatccacatcctgacctgtaagatgtaacttgttagcatttataacttatgaccaaaaaatgaatcacaacattaaatattgtcactgttggtatttcttaacctcacagataaaattcgcaagcgcacggagaataccgatgtagcactttacccggaagtattccaaggtatcgatttccatagggaacgtgtgtgctcaactcctcgtcgtgttcattcaaggacacaaagcacaaggtggcaaagggttgaagagatttactagtgagaaacagtgtacgaaaaagctaagttaatcctaacgcgatacttaagcacttggcaaactgctgcttccagatgttgctctacttggtaaccgaacaaggaggt

SEQ ID NO: 24564 - DNA, 1490 bp, Oryza sativa
  unsure (1)..(1490): unsure at all n locations
agccgttgggcccacactactatgggcgaattcgagctcggtacccctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaccaataccaggattaaaatattaaaataactttcacccgttgcaacgcacgagtattttcctagttatatcaatatgcgtctgatccattacaatgtgcgggcatatatctagcaaaagtaaaaaaaaaaaaggattgtttgcaattgtgaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatcctaattatataactaagtgggggtgtaactatggtgtaaatttatataaatagggtaccgagctcgaattcgcgtgatagtcatcggatactcactngcact

SEQ ID NO: 24565 - DNA, 1059 bp, Oryza sativa
  unsure (1)..(1059): unsure at all n locations
ttattatattcttaagtatggcaaaagaaaagtattgaccttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagttggtagattcagaatttctatttcgtgaaattaatatattggttagcatggaggaaatcgttaatgatgccattggggcccttcaaggtgagctagctaagagcgctgatgaaaatggcaatgatgctgacggaaagggcagcttgcgtgtggccaaaatgaaacatgtagctngctgctacattgatggggcaatatggatnntttnctatgatgnatctctatgaagggctggaatctnccgaagatgaagatgaagcattagtgttcacgtnaaaatgaggcgaatnaacatgtgatnaaataagnttaattt

SEQ ID NO: 24566 - DNA, 741 bp, Oryza sativa
  unsure (1)..(741): unsure at all n locations
aaggcttcntacatttggtcatcttttcagaacaactattttcggccctcagtgatatggttgagtgctggatatcaggatatgttattcctgcaaatggcatcgttcaaataacttatcttaaaaaagtttgacgtgtgatctttaagtgaactaacttttgtaacaatctaaacttccttacttggaacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactagcttcaaatcagctgcttacattttggtgagcttgtgtttctatccttacggaattgccattctttaggatgggataagacgagaagtacaagccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtccacctacactcccaagggcatattcacagagatgtaaaggtaatattgaatctccannnnnnnnnnnnnnnnnnnnnnnnnnnnnnnnnnnnnnatgtaggtctacaaagggcgg

SEQ ID NO: 24567 - DNA, 994 bp, Oryza sativa
  unsure (1)..(994): unsure at all n locations
aatgatcgaatcatgtcaattatgtcataatgattctgcaagagcaatttgagcttcttgtgagatagacatccttggaattgagctacatctatttattttatgttggcatcaatgtttctcttcgtgtttcatgcataatagaatgtcatgcatgtcaagaatataaagcagtaataggtcagtacagtagaaagcgattagcaagaaaaaagtgaacccatgtccacaaagagcatctgagactcgccgaaacgaataaacattcgaaatctgtattgcgtangactaggacagtttataaggcaagtaaaaccttgcttttgtaaaaaaagaaattgttttgttgggggaaatagatcatcatgccgttgctatacaaaatgaaatttggcgcaaaaaatgatcaaagtacaaaactctcgccaggtcattactgcacttctcaaggtcaagaactttaatggcaactccaatattaagtgggatacaaaaagctttgtacgccgtagcactaacaccatctccaacttcctcacataatttatattctttgggatctgttgcaaatctccttgcatgctccatggctcaaattcaaagagcatcatgcgcaataaccacagagttacaattaccatagcacacagaagcagaaggcaatagcacgaacaccttgtagcagcgacagagaacaaccagcagcatgactaagtctataggcgaatgtacagtccaatatagttcttaattatccagtctatctttcaagcatcctttggtccaaggtgttgtattgccaaacacgatagttaagtagaaaccacaaaagctaccgaaatggctagcagcaagcgtactttggcatccagtcttaattatccagtctatctttcaagcatcctttggtccaaggtgttgtattgccaaacacgatnnnnnnnnnnnnnnnnnnnnnnnnnnnnnnnnggcagaggtatacatntcaaaccgg

SEQ ID NO: 24568 - DNA, 1142 bp, Oryza sativa
  unsure (1)..(1142): unsure at all n locations
cgcgcgaggtgngtgcacactactactatagggcgaattcgagctcggtacccaacgatcacagcctacgaagtcggagcctacaggagccaagttccgggtgatctagtcggaccaactcgactatggtattgtcgatatcatcgagttctgctattccctttgtaatatgtggtttccatcatataatcccataccaactggattagagctattacctatcaaggggcctgaaccagtataatccttgtcttctatttgcttgatgtcgtattacatagatcctcgtaccagcgtaccccaataccctctatatccggtctacgggtatccaccgtcgacaggggcgtgccaggtaggggaacttggtgctcaaggttctactactatgtcatcaagcttcgtcgacaacagcgtcaaccccggcatcaaccaaggagtttctacttcaacaatgctggtgtggactcaagtcggcgaaatcgtcttcctggtttacaccatggtgccgatctcaactggtccatcaatgaccagaagcgagaacgccgtggttacaaccctggacggctccatgtcgaaggatcctcccgcagaagtggagaacggaacatcgacgacatccgagcctgagaaggatcctaatgcggccaaatcttgtccttccgacgagaatcacgagccgacaaggacaacttccgaggcgacaaagtcctggtgtcatatccacaaaaccaggaaacacaccttacaagcttgctgggtatttctcgacgcctgcaaagagcgtggaattcaacgtacttctctaacccgcgatgtctattgtcctattcacaagacaaagaatcacgacctctcaaagctgcaggttcttctcagcgccatgaggacgtcacctcctaaggtccagcaatcacagatctctcttagagatgcggccaaggaacgaggagcgacagttatctcagatcgattcatcggggtaatcgacatcgatccccacgagccgtaagtactacaacttgctcgaagagcaggcccttattattaacgagtacaccacgtggatgtgttcgcttttgatggggaccagcccgtttgcgcgcgcttacgcagaaacataggatcaagtgggtccc

SEQ ID NO: 24569 - DNA, 732 bp, Oryza sativa
  unsure (1)..(732): unsure at all n locations
cgagtgttgtgatgtcgactnnnnnnnnnnnnnnnnnnnnnnnnnnnnnnnnnnaggaagaaaggcgtttccccagttgctcggcttggtgtggttcggttcgcccagagcaccgctggcaactcctcgatccatgaatcgccgtgcttcttgagaatattgaaggtcttggttttgaggcctttgaggatttctgcattggcgcgctccacttgaccattgcttctggggtgggcaggtgaggcgaagcagagcttgatgcccatgtcttcgcagtagtcgccgaagagttcactagtgaattgtgtgccgttatccgtaatgatacggttaggcaccccaaaccgagcagtgatgcccctaatgaatttaagcgcggagtgcttatcgatcttgatgaccggataagcctcgggccacttagtgaacttgtcgatcgcgacatacagatactcgaacccgcccggggcccgcctaaacggacccaggatatcgagcccccagacagcaaatggccacgaaagtggtatgatctgcagggcctgggccggctgatgggtttgcctggcgtggaactgacacgccctgcaccaccggaccaggtcgaccgcatcgttgagagccgtcggccaatagaaaccctggcgaaaagccttgccaaccaacgtgcgtgaggcggagtgggctccgcactcgccttcatggatatcggcgagaagctcgacgccttgt

SEQ ID NO: 24570 - DNA, 1486 bp, Oryza sativa
  unsure (1)..(1486): unsure at all n locations
gcggcttatggatgtcgtacnnnnnnnnnnnnnnnnnnnnnnnnnnnnnnnnnnncagtaaagcagtatgtatgtcaaatatgataacttgttgctcacaattattgaagaatctttttttaaaaaaataaaagaacttctctgcacctatgtaaattagctctcttaccatgattctttaatctgtgacaaactactaaatgtcctttccttccagagaactaatattggggtcctattgaaaaaaaaattattagaatgatgccgtattaatatttctatcttgatcaatatttcctttagcatgaaaacctcattcttccttctcaggatatggtggtgatgtctggttcccccaaccagcaccaaaggatcacccatggcgatacatgcctaatcatgccatgacccctcatatctctgggactacaattgatgcacaggtcagcttttatatatgttttctactttaacttaaggcattggagcataaaattctagaatctgattctgtgggtacccccacaatgctttaacaaaactgtagagcaatatgtcagctagtgagatgagtaacttagttacccagatggcagcgcatgttttgcatgatacatagtacaaaccaagggccactttattgattcatcaataattggttcttaagatcaaaatcatataaagatgtttttactccaagctagattaaatatgcacaactgctttattcagccatagggttgagattcggcgtcaatttctcactacattggcaacgggtcctgcttgtattatgtctagcatagattatatgtgggcatttggattggtcttataatctgtttcctataagtattgctgactgtgtctgtaacgaaatttcacggcaaatgaacaattgctgcagctgagatacgcagcaggagtgaaggacatgctggacaggtacttcaaaggggaagacttcccggtgcagaactacatcgtcaaggaaggtcagctcgcgagccagtaccagtaataacccccccttgtgtgttgggtgtccatcctgtggccaccttcccgcagtgaagggaaacagagattcggataggaaccaaaacaccttgtgttgttgttgttgcttgagtgttccctgagaaactattggacaccggaaataatggatgcctgccatggcaaccatggctccgaagaataaaaagccctcggattaaacagttcagttcagttcgtctatgtatgatcttttatgtgctttctgctctctgtttttgatgtgaattttctggtccagtactccagttgcacataacaattgtacttgtacctgagtacctccatgccaggggccgggggcaccctttgccttactgcctcggcagtcggctggagggctgcagtctgttatctatggaatctttggttagggggatcctctagagtcgncctgcnggcatcaagcataagatctacaatccgt

SEQ ID NO: 24571 - DNA, 763 bp, Oryza sativa
  unsure (1)..(763): unsure at all n locations
acgccatattagtgaagacacgattactatagggcgaattcgagctcggtaccccgctccgcccgcataaaactgaaccccgataagtgtgtgtttggtgtacctgtgggcaagcttctcgggttcttgatctctgcccgaggtatcgaggccaaccccgagaagatacgagctataaagcggatgcgccccccagtaaacttagggatgtgcaatgtgtcaccggttgcatggccgccctaagtcggttcatatcgaggctgggagagaaggcgctacccttatttaagctcctcaagcgctctgggccgtttacctggacggaggaagctgagcgtgccctcactcagctgaaggcatacctcagttctcctccggttttagtcgccccggagccaaatgagcccctgctgctctacttagcggcgaccccccagtagttagtgcaacgatggttgtggagcgcgatgaggacgatcctcattccgcgcaccctcaccctgtgctgacttggcccgggagcgagcatggaggagaggcccccgagccgaacggtggcctaaaggccctgacgaccggagtcagncctcttcccgctcgtcagatggtgctggtgcgcccccgacccttatgaagagccccgagggncactgcgggaagagcttgaactatcggccctcttgaacccgaggctatacttctgtacccgaattcnaaccttgggaagcgaagccaagttagaatgaaagaccccccaagccct

SEQ ID NO: 24572 - DNA, 1260 bp, Oryza sativa
  unsure (1)..(1260): unsure at all n locations
acggcttgcatgncgccnntaagtcggttcatatcgaggctggaaaagagggcgctaccccctattttggctcctcaaacgctcnggnccgttttactggacgnaaggagactgagcgggtcctcactcagtgaaaggcgtacctcagttctccccctgtcctggtcgccccggagccagatgagccgttgttactctacctggcgtcaaaccccgcaggtggtcagcccgtcgttgatcgtggagcacaacgaggacaaccctcactccacgcatccccaccttgtgtcgactcgacccgagaaagagcagggagcagaggcccccgagccgatcggtggcttaaggcccccgacggccggagctggccctccgcctgcttgtccgacggtgccaggcgcccccgacccccaggacggcctcggggccactgcgcgagggccgcgcctgtcgccctttgaccccgaggtcgtcggcacagaagccgagtgctacccgcgtgccctctcggacgaagagcgccctggagatacggcccctagcgaaggggatcggccccgccgaaaggtgcagcggcttgtttactttgttagcgaggccctccgggacgccaagacccgatacccttaggcccaaaagatgctttacgctattctgatggcttcgaggaagttgcgccactatttccaggcgcatcggggcacggtggttacgtcttaccccctcggtcaaatcttgcataaccgagagggtactggacgggtggtaaaatgggcaatcgaactctctgaattcgatctgcgctttgaaccacgccacgcgatcaagagccaggccctcgccgactttgtggcggagtggaccccagctcccgagcccgtctccggccccgaggccacctcgggcccctcgcagctgcctcacaccgtctactgggtgatgcagttcgacggctccttgtctcttcagggcgccggtgcgggggtcacgttgacctcaccgagcggagacgtcctcagatacctggtccgcctcgactttcgggcgaccaacaatatggcggagtacgagggactccttgcgggactcagggtggcagctggactggggatccgccgcctcctggtgttaggcgactcccagctggtcgttaaccagatctgtaaggagtaccggtgctctgacccgcagatggacgcttacgtgcgccaggtgcggcgtatggagcgccatttcgatgggatagagcttcggcacgtn

SEQ ID NO: 24573 - DNA, 754 bp, Oryza sativa
  unsure (1)..(754): unsure at all n locations
cgtgtgattgatanattcgtatnnnnnnnnnnnnnnnnnnnnnnnnnnnnnnnnnnnntttgtcttctgatttttcttctgactcagcgagatcccgtcgcgccccccccgccattccaagtccggccggtctgaggccgaggagacggtgaccgcggaggcccggaggcgggaagctgaccggcgagaagccacggaccgcctacgggaagccgaggaggctgcccaggaggccgtccgggtttgccaggctgaggaggccgctcgggaggaggccagacttcgccgggccggggagtccgtccgggaggcagaggcggcgcgcacgccaggcggtctgtcaagcccccgacccgactccggccgaggtgacgacgacttccgaggccacccacgacgaggccgcgggcgcgccgatcgggcccgacccctcgggcgacgcttgggacaagccagctccgggggacgcccccgagtccggcacgtcgatcagcgggccgagccgcgcggcacccacaccgaggcggctctcccctctggcttccgctgccccaccgagcgcggagcccctcctggcagccttggccgccacgaacaccacggtgttggacgggttaagtgcccaaatggaggtcctacaagcagagcgggcggaacttgacgcggcgtgggcgcgcgtcnaagaggggcggcgctcggtggaggccatggtggaggcggggccgaaggcacaccgtcggcacgccttagactn

SEQ ID NO: 24574 - DNA, 887 bp, Oryza sativa
  unsure (1)..(887): unsure at all n locations
gtggtttgtagattgcatgcnnnnnnnnnnnnnnnnnnnnnnnnnnnnnnnnnntaattgcgaattgaagctagctagctaactgcctattggttctagcttacttggttagttacgagagttaattaagtaaagtcagatgtggtcgtatgggtgcaactgtgcaagcctccatttaaaagaatgaattagtgggcgtgatattacattgtccgtatactgaattactcaattttgaatgggtgctatttagcgaccttgtttcgaattggtgtattttaatcatcgatatattagactacatacggacatatgtaaacataaactgaaatacatcaaaaaccatatcaacaatcattttatacattaattaatatgaacgacagattaacatatattttgataattacacgagagacgaccaaacatatcaaatttatgcataattacggattctaatgcgaacaagagacatttgtacatagtcaagcaatcattccatagagtcaagctgccaaggtgttaaggcgaatcgtgattcatggtttattatttctctcgtagctattagctaatttttgtgacatgatacagattacgcgtcaacgtcatcgtccaggcatccactaagctgctagtgagttctcacgtcttctagctggcaccccaaatcaacagatcctggcttcgccccttgcacgggaatggtaaaccctatctaccacgcaccatgtttgaaatctaggacgccacgtggccccacgaagtcactgccaggtgaggccaaccacccaccgcgcctgtccggctgggttgtggaaaatgtgcatgcattggggtaccgagctcgaattcgccctaagtgagtagttgcacntactgcgccg

SEQ ID NO: 24575 - DNA, 752 bp, Oryza sativa
  unsure (1)..(752): unsure at all n locations
cgcgggattgtaaattcgtatnctcnnnnnnnnnnnnnnnnnnnnnnnnnnnnnnnnaattggaatcaacatgctcaaggggaatgtgtgacttggcttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaaaggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgcttgggcatggcatggctcaaagccggccgatcgagtgatggcaatgggtggcgcgcggtggancaaccaacggcggcgcacggcacggnggaggccagcgaagggggaaggaggaaaaaagggaggggagtgctcaccgagcgacacngcggagcatgcngnccgcgcgaggaacgg

SEQ ID NO: 24576 - DNA, 800 bp, Oryza sativa
  unsure (1)..(800): unsure at all n locations
gcggcttganattgtaaaccttaatcccgcangcccgcagggcgactctagaggatcccccggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcacccagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggtttgatgtcgattctcctccactttatggttattctctgcaaaaggttagtaatcctaatactagtggaatattattattctaacttaaatatgcattgcaagtataactagttctcctctattttggtaatattggcggtcgaaacttgatcgctaacgannnnnnnnnnnnnnnnnnnnnnnnnnnnnnnnnnnnnnnnntcaaatcccgcgg

SEQ ID NO: 24577 - DNA, 719 bp, Oryza sativa
  unsure (1)..(719): unsure at all n locations
ctgcggggtgatgaacacgatgactatacgccgaattcgagctcggtacccggcgcacacgaaagaggacgagggcttagaaagacacacgcgccccctacctggcgcgccagatgacggagcgtggggctcctcaccgggagaccgcgcaggcccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtgttctggtggatctgtgtgtgaagaagttacagagagccggagagcaagagagttcaggctctagaacccctcttcccctttctctcctctacgagctcaggtattcccagagtcgtctgagagtccccctctctcagagttcccgtgggcaaggtcctccttttatatctcaaggggataccacatgcaccacttctacctactcttcttttgggtggggacccaccctatcttgaccaaaacttggctcgcgccttctgctggaaagctaatcacagcttgtccttgagtgagggccagngccgtnactcgccttcacttcgncggaagcagatgcaacgtgggagcacggttgtctgtcgatgacgtgaccgtgttagaccagtcacaaaccggcatttttgttcaccacgcgtcagttt

SEQ ID NO: 24578 - DNA, 878 bp, Oryza sativa
  unsure (1)..(878): unsure at all n locations
cgcggnattgtagatccgatttttatanggcgaattcgagctcggtaccccgcaggtctctaacagatagcacgccagctactcggcccgttgagttgccgatgacgccgccaccctggcttcctcaatctcgcggcccacgccgcgagctccagcctggaggatgcgctccatctcagcttggagctccccccaggtgagggcatcaataggcgggccccgagcgggcacaagaccgccagctggtccactcggtgtcgcctcccgatccctagttgtgaccacgacatccgtcgaggtcgccacaggagacgcgctggaggttgcgccggacccgtcttgcgtcgccttcgcccgcgccgccctgtaaaggatttccgcgatttcatgaagacaggcaagcaagacttccaaaacatctacttacttctcgccaagcgtcaccagcctttgccttcgctaggacgggggagacgcatccgaggcctaagcaagatggcacgatatgaggtcaaaatattggaacgttgctgccactcatcgtagtagcagcagcagcagcaatgtcggatgcctccttggcaacgccctgctttaacgacgctgccgcctggtggtccgcgagcggcccgatgacatccgtcagagggagagcctgcatacatgaagtcacaatgcgatcccaggaaagcagaagtaaaggagtcgtcaaatacactcacgttgatcgcagccatgcaattggctttccccttcttgcaaatggggacggggatgttgctcgccgttgtaggaccgctgatcatcacttgannnnnnnnnnnnnnnnnnnnnnnnnnnnnnnnnnnnnnnnnnnncaaaggggnctcaaanccgct

SEQ ID NO: 24579 - DNA, 3647 bp, Oryza sativa
  unsure (1)..(3647): unsure at all n locations
ccgcggttttgagnccccngtgttgtacnnnnnnnnnnnnnnnnnnnnnnnnnnnnnnnnnnnncagatcttacatggtcgcttgtctctacatgatccgcaaggccttattcgctctgggcgtacccagccgaagttcccttaggatcctcagaggccttgtcaagacggcgtaaagggacatgaggataggtttcaacgctaggtgtcgtcgtggtaagggatcgtcgggaaagaacactttgatcgtagtctgtacctgaaatcaactttattgaagtcgtaagatgtcttacaagtatggatactattgatttatacataaaatttacgtaattgatcaatgttccaggaatttgctaactcgcgaccatcgtcgtctgcaatcttgaatgcaactggccgcaagacttgcgtgatcgtgtatggtccctcccacttgngtgagagctagttacgccctgcttggctttgaacccatcggaggacgtaatcgccgatcgaaagcgtgcgtgctctgatgcgcttctcgtggtatcggcgaatggcctgttggtagcttgctgctctgacggtaactctttctcgatgctcctcgagtagattcacaatcgncgctttgctgctccctctggatcctcgcccaaggacttcctgcactcgtggcgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatgggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgtttgccgtcatcgagcgagatgcatttgagaagtaccccgtttggtgccttcttgtatagatcgttgccgatcatacagtaaatcttggcttgtcgggttattttctcggcttttgcatcatcttcgggcaactcgtcactactcaggaaattgatgagtggggtctgccagtcatatgtggtctcgatgtcggcaacggcgcgttctgcctctgtagcccccgagccgatgtcggggacgactgtgctatcttcgccgtttgtggttttgtcaggatgtccaggaaggtgccaggttcgagtggctctcgtctggatgcacgccgtgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggactngatggctgttccgggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtacctttcttgatttcatgattactgggtaaagcagcttttggatctgggggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttgaaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaacccagctgtgagtctaccaattggtctattcgaggaagagggaagtgatccttgggacacgcctttgtgaggtcggtgaagtcgacacacatccttcacttcccgttgccttgcgcaccatgactggatgggctagccactctggatggagaacctctctgatgaagccagctttgagaagcttgtcgagctcttctcgtatggcgtgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggttggcgctggagagtggaacgatcttgattgcgtcgtttggcttcggcgtcttgtttnnnnnnnnnnnnnnnnnnnnnnnnnnnnnnnnnnnnnnnnnntcacggggnattcactccccgt

SEQ ID NO: 24580 - DNA, 1669 bp, Oryza sativa
  unsure (1)..(1669): unsure at all n locations
natcgtcttgaaatgacccagtctgnnnggagtcttcctctgagaatcgaatcttctgtcgnnaccacttcatcttgggcgcagccccctgccatgtcgaacaaacttcgcgctccactttcttgtactctcgcttcgaagagtacgccatagaacctcggaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttggccaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaagaactcctttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgccagttggcggttgctctggcagtactccggtggcggcctcttcgaacgcgttactgaggttagccactaattnnnnnnnnnnnnnnnnnnnnnnnnnnnnnnnnnnnnnnnnnnnnncaacggnnnctactatnccgcg

SEQ ID NO: 24581 - DNA, 10925 bp, Oryza sativa
  unsure (1)..(10925): unsure at all n locations
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacatagcactgcaggtaccaatctcatctactcccatttatagttggagtacatatatatgttggctggatcatgagccaccggatgtgatgtgagcaattaataataataaccacggattactgatgctgcaaatgattttttttttctgctctgctgcaactatgattttcgagatacaatgaacaacacatcaggcaggcgcgcaatgagagggaactagttgaataaatttaattttgtagagagaatctatttggaatatctgttgcaggtgcatcactccggtcaaaaacatttcacctttgggatgttgttgctgtgctaactgctaaggaagatatatcatcttattatgcccaaattttacaacaccttgccttaattgttactccctccgtattttaatgtatgacgccgttgtctttttgactaacgtttgattattcgttttatttaaaatttttgggtaaatatgaaaatacttatgtcatgtttaaagaacatttgataacgaatcaagtcacaataaaataaatgatatttacacaatttttttaataagacgaatgatcaaacattgaaaaaaagtcaacagcatcatacattaaaatatggaagtagtattaaaatagcatcagccaaattgtagtacagtaagaggaaatcatcatatcattagaaggaagcaagatttttttttttgggaaatgtgattagttggcccctgttctgttttccctttttcttttcgggtgatgactggtttggttgccactttgccttgacagcttaatgttaaacaattataaccccttttctctcttaataaaatttggtcggtcaatccttcggtcgaactagcaaagaaaaaagttttcattttccagaatgaaggagcatatataataagaggacagcctcttaataaggctgtgaattccttgtctgttggtaatataaacgaaaggccgaatggagcatatacagcatttcgattattactctattacaaacgaagaagattattattgtaatctcgctcgaaatgaaaaggaaaagggaaatatactgggtagttttaccggagagaggtgtaagtaaattaaaagagtcgagagtaaccacaaacgaaatcgccgttttggaatttgtagcgtatagatttgtgcacgacgacggcggcgccgtcactgcccaccacatcaacgccggtgagaagcaagaacctgtcgttcttgcttttttcgccggcgacgcggaagaatggatgaagtgagatgttgtccttctcctcctcctcctcttccatgaacctggcgatgcagaacctaccggagccgaggtgcacggcgtaggcctccatcagaaacgatcgcttgggcggcgccgccgccggcagccggtctaggccatccaaccagcgcctgaccaccggcacatcgtaggaacagagacggcaggagcagaggtgcagccccttcaccggcgtggaggagagcccgaaccatccggcgtgctccttcacgtactcgccgcgccccatgaacggcatccgccattcgccgcgcgccctccactccccagcctgcgtgtcgaacgagaaggtcccggctccgtgcgccgtcacccacagctccgtctcgttcaccaccgcggaggcggtgatgtcgtactctcggcgatgccggtggcggtggatgtcgccgtcgtagccaaccttggcgaaaggaggcggcggaagagaccgccagtaccagcccatcctggaggacagtgagtcgtcgtcgtcggggagtaggccgtaggtgagagcctcgaagcagccggggttaccggagaagggcaccctctcgatgacgtagaggcagctatcgccggcggtggtgaaggagattggctccatcttgggcttgcacgggtcgggcatgtagcggacggcggcggaggcggcgttgtagagcagaccgcggccgtcgacgtcgagggcgagaaggctgtcgtcgccggagaggcgcaagaaatcgacgttgccagggccgacggacaatgaggaggggtggaaggtgatggccggaggaggcaggccgccggcggcgtcctccacgtcatccggatcgagtacgttggctgcttgccgacgtggtggagatgaaaagagggccgatgcagcgacacggtacagcttgtacgccgtcgcgccgccgccgccggcgttgtccaccaccaaattcacaaaccgccgcatctgcttctacaatggtttttttttgtttgtttttttcctttacacaacaagaattcaggggaaaatacgataaaacacaaccgactgaacgaggaaaaaccacgggcccatcaaagcccaaagtatttttccgcaggcaattatttcatctatatattttcctctacaatgaattatttcaccgttccgttttcaaacgtatattgttagtatatcataggaagtggaattttgtccctcgagggaatattttctcgttttctacatgtcgttcaaaaaaaattataaaaaacatatcaggatatatcaatatatgatatatcaatgtatgatatatcttttcgcaacctgcgattttaaatttgacttatacaattcgaaacaaaaattcacaaatttgttatttttgtttctacttgtataagttgaatttgtatttgtatgtctgtgaagtgacatattacatattgatttatcttactattttttttcatattttttgatgactttttaagtgacatgcgaaaataaggggatatccccttgggtgatgaattgagtttttcatggttattgtttttttgaatgatagtacaaacataagatggatacacatatgcacactctttctttataagcaccatcaaagactcaactggtatatcttgagattcacgaaatcaccgcgtacgtctcgctgcggttgactcatatgacgattcaccattcattttacaaaacaaaaaacatgcatgtgtcattcatattattacaacttatgtgtaccctataatttaaacatgatttatgtttttttatatttaccctaaatatttaaataagacaatgatgaaatattatttcaaaaatcaacagtattacacatatttaaacataaagtacgtatcataaaactacacatgcttttacaaccatcacaaaactatcgattggcatgttattcttcatgcatgattcatccatggaagcacgattagtagagggaggagggccttgggaggacgcgagcacggagcgggtgcttcatgacggtggtgaaatccagcttctccgccatgtccgccgcctcccccttcgtctccggcagccactccagctccctcaccaggctccccaccaggtactccgcgtgcagcgtccccaccgtgtacccggggcacatccgccgccccacgccgaacggcatcatcgttatctccctgctccccgtcacgtccaccttcacctcgccgccgtccatgaacctctccggcatgaactccctcgccgccgtccacaccacctcgtcccgccccaactccgccacccacacgttcagctccgcgcccctgggcaccacgtagccgccgacctccgcgtcgctctgcacgccgtgcggcagcaggaactgcgccggcgggtgcagccggaggccctccagcaccacgggcttgaggtacggcatcgcctgcaggtctgcctcggttagctccgggcggcgtttcccctcgtcgtgaccttggcctgaatgtcggggcggttcacaagctcggccatgatccactccaccaacgtcaccgtcgtgtcggtgccggcgttaagaaactcgaagcagagcgcgatgatctcgtcgtccgtcacggcccggtcgccttcctcgcccacgcgcagctgaagaagggagtccgtgtaccagggtgggtcgtccccgttcccgtctccggcgcgcctggcgttgatcaccgggacgtatatctcgcccaccctccggcgaacggccacgtgagcggcccactggttcgggaagaccctcttggtgatcgccggaaagaagaagaagacgggaaacctggtgaaggcgcggagcatccatagctccagccgctcgacctctcggagcgcctccggggcaagcctggcgccagggctcatgtacaggagcagttcgaccatggcgcgcccggagcaacggctcaagctcgacgggccggaacccgtcgcccccgcggtcgcgaaggccccggacaagcacgtcgcgcgcgccccccctcgccggcgcgaagagcgcgacgcgggccgggctgagcgcctcggaggcgaggttgcggcggacgaggcgccagtaggggccgtacggggaggagttgatgtcgcgggtgtcggaggtgaaaaggcggccgagctccgggaacggcgggcggtcggcgaaggtggaaccgccctggacgagtgcgcggtgggcgagccggcggtcgcgacgaagacgagggtggtgccgaagaggcggatggagatgacggggccgtggcgcgcgtgcaggtcgcggaggagcgggccgaggtcgaagatggagcggcggaggcggaggaacttggcgaggaagagcagcggcgacggcccgggagggaggcgcgccttgatgctgctagagcggcggcggcgagcggtggcgagcaagacggcgacgagcgagatggagaagaggaggaagagccaggtctcctccattgttggcttggcgttgctgctggtacccttgcttagcttaatttcctccaagactaagtactaactctcctcatattctaactttaccttgtggatattattttggaatagcagtactagtaaaaagtccgtaatgacttttatttatacttgaggcaataatataatattattccatctagtcttatccatcatgtgtttttgtcaaggtttttttttttcctttcttacgtacgcaaagcaaacaaaacaagagtgcgcgttgagcttttttattctctggcttagctttggtggtttcgataagtctctacgttgactattcacacagttagttagcccatgacctcttcacctttgtttggttgttaatggaattgccacgttcgatcttatttttaaaaatccagttatatactatatcctccataccctacgcaaacaacaatagttgagtttgacatccataccctacacaaacaacaattagttaagagtgacagttttgtatgtatgcatgcagtcgagaatccaaaaggtccatgtgagcaacagggtagggattgacggtgtactgtacactgcacagcacgtcctactcctagtacatcacttcttgttttcagaacaaagccaaaccccgtgcaagcagttgcgcaacaataattatattaagcattggcttgagccatctatattgacatatgagatacaacaaataatacgaccaagcatgatcaaatgatgtagatagaatcaggacatgaatgacttgattagatgaaacaggaagacaaaaacacaacatgaaggatgatcacaagaagcacatgcagccataggctaataaagatccccaagcctgagcacacgtagcagcacaggtgcgcatcagttacaatgagaaaatgaacaagatagaagcaagtaacaaaaaaatacaagtgtggataggatattaattagttagtgtttaaagttgatatcttctaggaattgctacgagcgtacaagcaaccacccagtttcatacacaacttgggggctgggcaaagctatcatcctctttcctgccttgggatcaatcccctccagcatccatgacatcgacggtgaactcgtactcctgatcccggcccagataataatcggacatcaggtagatcatgtactcctttctcccagcttctgaagcagcggtgaactcaagcttcactcgagccctcttctgaagtgcaaccctgattggtagagctatcaccaattaccagccaccagccttcttccttgggctttgggtacctgggggcatgaactggccccacctcggaaggcaagttcgtcatgtcacgctccagggtcacctgtacagttacattgtcaccagccctgatatcatccaccctcgccaacttcgtaagccatgtcgacattggggaaacgcttgaagaattcaatgatatcctgtagctgagggtttgatagctgcaacagatcccgcatctcatcgatgctcatctcagccagatcgaagatgctctcaatgggcctcccttcattctcctggcatctccgcgccaactccttggtgaaatgtggaagctgtaaaagaacagaatcacgatcccatatgccttgtgtcaccatttgactcagctccattgcattaagagcaagcgtaagccatccattgctggagataacatcaaccattgcctggagcaatctatgagcagaaaggagtatctcccgctggtcggctgccaagatagtgcgccttgaaaaatgagcttgcagcagcgcgttggccttgacatgtggatcactgtcacgcccagaaattcactagtaatttctgaactaatttgtgcaaaaaatcctcgtccaggaatcagccgaggtacacaaactgataatttaatatacaaatccatcataataataacgttacatacttacaaaagaaaaaaaaaacaacagcggaataacgatctagcgaagctccggctccactcccacaggcagctcaactggggtataagccaaacgtcttctccttctggatcatttttcttcaacttaggttgattgattattgcaaggtgagcatatgacatactcaacaagccacacagcaaatatgcaagtgcacaaggataccaaaggatggcataatataggctcatttgcaaaagcagcatttagcaaacatttagaagtaaaacagtagagtaattattcatcaattttaatcaacactgaacagcacacccatgctgctcaggcccgaccatcctaaacaaccatacccggctgtacagatctaactccaaaccaggagctaagcaaattattaccagttatagcaccaataattattgtgagaggtgtgagactaatcacaagaaacattgctcaacccgcccatgaccgcgggcacggctattcgaatagttttactctggccagaggtgtaccactgtacccacaagacaaagcctcaacatcatgtctaccatgcgtcgcgatactggaaagtacccgaatagaggctgtgacaatatcctctgcacaacacaactcaccacagtgcaccgttcctggatcataatcacccccttataaaacaaggcatggactccccagcgacccccacgaacttctcgccgcttctcagtctggcaccccgtgatgaaccatgctatacaaaaggtaaagccgttgcccacgctggcttatggttggcatggttaatgtctcacaacagtagctcacgaaccggtccttaattgtcatgagcacgaccatcaaaaccatgtgctcacaacccaccattaatcaaattttagttggcaagtaattaattaaccaatcacgattgaccatcatgggtaccattaaatataatcataagtgatagtgtaacattagttatcccaatcatgtgctaatgtttctaagcatggctaagcaattatgtccaacatctagctgaaccaaaccaatatataaggtttaagctaatcaatttattaccataggaaaataaagtcatcttcggccataattaaatgagaaagactcaccacccaatgacattcgaaaataatgcatattttaaaataaaacaatagctttaaatgggttcaacatgctcaaagggtcatttgggatttgtgtgacttgccttacaataatcggtcttcaattagtcttcttgaacacttccgacgcactcgcgaaccttcgcaacgatgaaaacgacgagctaacacgcaaaacgagaaaaaaaaactaataaaaaccaaataaacagtacatataaagtaaacaaacatgtagatcatgattttagatgaatttagagacttgaaccacttaattccgacttcatatgaattagttatgaattttacaagattaattaaactgattttagccttatacagcaaagaattcacgatttattaaatagataatgacatcatcgatgacatcacagccgaccatgcactggtccgcgaggtcgccggtgttaggaggctcagccgggctatccgagagcaccaacgcggagaggacgacgagacgaactcaccggtggtgacggtgacgagaatcgatgacggaaaacggccggcgaccgtaggtgacgatgggagcaacggaggtgtggacgggcttcgtcttggcgctgtgatgccgaggaaggcaacggcgaagcttggcgttgacggaaacaacggtggtgttcggccggaggcggagtagatcggattcaaagtgacgaagggcttccggcgagtttcggcgcaaggtaaccagcggccgggatggagatcagcctttcggagccgagggaagtggcagcgcagaagggcgtcggctggaacggctgccggtggcggagacagaaggcgaccgcgggtagggcgctacaggcaacagcgatggctgggacttgaggcaaacgaaagaggagaggaaggggactctatttatagccacgggagagagagatcgggcttggaacgcaaggaatcacgccgggaaaacctagggtttggcggagagataaactcgaaaacgaatccaaattcgcgtcgtattcaaggggataaaatcggattttagaggcaagtgcaacgcctgctgcaagcagctcggcttcctggcggcaagtgcaacctcctccgcggcatgctctgcctctgctgccacgaggacgacgaccagccgccgccctcctcctccactcacctccccgtcgccgccatcgatcacgatcacgctgccgacatgccatgatcatctcgtccatctatatatattgcattattactcatttgctcgcgtccatgagccaccggatgtgatgtgagcaattaataataataatcatggattactgatgctttttttctgctctgctgcaaatgattttttttttctgctctgctgcaaatatgatttttgagatacaatgaacaacacatcaggcaggcgtgcaatgagatggaactagttgaataatttaattttgcagagagaatctatttggaatatatgttgcagttgcatcactccggtcaaaaacatttcacctttgggatgttgttgctgtgctaactgctaaggaagatatatcatcttattatgcccaaattttacaacactctgctttcttaattgtcaaaatagctgcagtcaaattgtagtactgtaagtggaattcatcatatgatcattagaaggaagcaggaattttttttttggcaatgtgattagttggcctctgttctgttttcactttttcttttcggctgatgactggtttggttgtcactttgccttgacagcttaatgtcgatcttgtaaacaattataaccccttttctctcttaataaaatttggtcggtcaatccttcggtctaacttgcaaaaaaaaagtttctttttccagagtcaagaatgagcatgtataataagactataagaggacagcctcttaatataaacgaatggagtacccaaaaagtaccattcatatacagcattattactattattgcaatcgaaaggaaaagggatatatatataaaaatgatatattcactccgtcacaaaacaaaatatagctagttttaccggagagaggtataataagtaaattagatgaaattaaaagagtcgagagtaaccacgaacgaaatcgccgttttggaatgggtagcgtatagacttgtgcacgaggacggcgtcgtcacaggccaccacatcaacgccggtgagcagcaagaacctgtcgttcttcttcttgttgttgttgacgccggcgacgtggaagaatggatgaactgagatgttgtccttctcctcctcaacttcctcctcctcctcctcttccatgaacctggcgatgcagaacctaccggagccgaggtgcacggcgtaggcttccatcagaaaggattgcttgggcggcgccgccgccggcagacggtctaggccatccaaccagcgcctgaccaccggcacatcgtaggaacagcagagatgggagagatcgcaggaacagaggtgcagcccctgcagcggcgtggaggagagcccaaaccatttgccgtgctcctccacatactcgccccgccccttgaacggcatccgccattcgccgcgccccctccactccccaacctgcgtgtcgaaagaaaaggtcccagctccgtgcgccgtcacccacagctccgtctcgttcacccccgcggaggcggtgatgtcgtactcttcgcgcttgcggtggccccggaagttgccttcttaccaaccttggccaaaagaggcggcggaagagaccggcagtcccacccattcttgtcaagtcttggggatttggcccttagtgagaacctttaacatcccgggtttccggaaat

SEQ ID NO: 24582 - DNA, 4985 bp, Oryza sativa
  unsure (1)..(4985): unsure at all n locations
cccctccactccccaacttgngtgtgaaagaaaggtcccagctcgtgcgccgtcacccacagctccgtctcgttcaccacgcgnagcgngtgatgtcgtactctcggcgctgncggtgcgccgnaagtcgccgtcgtagccaccctgncgaaagnagcgnncggaagagacgcccagtaccagcccatcctgtnccagtcgtgggggagtaggccgtaggtgagagcctcgaagcagccggggttaccggagaagggcaccctctcgatgacgtagagaacgctatcgccgccggtgaagaagatgggctccatcttgggcttgcacgggtcgggcatgtaacggacggcggcgaagccggcactatagagcagaccgcggccgtcgacgtcgagggcgagaaggctgtcgtcgccgggaaggtgcaagaaatcgacgttcccagggccggacaatgaggaggggtggaaggtgatggccggaggaggcaggccgccggcgtcgtccacgtcatctggatctagttctttggctgctgcttgacgacgtgctggagatgaaaagagggccgatgcagcgacgcggtacagcttgcacgccgtcgcgtcggcgccgacgccggcggtgtccaccaccaaattcacaaaccgccgcatcatcgtctctattgatattcttctattcaaaatttttcttttctatattttttttttcttttgacaaagagtatcttcgatctggaagaaatcacgcaccttctggagtatgcagtctcgctcgtcctcacgcgataggcggaccgccgaatctcctctcctcggtggcgcgtgatctcgacggcggggcgggatctcggggacggcgggcgagatctctctagcgggcggcacgggagctcggagctcggggagaagcttttctttcttttcttccttttttttgttgggcaatttacagatatatacggccatacgggacagttatctcatcggagcaaatcgagatgttgtactgtggggcccatcgcccgccgaattactttagactgaatttttgccgtataaactgcgagacaatttattaagtctaattaatcattattagcaatgtttactgtagcacaacattatcaaatcataaagcaattagatttaaaagattcatcttgtaaattagtcgcaatctatgcaattaattatttttgtagcctacatttaatactttatgcaggtgttcaaacgttcgatgtgatagggtgaaaaattttagggtggatctaaacaaggccgtggcaaaatgtggcatgcatagagaactgttaatgctaaaatttggtttgaatatttaagtaaatttcgttaacgaaatatgacaagatttatacaacagagatcgagtttgaaaaggagttacgaagaccacgacatggcagataagttttgtatttatgaatgtttttttcttttatctttacaaatgtttgtgtcatgtctaaatagaactcttatcggtttgtgtgtataaatatgtatacccagggtccctataatttatctcatagcagggtccctataatttatctcatagataattacaattactctcggcgcattgccatcattcttcccgaggtttttatttatcaccgacaaaacttgacacttgacgcgaggttgcatcgactttgataagttgcatctcacttttttgagagccgcgtaatgggatgctccgtttgttgttggattgaaggaatgataatactccatttcttttatattttaagtcgtttgatttttttcttagtcaaaccgaaaaaagtttgaccgagtttgtagaaaaatatggtaacatttacaatacaatacaaaacaaacatattattaaaatatactcaatgttaaatttaatgaaactaatttagtgttatagatgttgctattttttttacttaaatttgagcaaacctaaagaactttgattagaaaaaaaagtcaaacaatttataatataaaacagatggagtaacaaattgtattattgatggtttgaaattcgaggatattattgatgtttacagaaactgtacaatactcgtatacagtgttgtggaaaacggtatacgggtatcagacaaagggtaccgccaaatgattaatcggaatttggcggaaatataacgttttaaaaatatatgtacattctccctccgtccaaaaatataaacatttttagctatcatagccaaaagttattatattttaggatggaggtagtagttgataatagttttccctttttgataaacaaatgcatataactaaatatattccttctatatatatccttaaatagaataaccatatatgacatttaaataaattcataatggatagctgttactgtatatctcaattctcacgtagtgatgggttttgttcataatgcatgaaatgaattatcaagagaatgttacatagcataaatgaccgtaatcaaagtcccaaataacatgtgtatcggttacctcgaagagcttcatcaaatacaaactccaataacgtgatcatcatcaaaatcaaggaactcgtgttcaaactttagaggaaatcagttccttgtcattttacatcttgctgccttatgagaattccggaagagcaaactcatcaaaatcaaggaactcatgttcaaaacctttagaggaagtcagttccttgtcattttacatcttgctgccttgtgagaatttcagaagagcaaacttctagtcaatagtagtaaacggcacggattcggatcagatgcagtcactactgtgactgcaactttagcagtacccatcatccaaccatccagcacacaagggatggtctagattggttgctcaatttcccccaacttttcacctactctctgactccagcagatgtgttttggagggaaaagtctgagagggaggtgagaattggcgccaattctaccatgggaagcatactttaccccctactgctgcacatcacacgcttctttttctcttctctgttcagccatgaccgttgagaaggccatggagcaaaacctggagaggtacagatcgcgataggatcctttgtcttctgatttttgtcttctttcttcctgttttgttcatgcatcaaactttttattcctctatactgtaatgtaacagatctactaaacctccctgttggatgcctcaaattggtatgacatttaattcctatgaagaagcttgggatttttgggtcaaatatggtggtcgtattggctttgatgttcgaaagaattacactaacaaaagtgatcttgatcagttagtaacatccagtaggtttgtttgttcaaatcagggttctagagcagaagaaaagaaatatgctgtagcaaaacgtaatcgaactcatactcgaactggttgccaagttcgcatgggcatcactttactcagggaaacaatgacatacaaggttcatgacttagctgtagaacacagccatcttcttcaaactccacaaacaagccgtttgatgccatcacaaaggaacatttctaaacaccaagcagtcgaaattgaggtggcgtatgattctggtattacacctaaagcagcacatgagtttcttggtcggcatgttggtgggtcagctaatcttggttacacacagcgtgatcataagaattatttgcgttctaggcgccaaagggacttactttatggtgaggcaggaagtttactaaagtacttccaagataaaattgtggaaaatccctcatttcactatgcagtgcaattggattgcgaagaacaaatagctaatatattttgggcagatgctaggatgattgctgattatgctcactttggtgatgtcatcaccttcgacactacattcgggacaaataaagaaagtagaccttttggtatgtttgttggcttcaaccattttagagagacagtggtttttggtgcagctttgatgtatgatgagacatttgaatcattcaagtggatgttcaatacatttttatcagcccataatcaaaagcaacctcaaaccatttttacagaccaagacattgcaatgggaaaggctgtgtctgaagtattcactggtgcatggcatggtttatgtacttggcacatatcacaaaatgcagtaaagcatttgagtcctcaacaaacagaaggttcaagtatcctagcagatttcagtgcatgtatgtatgagtatgaggaaaaagaagaatttgaagaagtatttgatgccatgagacaaaaggtgcgtaaagtgacttggttggatagcatatacaatttaaaagaaaagtgggctgagtgctacatgtcagatgttttcacaatagggatgcgaagcacacaattaagtgaaagtttgaatagtaacttgaaaggtcattagaaatcagatcttgacatcggcaggttccttaatcgtgtagagcgtgttgttgaagaaaagagagagaaggaattgcaatctgaatatgaatcaagaaagaatttgccaagaattatgatgatgacacctattttggtacaggcaagtaagctttacacacctgctttatttgaagtcttccaagccgaatatgagaaatccatggctgttccgccatgggggatgaatgggagacttggatagctgcaggtcttgttagccccatgtgtcactctgtagcaactcattctgtgagattttagctttcattttatgtctgaaatggtggtgcattgacgcaccgggctaccttgtacattcccttttttactcttaatatacatcgggcggctattcgccggcccggcgaaaaaacagaaatccatgggtgcctatacgaaaagatcaaatgaaaggaatgatttcataattgaaattgggtcacttgatgatcagttcatacttgaagatgagaacaagttgaatgcccaaccttttgat

SEQ ID NO: 24583 - DNA, 8828 bp, Oryza sativa
  unsure (1)..(8828): unsure at all n locations
cgctagtaacgacgtgtagtttcgatanttaacgaatgatgcgtttccataggccntacctacnntttttacgttaggatnngtncgannntttctanntaaaannncnnnccnccccccacagtgnatttgaaataccatttgtttatacccccttttgataaccncctgctaanngcccgcggtcgactctagaggatcccctatgctgaccagtttcttcaaagataaatatatgtgctaacaaattattttaatttggatattatttttttttccctagggttctattgacgttgaagatgtcatcttatctcaaaagttcatttgaagaggtcaatagaacttagaaggcatcgtgctgatttgggaagcagatgatgatctacttttggatcatgaaagcttttgttactgggttaatctagcagtagcatggctagttgattttgaaagcttttgtctcagtggatgcatgacacccaatttcagcgaaaatagttaaactctagctcattttgccaattatgcgtgcaagatattatgaagttcaatataatgaaatgaagtctgtgtctacttttctttaacaatatttgggttttctgaaagttcaagaaaattcagatcaaaaggagagaaattgcaggcaaaatctgaactgaagctgttctgtgcttgttcaaatagctaaaatgatgcatgacacagttaaatctggaccatccctcatgtgctggatggttggatgattaggtactgccaaagttgcagtcactactgtgactgcacttgatccgaatccaaagggcacagctaatgagctggattgtggaatcgacctttgtcatcacgccgattatacgtctgattagacggagacggacgatttaatcggtaatgatcggatttatgggttcgttaccgactaataatgaccggatcggcgtgacgtgatggactgatctccgtatccgtattatcggacgtattaacggccgttaacaccgttttccacaacactgctcgtatatatgtcggtcgttttatattttcatatgattaaaatctctttgcggactatttttgtgatgatgggaaccatcatatatgcatacattaggcctaattggactggcccatctgcatttccccacggcgaaaataatggtggttttaaattggcaatgaataaccagtcattactagtaatatgtcagtgctaaacgctacactgtatttctatttgtctttaataaagtttaaaatttcatgttggcaaaattttttttttgtgttagcataagacatgaatataacctcaataaaatttcatgttaacaaaaaaatattttttgtgttagcataagacttgaatataagctcaataaaatttcatgttaacaaaaaaaatattttttgtgttagcataagatcgtgaatataaactcaaataacagtttgatatgatacatatatcaaattaatagttttaccatgtaaaacaagataacaattgttggtcatctcgttaacgtcttcttttaagatctacatggaacgacaacgaaaatttgccgatgctaaagtacaaatttaaagaaatacaagtgttaacatatagtcatattatcagcccggtgcaaactgacacatctagaacgcaatagtatggagaagataattacacattattccaattaaattgtgatgatgtgctgtataaaacaagaggacgttggtatcatttatttattttttttgcaacttggaagtataaagcataaacatgtatgtgagcaatcagatcacacctcaccaaagccgctacctgttgttagaaaccatagtacatatacagaaaactagcatggtggcccgcgcagattgcgcggctagcattattatatatttttatattatttatttttatttctgaatttttatattatattttatatacgtgttagttattaattatttttaatatcaaattttagttatttgtaaattatatatattcttatatggactctagactcgtcttttaatatttcttttaatatcaaattttagttattctattttttttcttaattgtatttctatatggactctatactctatttctaatattccttatttttaactccaaatttctttcatttcctaattgtatttctatatgaactatatattctacttctaatattccttatttttaattctgaatttcagttatttcctaattgtatttctatatagactctagtctcctcttctaatattccttatattttaattccgaatttcagttatttcctaattgtatttctatatggactctagtctcctcttctaatattccttatattttatttccgaatttcagttatttcctaattgtatttctatatggactcgtttattccaaattttagttagttttaaattcctatatggactctatactctacttctaataatccttattttttaattccgaatttgtattttttttcttaattgtatttctatatggactctatactctatttctaatattccttatttttaactccaaatttctttcatttcctaattgtatttctatatgaactatatactctacttctaatattccttatttttaattccgaatttcagttatttcctaattgtatttctatatagactctagtctcctcttctaatattccttatattttaattccgaatttcagttattttctaattgtatttctatatggactctagtctcctcttctaatattccttatattttaattccgaatttcagttatttcctaattgtatttctatatggactctagtctcctcttctatttttaaattgtatttctatatggactctgctttttctttttcttctttttctccgattaatgtgagaatttctaggccatgagagcgaacgtggaggctccttttttctattcatttaattatatattatataatagatagatagatagtactgattggcaaagattaacttcagcaccataggtttcaatagaggcttactttatatttatatcaattggtagagcaaagtccgatttggcaagatatcatctactgtttgattccttcaacaacttgacatgtaaaattcctaattgcaattaaatatgtcgcacatgtattgtataatatatacattgacaccacattaattatgagatgcccttatttgaccagtgaatcgtagtaagagtaaaaacttattttgtcgaaggaataacaatattggaaaatacaaggtgcaaaagattaattaatagttgaggaatcaaggacgcaagagagtaattggataatttaccggtaaatcttagtatgtagtaaacaatctcataattttttttccagattcagccaatctggtagaggagcaatttgagaaataaccaggacaatacataccacattggttaataaaatccaaaatggagtctgtctggcaatggaaaacaagcagacatgcttacaacactttcattttcataattagaaacttataaggaatcatgacaacttatgataatctaaaaacagtttgtgaaatagcatatgttgtgcactatacagtactaaatagtacactttattttcatggaaggtgataatatctgcaccttatgtttccaggccatgtgaaaataaaggatgggtttctgtgcgactaatcaatcctgaggtaattcctttttttctcaaataattgtgcaaattgttcaaatatacaacaattaagggctagacaaataattagtctgatctgatgccagatcgccaggtgaaaaacaaaaggcctagaaaaagtgatcaaccctacaacaattcagaggcttaaaatggtttcccaagactacaaaattaaaatacaacataagccaaattcagaaaatatggtcagaaactcatatcacacacttcatggagttctaaagtgaggataagattgtctcaaagtgctactgagcaagttatcattgttttgttttgttcctttattctttcaccatataaaaaggaatcatggtgagataaattctgccattgtacttgtacctctacaaaacagatcttggcagctgagcaattgtacctctaagtttatctctgaaatcagacttcaacaaacatactaaacacacacccatcaagtttcagaaaagctaagctgctaaagtcatgtttgctgaagtaatgtgtgtatattatagtttatttttgttgaaagagcaattcagaaatctgcatattcaccaatatggttttaaaacagcaagatccaaatgctcctcttaagtttgaacatactcgcattccaaacagcgaatgcgcattgaaaagagccatagcggcacataatttataacaaaatatactgaattatcttaagtcttaagcaatgttgactgaatttaaaacttgttacaaagaaatccttgaaggttaatagaacagatattaaacaggtactcacattagagtccagttcttcagtaatttatctccaaggtctgagactcactgcacttcaaaaattagttgcagcccaaacacactctgcagtaatgctgagacagttagcatttttcctggcttgacaaaagattaagcctgctatttgaattagggaagcatatgcagataattaataagttattttctcacacatgcagataataactttttttttctcataggtggcataatactacttaccagcttattcagaaaataagcagagaaacatatagtgtgaatgatcgcattgagcaaagctcgagtgaacatatctgcccagtaggatttaggaactgtaaagggcacggatcctatgtacaataaaatttaacctttttaccgcaagaaatatgccaagacatatgtcgttcatagctaccaaaggtcaattttggtaccacggaaaaacaaaaggctagttctgcatcattaattaaccaatcgtatcgatcacacaaggaaaacaggggaataaaatagtagaacccacaagtcagaaaaagcccgacgtcgacgggaaacagcaaggggtcccaagaagagaagcggctggttgcccaacaccgatttttgaatgggtagcttgtgctcctgccagatgacgacattagtgtgcaaatcaatcatgattaaaataaaaatgattatattcaaaattcactaagaacaacccagaaatgatatcgccaaattcagaaatattcagaggaacgctcgctctggcatttttcattcagccttttaatgatgatagaagaaacatggtttatagtgctgtttcacaatgaatatctgctcaatcaagaggaagcatttctcattagttttagtacacatcatgtttggagaggcgatatacgtttttagatgctgaacttcaactgaaataatgcatcgaggggttagaactgcattgagtatattatttttattttttacctatgctgcaatctaaacaggcaccccattctaaataatctgaaaactcgacaatctaaacaggtttcccattatgaaaattataaaaacttgaaattgcttgtaccttcaattcagggaaggaggttttgcgagcgcaaaacacctgttcatagtatatgggaatcagaaatgctagtcaccggtataccgtttggagtcagcnccgnacgggacatnttcccacggatcaaacacacaccctcacggatcagatacacacactcgagaaacattgagggcctatttggattgctaccatgccaattttttagtagtgccaaatcttannnnnnnnnnnnnnnnnnnnnttttttggtaggataagattatatttggtttggtaccaatataaagccaacatgtgacttctagtgaagattgttctagattgatggcaaatctagcatgggcattaccaataaattggtctcaatccaaacaagcacatgtactatttaaactaccaaaatattggtaaggctaagttttggtagcaatccaaaacgggcctgagtcactcccaaacagacacctccagctcccaaatcgtcacgagcatggctccgcgggcgaaaccggcggcggtgccgaagtcgccggcggccgaagccggcggcggagcctgcttgcggctcctcctcttcagcggcgccgatgcgcacaaggtcagtagtgccaaaaaggaaaagtggcgtaagcgtggtggtggcgnctgtggcggcggcgtctacggcgaagccggtggcgtctgcggcggagccggtggctgctgctgcggcagagccggtgcgcacgatacccctttctctcattcctcttttttcatcgatttcctgattttgatttaacatctcttcatttttgcattttctagggtttgttgaatcactaatttgtggatggggctcatcatatcacatccaaattgaaatcaaagtaagttaatactctctctcttttttctgtgtgtttttgttcattcactgggggtgtttgtagcagaggtgagggatgtgtgtatgtgctgaatcatatgatacttgcagcaaaatgttcgaattggaatagatcgcttgaaatgcttctagctgtatattgatgggaaggcaaatattgcttggagcaagcaattttgccgttaacaagtacacactgttttgaaacagagaaatctccattcaactagtaggatttttttttgggtgaactgaagtgtaaacaaaatcagagaaatccgcatcagtcggttgttggcttctagttccgggcacgctttgcttgtcaattgttatcctctttgtcatagagggcagtgcgtggcgacagagatggcagatgcagctgagtcatagatgcagatgatttggatttttttttctgttgatgttttgcatatcttagtggctacatgggtgttttctgttttaaaatgattagatacttttgttcaatcgaggatgaatcaccattgaaatgatattttctttatccgttcacacatgtgcacagagttgaaatggcgttgccacctgcttcaagcgaatccgatttcatgcatgtttcaaagaagacaaggtgctctccaaggttgaacaacggctcagcttcaccccactttgacaaatctaacactgctcattcttgtcatctatgcaggactacatgaaagaatatcgtagtgagctatgcaaaaggttgttgtaccatcgctttaacgacttacatccaaaacgtcgtttctaagcttcagaaccaatatgctcattcggttcaagcagtgtcggatgtgtgcttaggccatttttgtagctccctccctccctctcccccaaccaacatatgtaacaagtcaagtttcagaattgtgtatgtggctactgtttttgtcttgaactggaaggttgcaaggggcacaacaatcaaagacatgaactctgtatgtggctactgttttcatgtacatatatgttggtaaagaagtggattatattgcgtagaccttttctgtggactatatatagtttgagtacgttgtacacaatgaaaccgagttcagtttcatatgaaacctgaggaaatgatactgaggaggatcatgatacctcccagggttcacatgatcctactcaagtatcatatgtgaaaccagtagggaaccactttacaagacatgatactagataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtgatacctgtaaagtatcacaccatcctactaagtatcatctgtgaaacccatagggatcatgttagaggacatgatacctaagtaggatcatgttagaggacatgatacctaagtaggttcatgttagaagacatgatacctaagtaggatcatgtgtgatacctcacatgtatcacacttaatgatactttttttagtaggatcatgtgtgataagtatcacgccattaagtagcatttgtgaaacctattgggatcatgttagaagacatgatacctaagtaggatacatgatacccaagtaggattatgttaaaagacaagatccctaagtaggatcatgtgtggtacctcacatgtatcacacttaatgatattttttttagtaggatcatgtgtgatacctgtaaagtatcacaccattaagtaccatctgtgaaacccatagggatcatgttagaagacatgatacctaagtaagatcatatgtgatacctcaaatgtatcacacttaatgatacttttttgaggagaaccatgtgatgctacagaggtatcacatgatcctacaagataacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggcagacaacgtgtgcgccaatggaatcagtcgaggaaacgagcatggaggcacgcgattccgcgaatgaatcttcgggatgcggaggagcttgcgccggtgaggaatcacgcacggaggcgcgcgattccgaggaggattcgtcgggttgtggaggagttcgcgc

SEQ ID NO: 24584 - DNA, 3835 bp, Oryza sativa
  unsure (1)..(3835): unsure at all n locations
agcaattccttacgctgacagatgaaaccaattcaggcagaaagcttaaaaaataaaatactgatgacatcccatattttagtggtgcaattaatatagtaaacatcattatattcatcagaacttggacacaaataatataccataatgattgttttggtcgttgtattttggttgattctggaaaatattaagaaccgtatgatgaaacgagaggaggatttatgtacctttgtgcgaatcagagatccgtggctgtgtggaggcgggtgacagggcgggcgacggtgttcgggtggtggagatcaggggtggcacggaggacgggacgagacaaccgaggcgggcgacggtatttggcggtggagatcaagtggagatcggagccggcacggagatgggcgtcaccgagtctagcgacgcagctctggcggtggagatcggggatccgcaatgccggtgacagtactttttgtaaaatctcctctgaggaagaaaatactttgagctattatcttccttaagaaaactaatcacatatagcttgacctataaacatcatatacattaatggctacatatgtgtttctcatttctgtgtaaattaatgacagatagtcaaatattcaagctagatctatccactgattccttcacattataacaattaaaatatccaaattaagaaatacctgctggcgtgttgcaacctgcagctcgctgatgtcctgcagggaggtctgctggtggcaattacttgaaagattgtgggcgtacaggagcggaagaaccctaaaaagccagacattcagacagggtgcagaaattgaagagaaatagacgaaatcaggctacctacctacgatgttttgagcggtgacgatggtagtagagcagtagctcctagcacaaagcaggtcctaatgttgcctagatgcatgcgctgcggcctttgtcggagctccgactggagaggccaaggcctttcccgagctgtttgatgaaccagcaagcacaagcacaagcatctcttctttatgagactcgacagatccaactggtcctactgatagttgagggatagcattaacaacaaagcattcaatgaaaaatgctatacaagaaatcatgatataaaatcacagtatcaaatttattagagacaatactatatgatcataaagagtaggcagttatggatattagaatatacatagttcgagatgggcagtactatttgatcaatttgagaagagggataattagtgatccagcatgttgtacttaagcccagcattttttttctaaagcccttcaaagcataatcatgtattaatcccttgagacttcacttgatactatcaagtttttggaaatcaagttgtgtagattaactgaggagataaagtaattaaccatgcgtttatgcataagtgcgatttagcttgcacagaaacatacatcttccatgccacagtacctatctttaggggtaggaatgaaatgaaaaattgaacaccacttaggtcctactgtaaatcagtaagatatagtacaaacgtaggcaccaaatgcgacgagttacataatacagaatctgaaatacaagaaaagaggatatcgaaacacagtattattcctttttgttgaaaaataatgttccgtaaaggtcaaagcaatctgacacaatcatggtacccctatagttacaagcccttcccgtctatctcttatacatgcaagccatcgagatgacaccatgaaaagctattggaaatgccatacatgacaagatattggaggaaaaagctctgatatgaaacatactatttatcaaacatacttcctttagcaaacaagaatatgccgatgaccatataaaaaacaatacatttcaaactgcatcttatatttttacacaaagaatagaggaaggaagatttaaaaaaaagggccaaaaaaaaccccacattgatattgaagcaccattcgagatagaaattgaatatgtcactatgctggaggtaaaattgaatctgagtttttggtgggatctagaactcactctgtcatagtaatttcttcaatctacctatgagatgtatcataaataaagaaaaataatttcataattggaaaaggagataccagaaagctcattttcacaccttcacacactgcaggattctaaaatgaaatttcatcagttctcccaattctatttgaatatttgaaaatttcaaggatttggttacactcagattagtattttgcattactggtggcagataagaccacactaccacaacctggctaatgaattttttcatagggaatctgtgtgtagggactgaatgaaaccctgcgtgacattgacatatagtaatattatctaccatttttcttcacctgatgaaaatactactcactgacaatgactcattttgattattcagtcactcgaactatcaatatagtttgcatataaacgacaggataataacacatgttgtctgcacgatagatggttttcacacacagggagatcaaactcacctgttgtctgcacagcttatatggtctttcacatacagggaaaatatgtgcaatgaggtgctgtttttggattagagctgacaaacctttgctagcctcctgcttgcttgctgtgcccagacttctcgtaccgccgtgctgatgaggagatgactgactgggctctgtacttgcaatttcacacgtcattctgaaacaagtgctgggaatcaaacaacgcaccaagttaacaggagcaatgggataaataaatcgatgtcgtgattgtctgggagagagggaggaaggagtccgtacctgtaggctagaactgggtcgcccattaccggtaggcaaaaggggatcgattctggagcttggttctagggtttagggtctcccaaccgtcgacttcgctgccgctggtgcttgctacttccttctaaaaggtttttaggaagcattatcacctcttgtcgaggccgcacgaatatattgatctcagttggaaatagcctccaacgtggcttacaatcaggaaacaaaatctgttgtgatccggttttatctcaaccaaatcaatctcattcatatcacatgcaccggactccctgcatatgcatgcatgcatatctctaaactatcgctacttctaacagcccccctcaatcataacttatctaagttaagattgtgtctaaaatctctaagctgttaaacagtaattggtttagtaaaaccatctgcaacttgatctcctgaagctataaactttatctctagttgcttcctagcaactctctctcttacaaaatgataatcaacttctatatgttttgttctagcatgaaacacagaattgactgacaaatatgtagctctcaaattatcacaccataaccttgccataggaggaacttgaactccaatttctttaagagtttgaacccacattacctctgctgtagcatttgctactgctttatactcagcctcagtacttgacctggatactgtagcctgtttcctagcactccatgacactagatttgatccaagaaatactgcaaaaacctcctgtagatcttctgtcatctacagatcctgcccaatctgcatcagaaaaagcactaacaagagtagaagaagatctgttaatctttaggccaagatcaacagaggacttaacatatctcagtatcctcttaactgccattcaatgttgtaaagtaggagcatgtaaaaactgacagaccttatttactgcaaaagaaatatctggtctagtcaaagtcaagtn

SEQ ID NO: 24585 - DNA, 2591 bp, Oryza sativa
  unsure (1)..(2591): unsure at all n locations
cttgttccaaattaaaatcagctaaagcttcatttaaactctgtggctcttcactagagaaagcaagaaaactgtacctcactgtaccatcggtatagactttctccttacgtatccccctctgcagcctagtggtaggtctagtttgctgctgttgtacctgcacagagtcatcaaccgactgattagcagtaacactgctacctattgctgtactgctgctactgcgactcgcagacttgccaccaccactgccatttgcaggttcggctgtggtacttccagcagcagtagcactgttttcattttctgcgccgtgtgtatttgctgcaggttctgaaccacctgcattagtactattttcagctgaaccacttgcattagcctgtgtttagattcaaagtttggatccaaactctagtctttttccatcacatcaacctgtcatacacacataacttttcagtcacatcatctccaatttcaaccaaaatccaaactttgcgctgaactaaacacagccttagtactattttcagcatcagaagcaacagagaaatcattgccaccatcatcaggattttctgtatcatgtgcagcatatgaattttgctctccttcttctccctgttcagatacttgctcatcaaaaatattagactcaacaggaggactattaaacatataaccattttcttgtatacccctactagcaacttcaggattcaacagtgttgagggcaagagtaaaatttcagatttgagcctaactccagcattggagtggagattagagaaaggaaaaatattttcataaaaaacaacatctctagaaatataaactctgccagttgcaacatctagacacttgaatcctttatgaatattgctatagccaagaaacacacattgcttggagcgaaactgaagtttgcgagtgttgtagggtctaagattaggccaacaagcacatccaaaagttctcaaagaggagtaatttggtttttgatgcaagagacgctctaaaggcgtggagtattgtataactttgctaggtgtgcgattgatgagatatgtagctgcaagaaaagcctcatcccaaaatttaagaggcatagaagcgtgagcaagtaaagaaagcccaacttccacaatgtgtctatgtttacgttctgcggagccattttgttggtgagcatggggacatgagacatgatgagtaattcctatcttagtaaaaaaggaatgaagtttttcatattctcccccccagtcagattgcatagcaataattttgcgattaaacatcctctcaacaagttgttggaactcatgaaacttatgaataacctcagattttttcttaagcaaatagatccaagtaaacttgctgaaatcatctatgaaactgacataatattttctgccaccaacagagtcaggggcaggaccccaaacatcagaaaacacaagctctaaaggattattggacacactgaaagacttaggataggggagttgatgactcttacccctttgacaagcatcacacacacctaattcattaatatctcctaaacatgggagattattattgttcacaactttttgaacgatagacaaagatggatgacccaaacgactatgccacttcgaaatagtgggtttgatggctccaaaaacttgcttggatgaagatagcgacgactgtggaatgggatagagaccattgcggcaaggccctctaagaagaagattcctcgtgacctgatcctatatggcaaaaaacgagaatgactttcacaaagcattgatatcaagggctaaacgacgtgcagaaaggagatttttctgggccttagaacatgtaaaatattcttagatataaattgcgagtaggggtatgaataacggaatggccaatatgtttaatggccatacctgcaccacttgccatgtagatttgatccttccgattgtaccttttcccgggtcgtcaatttgtccaactctctaattatgtgatccgtagctccggtgtcaacataccaatttgtgtccacaccataggaggctgcagctgccatcttattatcagaaacaaagttctcatcatacctatacaaacagtcagcgacgacgtgccccgtttttccacagagctgacaaacagggcgcggtttgccgccacggcctccattgttgttgccgcgaccaccaccacgcccgccattgttgctgttgccgcgcccaccattgtggccgctgtgtccgccccggttgaagggggtgtagccgccccttccaccaccacatttggcgctgttggcggaggactgatgcgctgctgcatggcgaagtttctgccttgattcgaagctcacaagtgagagtagaactcggagaaggaaactgcatctggtctcccgacgagggaagacaccactggttcccaatcatcatcaagaccggcaaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccctt

SEQ ID NO: 24586 - DNA, 5166 bp, Oryza sativa
  unsure (1)..(5166): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaacagtcagcgacgacgtgccccgtttttccacagagctgacaacaagggcgcggtttgcgnccacggcctccattgttgttgccgggaccaccacaacgcccgccattgttgctgttgccgcgcccaccattgttgccgctgtgtccgccgcggttgaagggggtgtagccgccccttccaccaccacatttggcgctgttggcggaggactgatgcgctgctgcatggcgaagtttctgccttgattcgaagctcagaagttgagagtagaactcggagaaggaaactgcatctggtctcccgacgagggaagacaccactggttcccaatcatcatcaagaccggcaaggatgtaggacatcaattcctcatcatccattggcttgccggcggacgtcatctcgtcggcgaggatcttcattttgttgatgtagtccgagacgctgagatcgaccttttgggtcgtcgctagcgccaggcgcgtgttcagagaccgcgcacgcgactgggaggacagcatctcgttgattgccttccaaacttgagccgcagtttccatgtggatgacttgagtcaaaatttccttggatagggttgagagaagaaaccccaacacctgctgatctgccgcaatccaggtttcaaatgccggattggatttcttgacagtggcttctccttccttggcgtcaatcacagccgacggggcttgtgttgcacctgtgaggtaaccttccaaacgcgcaccgcggatcaccgggaggatttgccctttccataaaaggaaattcgtcctggttagcttcttaaggacggcatggccagagaaggaattgccggcgctgatgaaggaactcgccataacagatgcgatctgattctggcgatttcgggctctgataccataaaaggtttttagaaagcgttatcacctcttgtcgagcccgcacgaatatattgatctcagttggaaatagcctccaacgtggcttacaatcaggaaacaaaatctgttgtgatccggttttatctcaaccaaatcaatctcattcatatcacatgcacgggactccctgcatatgcatgcatgcatatctctgaactatcactacttctaacaccttcttcctttcaacaccagggtgatgaggctcaaggaagaggcagagcagcgagaagccccggcggtctggcaccgggtgagaggaaggggaggagatcccgtcgtgatccagggtgaggtgggggagatgcggtcggtgggaagggccggcgtcggtctcccggcgatcagcggggaggggtgccggtgagaaggctgggcgtcggaatcgacggcagcagcggctgcgctgcggttggcgtgggagggatggagcaaacaacggcggcgcttgagatggcaggggcgaggggaggcggaatcagctcgtgacgtctgacttcagccctcacgacggcagagagcagtcgagcagatccatccgtccacctagaaagcgcacaaccgcgtcgtgagtctgggctaaggccggcccaacaagcctcgtcccccagcgccgtctgtctcgctcctatcctttttaggaaaaagtatatttaacccccttaaccatcccttaggcccttcacagtgctcctaggtagagcgttgccttgttgtgctagctaggaatttcgccgacgtgtcgcgtagcaccacgtccttgttgagccgctcgctcccaagcaaggaaacgcgattcctcgctcgcgcgaggcagagggaacgcctagagctcgcgctgtggagggcgtgcctccaactcgtcgtcccctcgcgccctctccagcgtcgacctcgttgccgtctcccgctccgcgtcactgacctcgatgtcgccggggagctcgtcgctgcgccgcttcgatccgtgccgccgccaccgtcctcgtcggagaagctcgccggctcgatggggaaagcgcggagaaggagaggagctcgaggtcgatgccgcgtccgacctcgccgtcgtcgccttgatccagtgggcctaggccggatctggccgctcagcccagcgtcgtcgccgtcgccgctcgggccgccgctccacccggctttgagaggaagacaaggtcgcgtggctccggtcgacgacgaccgtgccgccgctcgtcgtccgcgaggaagacgaggtcgcgcggcgacctccgcgaggaagaccccaccgagagcccgttgctgcggagcggggtagggggagggaggcgccggcgtctgtggcctccggccccaacgatgagaggcgccgccacgccggcgtccatgccttcttgcccgccgtcctcgccccggggcttcccgtccgccgcgtccccggcatcgttcggcgccactgccaccctcgccggcttcttccgcttcgggattaggggagtcggcgccggcggagggaggaggggacagccggcgccactcggccccgaggacgccgccgccacaggacccgctacctcgccatgcgcgcagccgtcccaccgtcgaggtcactgccgtccggcccgacaaggagaggagggggcgggcggttcgccgtcgtgcgccgccgtggagccgagtgagggagggcctcgtcgtcgtccacgctctccgctccgcgtcgccgacctcggtgtcgccggggagctcgttgccacgccgtttcggtccgcgccgccgccactgtcctcgtcggagaagctcaccggaggttgaggccgcgtccgagctcgccggcgtctgtgccttcttgcccgccgtcctcgcccttgccgcttgccgtcctggtcagtggcatgcgagaagaatggatagagatagagagggagagatgaatgtgaaaagagagatggtgggacctactaacatgggtgggacccacaaacatgtattgtgcactgtgaagtgtggttctttacggcatgtgtgttacccgcactgctattggccttagggaaagatggtggcctggcccctgagtccgggaaaagagatactaatgaggtcaggttgctcagcaaatcaacttgctggaacactcttcccaactcggtagtaatatgagccctttgaggaaaagtgaagatggcgtgattgcaacaaacaactctaatgcacaatcggcgctctcctttgaggagagtgcccgggcacaatgaaaatactagcatggaactgcggcggccagtgcgagcgcttctggatttacagaggcgtgagagacccgatgtgttgttcctgtctgaaacacatttgggaacagctaaggcagaaattttgaccatctcagcattttcgagagtgacgggccaagtggtggactgcttatgttatgtgcaagatgtctctgaatatttcattgatgtaattgttgatgatggaagggaatggagacttactggaatttatggtgagtcgcgttgggagcacaaaggcaaaacatgggaggccttgagatatcttcatgggatgatggataggccatggatggagttaggagatttcaatgagattcttttccatcatgagaaggagggagggagaccgagagaacaacgtcttttgcaagcttttagtgattctttggctgattgtgctctctcggatatgggctatagtggtgacatttttacttggcaaagggggagaataagagaaaggcttgatcgaggtgtctcaaacgcgcagtggaatgctcttttccctactgcacgactggagaatggtggtatgctcaattcggaccatagtccgctgattgttgaaactgttgtgcgggcagattctgatgccaatacaaggcgaggtcctaaatgcttcgaagcacgttggctcaaggaagagacggtagtgctgcggccagaggagatgtgccaaatttctcgcaaaaaaccaagcaagtacatgaagagctccacgtctgggataaaaaggtgttgaagggacctgttaatcaaataaaaaagctgcaaaaaaaacttgaagagattagaaggggcccctcactgatgatagcatcgctgcccaaaaggagttgttgatccgcctggaactcctaatggagcaggaggaactgatttggttacagcgcgcccgtgcaaattggctaaagcatgttgaccgaaataccaaattttttcaacaatttgcctctagtcgaaggaaaagaaacatgattactgggttggttgatgaacagggggtgagacaagagaatagcgacactatgtgttctatggtgcaaaattatttttcccatctgtttcagtctgaaatgcaggagcttgatgaatcagttttggattcagttaaggtcaaggtcacgcctgaaatgaatcggagccttttagctccatttacagctgaagaggtcaaaaaggcactttttgatattggagatctgaaagctcccgggccagacggtttgcacgccattttctttaaacggttttggtcaatgctaggagatgatctgataaaggaagttttaacagcggtaaatactgcaacaattcctgagggctggaatgataccactattattatgataccaaaggtgtctaacccagatatggtggctcaattccgccctatcagtctttgcaatgtggtgtataaagttatttcaaaaatgctctctcgcaggatgaagagcatccttcctgaggttataagtgatcagtgcttttgttccaggtagattaattacagataatattctgattgcgtatgaatgtattcatactatcaagaggaaacaagggaaaagggggttatgtgcgattaaattggatgtgcataaggcgtatgacagagttgaatgggttttcttggaaaagattatgttaaaattgggttttgatgataggtgggtgtctcttattatgtcctgtgtgacttctgtaagatatactgctcggtttannnnnnnnnnnnnnnnnnnnnnnnnnnnnnnnnnnnnnnnngttntatcaatncacat

SEQ ID NO: 24587 - DNA, 1256 bp, Oryza sativa
  unsure (1)..(1256): unsure at all n locations
tatataacccattagatatgagagtatttaatatacttattactgacatactcgcttcgtcccataaaaaaaaaccaaatcctatgtatgaatggagtattctagtagtacagtagtgtaaaaaaccgccaatagattgatcctgaatttcaggtcaaggagacaaagcaactactccatagaatcatagtattaggatatgtttcatccagtaaaaaaatatatttgaagatggggagtaagaaacacgaaacggaaaaacgagtgaagaagagaagacatttcagggtctgcttgtttctgatgccaaaagcatttttttagataatgccaaatgcgtggacagaatgcttgttctaataccaaatgcatggacagaatggttgataggtatctgcttgtatcttgctcgatggaaaccgcatggacagcgacgcatttcttctccttttgcatgttactactgaacggttgacacaggatatattactggcgaaaaagtacatgttaacatgggttcaaacagtaacacgcatttcaatcaagtgtgcaagtgcaaacacaaaatgatcgtctgtaaccgtagcgcgtaaacaacaagacgtacagttatactacctccattccaaaattttgacgccgttgacttttttaaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24588 - DNA, 1016 bp, Oryza sativa
  unsure (1)..(1016): unsure at all n locations
cannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatctgaattttcttgaactttcagaaaacccaaatattgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagccatgctactgctagattaacccagtaacaaaagctttcatgatccaaaagtagatcatcatctgcttcccaaatcagcacgatgccttctaagttctattgacctcttcaaatgaacttttgagataagatgacatcttcaacgtcaatagaaccctagggaaaaaaaaataatatccaaattaaaataatttgttagcacatatatttatctttgaagaaactggtcagcataccagtagaagttgggcatagctgctaattgcttcacattcttgatgttcttccacatcagtttgcatgttttcctcctctgccttttcttcaggctgcataacagatttgagaagtggctcaatatatagttctcaatatatatagctgcataacagatttgagtagtcgctcaaatatatttacctttctcttttttgttttttgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaaggggatcctctagagtcgacctgcgggcatgcgagatgagcaaatcaagccgcg

SEQ ID NO: 24589 - DNA, 763 bp, Oryza sativa
  unsure (1)..(763): unsure at all n locations
agcgtggnatttggattcgagctcggtacccatcataataataacgttacatacttacaaaagaaaaaaaaaacaacagcggaataacgatctagcgaagctccggctccactcccacaggcagctcaactggggtataagccaaacgtcttctccttctggatcatttttcttcaacttaggttgattgattattgcaaggtgagcatatgacatactcaacaagccacacagcaaatatgcaagtgcacaaggataccaaaggatggcataatataggctcatttgcaaaagcagcatttagcaaacatttagaagtaaaacagtagagtaattattcatcaattttaatcaacactgaacagcacacccatgctgctcaggcccgaccatcctaaacaaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24590 - DNA, 10594 bp, Oryza sativa
  unsure (1)..(10594): unsure at all n locations
catgccacattgattacctctcggnaccctttcngaccggagtgatgcacctgcaacagatattccaaatagattctctctacaaaactaaatttattcaactagttccctctcattgcgcgcctgcctggagtggtggtcattggatcttgaaaatcatagttgccgcagagcagaaaaaaaaaatcatttgcagcatcagtaatccggggttattattattaattgctcacatcacatccggtggctcatgatccagcccacatatatatgtactccaactataaatgggagtagatgagattggtacctgcagtgcaggtatgtgtgtgtgtatatagacgcgagcaaatgagcaatatatatagatggatgaatgatgatcatggcatgcccgcggcgtgatcgtgatcgtgatcgtgatccatggcnaggtagtggaggaggaggaggaggcctgcggctggtcctcgtcctcgtggcagcagaggcagagcatgccgcccaggaagccgagctgcttgcagcaggcgttgcacttgcctctcttgtagcacaccccctagcacttgtagattgggtagttgcacgtttccgcctccgccgcccactgcatcatcgcaccatctgcatttccatttctaaatcccatcttatttcttttctttcttttcatttttctagctagctatagctgtttgcatttgcaataataatagtattttccatcttcttcttttattgctgcatgtatatgcattcatgctaacttgataacttaaactaatagtcaagcattgaacaggctaactgaaactaatagttaagcactgaggaggaggagggaggagctagataattagtaattaagatgactcacgcgaggcgatgaggacggtcactaggaacagcgccaccaccggcttcatcttcacagtcatcctactcgtacgcctcaatgctcactcgctatctagctgcctggcctcttatatactactcgttgcaagcctgcagctagcttttgacatggcagcccataaaattatgctccagagttaattaacatcgtccttcccattgtaattacaataataggcttaagtaattgtttttcacttttttcttcttttcttcccaaacccccttcttttctttgttttgccttttgtgtaaattttattcctcttaatacaaaagtgcgcaatccttttacgtattccaaaaaaaaaattaaatcgtcttgctgggggtagctagctgtcgtctcctcgtgcttgcttgcaagttactagtattaggagtttctgattatctagcattagcctgctttaagtaatgcgatcaatagtattgtgcgactactatcttaattgagatcgagacaagcatccagttcgttcatcattgatctcttgcaaatcgatctggtacatgtctatgtcattgctcttaatctgcctcaatgactcaatatggctagctcttaatctcagctcgattatgtcatcgaacaattcaagcacttatcttgccatatataccgagacctgatatgtgatagatggacaaattttgaatgtcttgttcgatgcacaacatttggagatgatgcgtgcgatttcgaagctgggacagaatttgtgaagaccaagaaaatgacaactcaatcacaacaaaccaaccaccgcccaggcagatcgcattcagagcatgagtaaataaatttcaagtctccctgttcttttcagaagaatacatgtccgaatgtggtataattaagcctgctaatgggttaaaatccaggccgcatccaccccaatccaccttctctgcaaccactccaccaaaccagtccgctccactttctcatctctaacatccaaattaatccaacccgcaggatgtttgaaaccaacccaacccaaaccattgtagctaagtggattgaatccatttcaaacccatggactgagaccacatgaaaccgccgccgccgccggcggaggaacattgacgcaaacccaacgaacgcatgcaacggtagtagcttgtcgtcgtgctcgatccgtggccgcgcgagcccgccatgtccagagactgcgtgatgagtgagcagctggcctgttcgacgcacacgacaatggctgcccgccgccgtgctcgtggccgcccgccgccgtgctcgcatccatggccgacgcgcacaacaacggcgggacggagctacttcacgacacggaggtgcgcggcgagcttcttctcccgccggtaaggaatagtagccgatgaacctgacctccattgtcgccaagctgagctcgaagagacagccatggtacagccggaagagcaccgcgccgctgctcttggcgaagcactcgagccggacctcctcgtccactgtcaatggcggcggcatctcctccggcgcggctgactccaccaccctcgccaggtccaccgcggcgcggcacgtccacctcgccgcgccgtcgtccttcgacaacgacgacgacagcggccgcctcgctgcgctgtcgtccttcgacgacaacgatcgatatctcgtggcgcctcgccacggccaggccgagcgtcccgtccggctacgacacgaggagcatctccacgctcggcttggcgacgcgttcgaggttcgagggatgagggagtttgatctgcgccgacggcgatgacctgtcgaggcggagcgcgggggcatagcagccgagctccgcggcgttcgagagcacagccagcagcgcagcgtcgtcgctgtctccatggatcgaacccactctagcatccatggatttaatccaagttggacccgaaattttatacccaaaaccaaaccaacccaaaccgttctcacatgcagtccaaaccgccccagcccattagtctcgtcaaaccatttccatccaaccaaagccagcccaaacttgaaaccaatccattttacccacttcaacccaacccattagcaggcttaggtataattaaggggagctccatgcttttcagtgttcttttcaaaagagtacatgtccgaatgtggtataattaaggggagctccgtgcttttcagagtttcagacgaaactgaacacctaaaactgcccaatgtgacggcaacagccaaaatattctgagatttagaggtagcgaccaccggccacatcaacgaggctctcgtctccatgggcaacttactttgttagttcttgctttggaaaaaatataaaattagcaagtggtattttgagaagaaatcgaaatgctaatggcacaggtcaagctagtacttgctgacaatagttgcaatacttctgtcgctatacatagccacgggctcacatactcgtatataacaacaggacttgatcaatttatttcatcatttttttattaccagtattgtccttggagcagcaataacagccagtgtcaacgggagaaaaatattacatcatcaaagccgagtttatgaccctacaaaagttgaattcgctttgcgctctcagtacaaactctccgaatgacatagtttcagctacactcccttggggagccccgtgaccgaatcgatcaatgctaggctttcgtcagtgacaacttttgggccagctccaagcctgctacagatgaagtagctcacatctcccttgaatttttggctcggcatcttcgtctcggcaggagctgggagggcctccacatcttctatcgatttcagtccagcatcgcttagaatcgacttgtcgccaaccatatagctgcatcattttgtttgtcaaatagattcttggatagattggtatgtcatactcatgacaatattaacgcacctgctgagatcattatcttgaggagggaaataatacaagagcttctgaaggagaatggttgcatttttgcggtttggtgcgattaggacagcattgggcccagcatcgaaggtgtaagcaacctgccatcaaaaaaagctcttgtagaatgagaagagttgatagcacaactgtctactagttccatactcgtatagaagaaaaatgcatactagaaaacataaacagtacaaataagtcctagacaaggattttcaatgaaagaacttccttatcacgaagccatattatgtacagccagattatcttgtgcattccttgggcttttgtttccatcataacaaagtaatgaattggtatatatatcatatccaatatatgtactaattaaatatgatcctccatagcattaacaccaatggactgatgacaattagaaaagggtgaaaagggtgtggaaaatgagcttagagtcaaacatttgctatttctacaaagatcattgagcaatgtgagtcatacacgttttggctagggcagtacaaattgtttgtgccaccatatgagcttatggtccattatacccttgttatgaactcagcatgtaaccaaccctatttcatggtatggacatccataaaccgcaacagtttattgagaaaaaaaaaggagaaaagaagagtatacctgtggggttccttctgactggttccacttctccacaaggctaattatcctgtgattaattcagacagcaatgtcaaagctgatgtgtcattagcaacagaagcccaaaacagagcactgataaataaaagatcacctgtgtgatgtatcgttcatatagaagatgggagggctcgtgtccaaacatacagcatgaaattggttgctatctgcacaagttaacctggcaaaggactcaaaattacgagacttgatagcctcttccattttcaacacccgttctggaactacagtctgcaatacaagaacaagcaattcaaaggacataagaaaaaagaagtaacagctaaattgacagaaaagctcaattaatattttactgcagtataaaactgcccaactctacttcctctatgaatcatgagaaatttaaacggtcaaaacagtcacctgggccctatattgcaaaaggggacttgtttcaacactgtctcgcatcccactagtgctacttgtttccttctgctttgaactgacctattttacacagggaagattcaattattttgaaggtgtcagacatgacataattagtaaatgttgttaaaaagcatgataaaatactagagttaccatccgattcaaatttactggttgtgaagccacaacaccaggagacaggagtagtaatgctacaacagattatacgcagtaagaggtatgttaaatgcacatcacataccaccgctatgataataacaagatcattccagtgtgcctcatcagcaagttgtacagctatgctgtcgcttccatcattattctgtaagtgtagtataaaacttatcattactcgctagaaaggatatgcgataaatttcaccaaggctgttcctctttcatagcatcagataactcacttttcccatacaccatttcacgaatcccccatatatactgcggcatgcacttccagacccttgcctgcatttgaatttgtcagttataccagaaggagaaaaggagcagttccatagcatattgatcagtacagatgagtacaagcaacaaaataccttgctatggaagaaagttcaccatgatcttctttcacattcattagctttccaagggtgaaaactacaaaaagcaatcaggtgataaatatgtgcttccattcaccctatttagatttttttaaaaataaaaaaatcaccaataagatgattgaaccattgtctgattttgggtggcattatcaaatttgaaaatatttgagacaaaataagtagggaaatatcattgatatcagaagtaagagactttaccaaaacaagccaagccagcagccgaagaggccaaaccagcagcagtggggaagttgttgaacgatgctatgtgtacatgtagcttcccccagtcctctttcttgatcctgatccccttcttctcatcctcgacatcttgagcacgcttccggatctccctcaggcagctctgaaacctccctcctgacaaggagatctcctgcacagttcaaaacgaaaagccagcttaagacatagtataccattaaaaaaagtaaaggatcatcccttaaggtctagcgtggtgatagatcacagacttttaagtttcacacagtgtaaatctaggatttgacagtttgtatttagataggatcagtgactgtaacagaaacaaagctagaaacacatactagatgctagtgcatatgaaatcaggaatgtgattcttttttaaaataataaaagaatggaaattagagctccactgcctgtagaatttgtagatgggaagaacactgaaacagattgccattattcagatctaagcagcagttgtcatcagtttgatgaacagagtcccattattcagaggggacaacaaagcataaacatcaatgcgaagcaacaacaaaaaaaaaaagtaggaagcagcagagcagagagatggaagagtagagaggaggaggaccttgccgttgagccacatgcggtcggaggggaaggaagggctgacggcgacggtggtggtggcggaaaggtggtcggggtcgagggtgacgctgatgctgtcgttgacggggaggatgagcgcctcgtccctcttcccccagtacttgatgacggcgatgttggtgggagatcggccggtggccatgagcacccactgcccctcctccgccgccgccatggaaggagaccgatctgctgcggcccagaagagcgagcaacgcgcgtcagggattcggactagcaacctcaactagatacagtcccaggcagcttaccggaacggaagcaacgacggggagcgggagcagtccccggcggcggcggaggcgggagggcgggagatcggagacggcggggcggagacaccgaggaagacgagagtgagaccgaatcttgatgctaaatccaacggctgcgatttatctatcccctccttagtatatgttttttcacaaaaacccctcactcgggtcgctatcgcagccagcatcttttgtttttctttcctttttgcacaaagacccctctgaataataataaataataatatgacggctcggttacttcctcctccaaggtcaagtccaagctagcgatcgccggcgatcaagccggcgaccatgcttccccggccaccgcgccgcgccgccacccccgtctatcatgatcatatcttctgtgaatggcttttcataagctgttgatccttcctgcagcatctaccaagtgaaatctgcatacacaatttgagatcaacatcgataagatgagatgagatgagatgcacaagtgaaatctgaatgcacaagttgagatcaacatcgataagatgagatgagatgagatacacaagtgagatctgcatgcacaagttgagatgcaggattcctattggattttgaagagagacagataatttacagggggtggattgactgattctcctcatacttcctggcttgaaaacgggaaagcttggagctttcggctctgatttgatccggtcagttctactgcttgacaaactgtggagaatctattccttccagccatatacatccaatttcttgacaatctggaccggacgatccatcagaaaaaattaattcagaatgcaatttggagtgcagcagcttttttggctggcacatcggtgtagtgcatctatatgtgaccttgcaactgtgcaagggtcaaacagcacggccacaagtacttttgttgatgaatcagttattaccacatgacttcgtcaatgctagcccagcaagtgatggaaggaaagatggatgaatgataaggctccagggctcataaatacctgagactgaacattgctcattacagtcttcagatgtaaagcagtgttgttcttcttctctattctgctcaaggcagctgcatccagatcactctactgatgaggaccacgaggatcatctgctggaagaaaacaaagatttgcacattgactatgcactgctgtaattgtatcaatatcgaattctaaatgctgaatgaacagttgctgatatgatcctgtcaggaagcaaaaacaagatactaattgccctcagagacatatatagtggacgtgcactagtgttttcataccacaaatcctttggccactggagtcaacttttgatcatctggataacataagtaaagaagattctatttcctacaagagcagcagcagctaagcacacacatccttttttcctttccagaaaggatataatgatggattagaatattcagacagtagtacagcttcaggattgctgcaagattagtcataaaataatactagtagtagtatcatcttactaccatccatggggttcaggacaaattagttgaactaggagtacatacagctgatacagttgtgcagtgaagcggtgacaattgtcaattgacaaagtgccaaggtctcacagctaatccccagctcagctgcctgctgcccccttgatggtctgcacatctctgcccattgaaatctttggtcagcaccatcctctggctgtcaagagttaggtgcagcccgatttgagtcaaccctttgattgcatcaagcaaaggtatactagtatcaatgcccctttatccaattctgcaaagtttcttccccaacttgctgtgtcctgaacaactggatttcattcggtcatcagcttacacggctggttgaatggttggtcaattgcaagctgttcatctgagagactgaaacaaaaccatttggatttgcggttgcagtcttgcagagatcacagaatgttgatctttcaggattagaaacaaaatgcagcacaaatatgatatgagtatatattctgatgaccagaatcagcacacacggttggttgaatgattggtcaattgcaagctgatcatctgggagactgaaacaaactgtttagattgcagttgcagtcctgcagaaatcaaagcaagtgcagcacagtatcaggcttcatatgacatgaatatatgatgacgatcagagattcagaatcgaaatcctcgtctgaaatttacaatttctgcattccttcactagtttcaacaacatttttttttgcttgctcttcagcacaaagattgaacagcaatacacactaacccaacaaaaagttagtttttacaagcaaatgtacacttcacaggatcacaaaggcagcagcagcagcacataaaaatcaaagaatggtagagtacagaaaggggaaaaagagagatttttttttatcatcctcctaattaaatcaaatcaacagccaactaccatcgtgggtttccctccacggaaggaaacctcagaaggaatggtggtgaggcggcgcgccggagccggacgccgccgccgccgcggcgctggcggtggcgctgctgttgctgcgcgtgctgtgctccatgatgcgcaccacctcgccgcggctggccaccacgcggtggaacacggcgcgcacctgccgctccagcggcgcgaggccctcctccagagcccggcacgcggcggcgagcgcctcggcgcgctcgaccacgtcacgcgcgcgctcatcggtcgcgcccatcaccagctgctcttcctcctcctcctccgcgacttcctcgaggagactgctcagctcccgcgcggcgcgctccacagcctgcatctcggcgaggagccccgtcgccgccgccgaccccgacgacgaccccttcttgtcctttttcctccactcgtcggcgatccgctcctggagagcacacatcggggccgcccactgcacctgcttcggcggcgccaccggggggttggtggccgcggacgaccggtcctggcacggcaccgccgcgaccagcgcccacatggagaagacgagcaccgagctcatggtgtagagcgccagccccagcccgcaacccgcgccgggggaggcggacgtgggcgactgcggcggcggcgcgaggtgcgccgccatggcgtggacgtggcggccggaggaccagttcctggagacgctgaaggacagcgcgcgcgcggggccggccctgcacgagggggacggcgcggcggcgagcttggcggcgtcggggaacagcctggagatggcccggcgcgcgcggccgaagtgggcgcggtgcagcggcggggcgaggaggcacaaggcggcggtgagcgcggcgcggtgcgagccccggagcgaggcgagcgtgagggagacggcgttgagtatgtcgagcgtcttgacggtgcggtcgaggaggtcaacggcgaggcggtcggcgggcggcctggagagcgcggcggcgacggggccgatgccgagaacctcgcggaaggcgtcgtcggaggagagcaccgcgtcgagcagcttggagaggaaggcgagggagaggagcggcgggtgatgggagagggcggcgaggcggtcggcgacgtgggcctggagggnnnnnnnnnnnnnnnnnnnnnnnnnnnnnnnnnnnnnnnnnnnnnngtcaatcaaacgcatg

SEQ ID NO: 24591 - DNA, 11759 bp, Oryza sativa
  unsure (1)..(11759): unsure at all n locations
ggcttcaaccagcttgaagagaaagccaaggtaaagaagcgacgggttattgtaaaagggcgctaagccgttcggatacgtggtccctggagggcgtggaggaacctgcagctcgtcgtcctgcgcggggtcaaagaaggcgacggcggtggccctgcgacggaagctgagaaggccgaggaagcccatcccggtggccgccgccgccgggtcgacgacggccatcgtcgtcggggggcttcagcttcgggactgtgcgtgtgcgtgggcttgggcttgggctttgggcctgggccttggtggtggtcgtcgaggaaaccaatggtggtgggtggagcggccggtggtggcgcgcgccctcatatacgcacgcgcgccggctccgaccacgtctcgcgcgcaagagctacctttgactgcaaggtggggccatgggtgtatagggcccatgtgtcagtgggggtggagagaaaaagaaggtggtgcgctgcgcggagaggaatgggaaaggtggactggttcttggagctgacttggttgcctcccactaactgtgtggacctggtgtacagcacccagtaatccctttttttttttcattcgctcccattttctaaatactattttgttgcgtattagttattttcacgtatattctgtgtgagtttttttccctggctagctgcctgagattaaggtgttttttttcagagatgttttcgcttcttatcagcgcagtactacctccgtcacaaaatacttatcgtttagagtttttttgtaacgtttaattatttatcttattcaaaagattatggaattattatttattttgtttgtgacttgctttattaacagaagtacgacttatttttttatatttacgcaacttttgaaataagataaataatcaaacgtttgcaactgtattaatagaaatgtgtaatgtgtagtactagtagtatttgttgtttttatttagttgcagctggcagcttaggacaaattgtaccttgaaggcttgatggctggcagggaatgaaaagtcatgaggtcttaagtccctatcatatcggatgtttgaaaattaattataaatattaaatgtagactattaataaaacccatccataatcttggactaatttgcgagacgaatctaatgagcctaattaatccatgattagcctatgtgatgctaccgtaaacattctctaattatagattaattaggcttaaaaaatttgtctcgtgaattagcttttatttatgtaattagttttgtaagtagtctatatttaatactctaaattagtgtctaaagacatggactaaagttaagtccctggatctaaacaccacctaaaggcttaaagcatgacagggcagggcaggccagatggagttaaattaaagccaaaacagatacggttgtgatagaatcatactagtagaaattagaagaggacgcatgcaaagcttgtatcatgtgacagtgagaagccaaacgcataggacacacaccaccaacatagcacaggtatgtaaacacaacgacaaatgctccattttagtaaggcgagcaggatcttaattcatcttacaaagaaaaaaaaaggaataagacagtgtcatgccactacaaaacactagtactaaaataaaacattagcaccaatcatcttctctctcttttgatctcttctctgaagtagtactagtagtacttcctccgtcctaaaatgaagctatttttgaggttggcacggatattaagaaagtatgtgagaatgattggaggaagtgtgtgattggttgaaaagagaaagtaggtgaagaagaatagttgtgattggttgagaggaggaggtaggtgaagaaatagctttattttgggacaagacactgtgctagaaatagctacattttggaacggagggagtagtaaataactagtgtagtttgaccatgtctattttgacgcgagaacacatctccaccgtcgatctctctgcccacgtgtcgtcccaggatgatctgcgccgctgaatagtaagtactacgtcaggacagtgaccctgcacttataattcactaaacgaaaaggaaaatgaaaaccaataatgattactggaggactacttagtttagaagatacgagaaatactcaagctaattaaccttggactgttctcaaaaaaaaaaattaagcttggaccacgtcagatgagagccggccgagcgtcgcgttatgtgctgcatgcttgcatagaccaagtctcctagctagctaattcttcatttaacttaaatttgatgtaattttcacaatacatatgcaaactaactatctactactaataattaaaacgagcttgattgttactagtatatattcaatttatagtacatagtaattagctcgcggttgcactttctgtaattaaattaacactgggcgatcggcttcagctagctagctagaccaagtcacctgcaagctattagctcgagtactttccagtttcaattcaagtcatggatataattaacaacacatgtaacacggattagaaatcaagcaagctatctactccagggaaggcaggctgactcagatcataccaggtcagccaatcaacggccatgcatacatacatcagaataaatattcatgtgatcgcctagcttatggtttcaaatgacacaaagaatttaactcacgtgttcatcaagagaatgcagtttatacattccaacaaaattcatctttcacttcactcgacgagccggccggctgctgctatttagatagtgatgtttcgaaacagagcaacctctcatgactcatcagattcatgatattttctttttcaataatacaagaagaagtaattaagctgatgataaaaaaagatgagcacttacacgtgtctatgcaggtatgaactcaggtgactgtcaatcgacctccttgattccatcttataccatacatacattagctatgattgaacatatgatgatgagttccatgaatcaatggatcaatatatatcgatcgctaacgcgaaaacaacaagctaatgaccaggagaaaattaaattaaataagcaagtgaataattaatcgtgatatccctaagtagctaggtagtaattaattgtaatctttgtcaattgagacagatgctgctgcagtaatagacacgtcttttaccaagaacagccttgcgtgcatacacatcacaatacatcaccatctcctgggatgatcgatgtatacgtacgcactcaccaccactaagggccccttttatttgtagaaaaaatatatgaattttagaggatttcaatcctatggaaaaaaaaatcctatgaaagcctttgaaaggattgaattatatccaatcctttaaaatttctaagaaatgggtaatcctatgcacattttggagaaaagttagccagaggtctaaccacttggaacatttcctctgagcctatctctctcatctgattcttgcgtttttcctgtggtccaatcaaacggccattcatgtgtttttcctatgttttacaatcttctgttttaaaattgtattcctatcctgtgttttttctattactctgttttttcattcctacgattcaaatggacctaatttcagataggtaaagatggagtagtacttcctatatatttattactcactcggtttcatatataagatgctttaattttctctaagttaatttttctaagtttaatgagtttataaaaatataataattcttacaacaccaaattatatctattaaatataacacttaatatatttgatagtatctttgtttggtataaaaatattattatgtttttatataaatttaattgaatataaagaattttgacttaaaaaagatcaaatcaaagtgtagtacaacaaagagagagatagagtagtatgatcttattatggttgattcgcgtgtatggacggtcaggatcgagttatatatatccggccgggtggctgcattctggccatatggacgtcacagtcacggccgtcgcctctgatccgggtcaagcagaataataagaggagaaatgcagctggtcagccccagatgcaaaactatactagctggttaattataattagtcagtctcccatgtaactggttaatcaacacgcgctctcgccgtccatagtaattaccgcagtgataacaacgggacgatggattgctacatgttagtagtacttactgtactagctagctattagagtaagtcccaaaataagtttattttacacccataccagatataccaatacaaaaccaaagaaaactataatatcttatttttatcaaatttaacattttatcttttcttaatacaactattcgtaaaaaatgagggcgaggcccgagcataggcacggcgacagagaggagactactccctccgtcccacaaaacgtgattcctagaagcccgatgtagctttagcagcagtattaaaagattagcatgtcttacaaaatacaaccactaattaacagtaaaaaaaaagacaagcaagatgggtgttttgtagagaaaatcaaccgatcgacgggacggcaacacgacgatcgagcaaggaaaggaattggaggaagggtccggccgcagtcaagtcggcgcgcgggataagatggagacattatctggacgctggctaatttgggatatcttatccggactctcactgaggctcagaattaaggttcatctatctatcaatccctaattatattatgttatatgcctaagtattatcgttgttaatcccttcgattgtccatgggcattttacaagaggcacacggagcaagcggcaatctaaggcatcaagcaggaaatagtcccggaacatcacgatggtttcaagcttttattcctgggcttccaccaagtaatatacgcatgtaatcatcagatgagatgataaaatatatcattgtagtacattgcattatctaaaaaaatcattgtagtacattagatatttgttctctgctagacataagctttctcatcaccatgtacaaatttccgagacatacttcaacggccatctgactgactccacaatacaattgctttgagcccttaacgaccatgaaatgcccattgtacacaaggtaatacaaagttacaaactacagtagcacaaatgattgttactcgtcggctagcaagcaaaaaaaagatcaaggacgcacccccatccatctctgctatcaaatcaagggtaaactccatacaactcaatgatgaagtaacaaaatcaaccgtcctgtagttaaagctatcgtctccgtatatgatggtacagagctaaaatgataaccagctccacaaacctgctgcaaaaaaatcactagccatcaccctatcacgagaagaaccgtttctaaactacaaacatgcctccgcagaaatcatgcatattggactccagcacatggccttgtgcaggctaattttggtgattttcctctgcaggttaactaacacttggggcagacgcctcctcttccccttcatcctttgtcctggtagaatgcaagattattgtcattgcaacatccaatcacatcaagataaatatatatcattttacccaaccaaaggtttgaataatcctagcctgattaatcatggaaagagggtgtcagaaccaggaaatagtgtttcgtttacgtaaaaaatggtgaattttggagagcaaacttgtctaatatttaagcagatcctgcttttcaacagcacctagaggtacagaacttgttctttcagaagagcaatcttattttaccagaaatgttttgtgggcaaacagttttggcctgcagaatgggacgttgcattgaatttcccttgaaacagttttgatacatggaaccgcagtacacagaaatactaacacagtactaactatattcagacaaaagcagccttgcaacaaaaatcttgggtagcattgcagtaggaaagcagaatagaaaaacaccagtgcagcttgcagcgttactttatgcccttaaggaaggtgtgcaagtgggcatgtaaaagttggcaagctttggaagcttaagcagcacacataaaccgagtaaactaagagatgacagaaaaaagtatgatacttgaatacttcactcagcataatcaaactgaatcagtacccatggaaaattgttacaatcaacagaaatatgtctttttggttctctctctgtgtgtgcgtgtggtttgtggggggtgatagaaatatattctgtaacaagacctaagttgatacaatatgcagagctgtccccactaacctttcattgcaacttttgcctgtgatatcgtcaatggcttgatcaagtgcatatagagctatcttcttaacctggtgatgcatattcacagggttcaattagatatgaatgtcaaaaggggagaaactataaaacatagtgctagagctatcacagttgtcaaattattcaaatatgtgtgcagaagagtatggaactgcggataaaaggattagctaacctctagtttatcttcattcaccctatgacccttcggaagcaagcgaaattcttctgtcagcctgatgcactcttgcacattttccggagaaacaaagtcaagtgcaacctttatacatgactgtccaataaaagggaaaaaaaaagcaggttggtaaaaagaataataccacagataagattggtccattttaattcaacacatggtattaacagcaatggtaatggacagttggaaactgcttccatgtctgtcatagcataccttcaaatttctgacttggtggggacatcctgctgggataaacacagcctcaccaagtttctgttcaaatgtccaaggctcaattcctgcatatgaaatgaacaatatatatcagtaagtgagaacaaattacaaaagacatcagtattttttactgaccatgttcttccttgagctttctcttgtgctcatttgttagataaaagcattgatcgtgaataggatgagaaacctgacaacatagggcagttgtgtgagatgagaaacatgacagatggcattccatggacaagtggtagaataactaattacctgtttgactgtttcataattataatgtctaaactcttctgcatgcttcatcagataatcatgcaatttgctgacatcttcacgtcggaagatatcccacaatgcaccaccctctgtctgatttccctcaacaaatgggtgatcatctttgggctcaatagatatggtaaatttgttagtctccatgctggtttcgtttatttcccctgttgcactggaagagcaagcatcacgtcgcctactgcgtctttgacaatcagaagattcagatgatcctacaccatgagaagatttacatttatcttcccttccaaagccattgcccatctcctctcccccattaattgtgcagatagaatggtctgtttcccccttggagaaagtaatatccatattatgtgcatcactttgattgggtgattgcccattagacagactcaagtttccctcagcttcatcagctaccatatctgtatgaacacctccctggtccattacagcaacatttggtgctggctgcttaatgcttgagccattttcaagtcctcgagatcttggcacttcagttgattcactgagagctattgatgtatcatcgtcatggtctggtcgcagaacatgaagattcttgccatctttacgtaagctctctttctttttctctattgctgtaatcctttcagctttgagttctacctcatcagtatgcatgagaatattaacctgtttacgcaataggaaacatgtgattattactttattagtcaaaactgaacaaagtaaacaggtgtataacaaatggaaaggcctgaaatcaggaaaataacacgatgatacagctttttattaaaaaaaaaggaaaatcacacgatgatacagctttttattaaaaaaacacaatgatacagctggatactgtatgcatcagatacattttcataattaaaattaacgttccattggttttttcccatataattcatgacatggtcaaccaactatccagcattgtcagccaccgtagcaagaattaaactaaggagtgcagctttcagcagcaagtaacaagacaacacaagcaaatatcacataattctttttatagatgattctataaatttatgctgtgtttaataactagactagatgttagcattggtaatcaactataaagagaactgaaaaatcaaaaatctaaataagcaacttccaacatgccaacagaagaatatttgaagccaaaaacatgcaggtaggggatcctcaagtgccctgagggcatgcaagctttgtcctgcttggttcggtactagtacaaaaattgtccctttataacagggctcactcttaaactaggaaggagctaaatatagtagaataacttgcagacttgacatgactacaatctaaagttaaactaggaaatggcttctatatattcgatgctcgtactgtcactgtagttgtcttccagccactgttcaacggcacgagctaggctcatgaggtgctgaaggtctgcaagattttacaactccacatcagtaggcaatgattggccgaggccagcagtgaacaaattgacttgctgttctttcaaaacagatggtgaaacctgctacaagagagcaaaaaatttttttggtactctgccactatcctagtatggtgtaatagagataattggttcaaggcattgctgtgcattggagagccatagtgcatgttgacaaagtcgcagttttttttccacaagaaaacgccttcatatcatttaaaactgcatatagcacttctgtgcctcgcccatcatgtggtctgacacaagccattccttccctcttcaagagatcacggtccttgaaaaattgctcgcaacgattaaaccatgggagtgggtcttctttgccatcaaatgctgagaaggtcaatttgtggtagaatagcgcaccacacgcatcttcatcctgccctagcactgatgccaagacattgctgctgcggctagtgctggttggaatgaggccatgagggccagggtatcatgctacagcccttgcatcacttgtgttcatggcatcctgcctagaaatgaggatataaatcttcttgcccaggtctgtaccccagctgtttgaagagctcttccagggctttggagttttatatggtggatggcagggatgggttggtcagagggctagggctgctggaggaggagattgctatgatacgaaataatgtagtaaagaggaggaagaaggtcaggaatagaaacacaggcaggtatgaaccagcactctcaggtcaagcagggttgtcctgctcagctagatgctcggttggcaaggatttagagttgggtgaagaccttcagctttattgactgattgctgctagtacaaaattggtcccttcatataacagggataactcttaaactacgaagaagcgagatatggacatatggtagtacaacatacaaacttgacctgaatactaggaaatagctactatatttgatatataaagactaggaatgtatatcctcccagactactgcaggaggccctgctaattttgagttcccagcagccccttcctttccatgtttacgtctccgatactttctatccataacatataatagcatccaaggatagcaatatgtacaatcaatatgaattaaaaggaaacaagattttaatccataaatctacatatacaaatgccagaaatcacaagaaattcacttatttaccgcatcagacatgtcgcaatggatcttcgtaacagaatcacctattcccaactcttgggcgacaccataagcaatgtatgtctttggaccaagatctggctttttaacatgttttggaagcttcactgccagattaaggggaccagattttggatctgtatactcacgaaatggtagtgcagacatgaactcagcaccatgccgcggcaggcgctcctcaaaggaactatgttgtggccaatctttaagcttaagtagcacaggcaaatcctccgaaccaacagctccacgggaatacccctcaaaaaacatgtgaatatttatatcaacctgcattatggttaaatgaaagcaatggtattaggaagttaccagtttgaaatataaagtagtttcaatggtgctgttgaaccccagatatgaaactggcaccaccaacacatcctggtggtacataaactaatatattgatatgtgaagttcataagttctaccactaccaggcacataagctgagctgacattaggtagatatacagttctttttcttttgttgtgtggacattttcatggtatcagggattccactggcacatctacacacctcaagaaatcacgatgatcaatgtttcaactccacacgtttataattgtactcgtgtagattatgtgactgacaatccctagcatcagctctacaagaggcagcttattgcaattttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatctagagcctcccaactcctgctctgtttccttattgaccactgaattgactttatccagtaaatcagaaataaagttctccttaaacaaacacctaagttcgagaagacaatccccgcaaccacctgcattaggtgggcatggtatgcttccgttgctttttgccctccatatcaaactaggagtgcaatcctctgaaggagctgcactacctatcaacctgtcattctgttgatcagaagccccttgacctacagcactgctatgactacttccctcttgcaaaccttccttgccttctatttcaggtacatcaacagctgtgtcacaagtgacaacagtaccagtagtaagaccttgacgcaactcctggcagcagctgaggcagagatcatagtgaccacttttacaacttctgtggaagtcaacaatggatgttctgcagttatcactgtttcaaataaaccaaaaaattagatagttcacacttgaaagaacatatagtccacatgctttacaaataaagcaataccaaccagtaaatccgctcatcattattaaactgagcttgaggaacctccaagtcagttacatcgatccctgttgcagaattaggattaggaaccaacaaaagaaacttagtgctaaaagggaaccgtgttaagctatgataatacctttnnnnnnggcntnnnnncttttctnnnncnnnnnnnntcntnnannnnnnncnnncnggcaagcaggatgagcattatcaaggccgtg

SEQ ID NO: 24592 - DNA, 17033 bp, Oryza sativa
  unsure (1)..(17033): unsure at all n locations
gtgactgaaatcgactgtgnacccatccgctcatcattattaaactgagcttgaggaacctccaagtcagttacatcgatccctgttgcagaattaggattaggaaccaacaaaagaaacttagtgctaaaagggaaccgtgttaagctatgataatacctttaattgtggcctcaacacttttctctagcatctgctcttggtgaagttgtttcaaccaagggagcaaaaagcgtgcaatacgcagagagtatttaattttgttcttaccatcggcaaactccttgtcaccctgacaaacgcataacagaaaatatcaaacaaaatgaagcaatgaggccaggtaataaaatagaaacgggacaacaaaaaaaagaggtgtaccttatttattacatttgtccgcagacaagtcttacaattgcagttattgtgacaaactggacagcagttctcaaaatcgtcctctgttagatgcgggtacctgcttagatcatgccacagaaacaagcaacagatccatattagtagctaagatataaatgtaaatttgtgcatgaactaacataataagaactgaaagggtgacacaactaaggtgatcaacattgagtgcttttagaagggcacaaaccagcgtttgatgcacttgacacaatatctgtgcctcctgtttttttcagcaccattccggcacctcacaactcttccactgtccttcctttggcactgatggcacatggttgaagttccatccatcttttttgtgtgctgcaaatcaaggaaatcatgatataaggacttagcaatgaattactgacatacaactgcaaatacaccatagagaatatgctgtataaaagattgcaatttccaccttattctccttgtagtctaccgctggaacgttccgcctgtccctgagcttcctgggtggaagttcagtcgaagagggatcagcaacaggacccttcctgcgctttcttgcggttctcgaggcctgagtctgccctgcgccattctcctggaaccaaaaagagatccatcacacattcggaacatggtaaatgtttgcatttccagtccccggcaggaaaagaaaacactaacctcaggagaagcctgcgtttcctcctccttgtttgtcttctcaccgttttcctgcaaccgcacccaataactggtcaagcatttcgtatgcaaaactacatattaagctcttcttaaaaagaagtggagggaaaattcagcgcaattgcagaggaactcttcagtgctgcacattccgtgagcaacccaggcttagaaatccaatagattggtagatatccaatgaaatttgacaactctgtagcttagacaagcaaaatcagggaaatggtcgattatccaaataacagtacactatgattgaagaaaagggagcaaaatccattatccattgcaagcgcgaaaaggaatccaaggatattgcccacttcacatccccgaccagaataacaaatacagaaagaaaggggaacaactcaaagcggcaaaactaacacaccgaaagcaaacatgaagcagccagtgttgctcggagatactagcacgaatccatccgctagggtttaaacgtcccaacatcccctcgacgacaacggcgcgaagaagacgcagcacatcatagcaactccccgggttttccgaggcgttgcccgaaggaacgagagagaaaataaaaaaaaacgagacctaatcgaagcagcttcgcttcggttaccttggcggcggcgtcctccggggccttgcgcggcctcccgccaccgcgcttcctcttgggcggcatccccggctagaccccgcggcgaccggcggcgaggtcggcggcggagaaggaggaaatcaaatcaaattgcggcgcgggtcgggtcgggtcgggtcgatctgtgggcggaaggggattcggagtggaatggaagaggaaggatacatatgacacgacggagcccacgatgtgtgcgttagggcccactggtcagtgaccgtggagggctccggtgggccaggatggtaagcttctgggcccagtttcagcgagagctggagtaggggatgtatggcccactcatcggagaatcgtggccgcgcacgtgtgccgaggagtgtactaggaatggtttgtttatgtttttggttttcgcgggctgtggtgcgacgtgtgagtttgaatcgagcggcggttggtgaaaaggaaaattcgaggtaaaaaaaaaagggactgtctatctgtctcagtcgacagaaaatttggtgtctaatctgttgtttttttatcataagatttcgatcaaagagtctcagatttttcacagaaatactttaaaaaatatatatataatcttattcatgacccattggatacaataaaagcccaaaacaaaaagaagcccaaaattaaaacatgagccaaatccaatattacaaccacatcaaaactgacagagagaattcacgtgaccacattgcctattgaagaaaacttgagaaccaagaagatgctctgcataggcacgtgatctgatcattaaagcaaaaaaagcaactttgcttccaaagagaaaaatcagagcaatagatcgaacaaggaagaagaagatggaggtggaggagaagattgcaaaaaaacgaaggatttagaatctgcaaacaaaattcaagatctgaggaatatgaaatcaacaggtactgaatcttgttctgaacttcctaattcttgaaatcaacactcttctaattcttgttctgaatcttctgaacttccttctttgaatcttgaaaaaaataactcacaaatgactcaagttcatgggattcctgtgaagaggcaaaaaattgcattaatccatcagtcctctatactggcgtatgtaaaagaagcataaaatagcacaacactatatacacagtacttcataactcatttgacaattgatagaatcttcatatgaatctacaatagcacaacactttagactattgacaaaatcttcatatgaatctacaatagaactatcaaataatagacagaatttcatcactcatttgacaatcaaatatgttagttacaggattgcactgttggtattttaactaaattcttgtggacttaagatctctattcatattgcatatcaatttattgggaacaaattcagaaattaataggaaaagtcaatcatagcaaattttaatttaattatagttcaactaccatcaacctcctaactcaaagctttcaaacaaaggagcaaaggttcacatataaaatgactaggaaaacacaactacaaaattcaaaaaaaaaatcgcatggcccctgatacatatcagcaagcaacacacaatgactataagaaaacaatcacatggccctgatacatatcagcaagcaacattcaaggatttactgtccagactgtagacttaaaaacttaacataatcaaaaatttgaaaacttatactctgcaaaattcgaatttacttcagactattaacataatcttcatatgaatccacaacataactttcacataatatacagtacttcataactcatttgagaatcaacaggttagatacagtattgcacttttttgttttcaactaacttcttgtggacttaagatctctattcatattgcatatcaatttattggaaacaaattcagaatttcataggaaaagaaaatcagaacaaattttaattatagttcaactaccatccatccactaactcaagctctcaaataaattattcagagatacaattgtcaatatatttgtactacaataagatagactgtatttgatggccctgattcacatcaccaagcaacacacaaagactactgtatttaaggattattgtccagtttgaagacttaaaactttacataatcaaaaatttgaaaactcaaaacagaaatcattcagagaattcagaaaatagacaatttatttcatatgaactgattagaaggaatttcagaatatcatatgaaaactatatgagataaaaaattacaatacaagtcaaaatgaaatcatcaagtgtactcatcaagtgtactgataatatgttctttgttttgattgctaaatgtttgataattaagtgtactgaaatatacttatgctttgttttcacaggtttgacagatgagaatttgaaaggttttgttggaggtaagaacagacttatatgtttatataatttaatgaggttatgcatacaactgttcattaaaaaaaattactaatttttgaaaattctatgtatacagaaacagcgaaaaaacaacagttgattgacttggatttaaacaaaaaaatttcacaatcaggtgaaaaaacataaattttttatgttgtttatttcaatatgaaatcagaattataatcagaaaatctcattcaaacaggtttacaattaattgagcaaaattacaataggacaagatcatttataatagatgcaaagaaaagtagtacacgatcaagtactgcacagtcaggtaagaacggaaaaaaaacatttgtccatataaatttttatttcattgatatgtttaaattaacttagaaagaaaacatatgttgtgcaggtattttgaaggatttaagagagagagacaaaaacattgagaagaagccaatatcaaaagatgaaggtaattgaaaataaaattacataatttcttttgactaattgtattcagagtttggttttaaatttcataagaaacaaacatcagattaattcaatttttttaataaataaaggacttgggttactggagcaaaattataatacgatgagatcatatatgcttgaagatggcaaaggtgatacaaaaactggtaagaaacataaatttagaaccattaaataaattagaatttaacaataatctgtctattctattataatatgcaggaaacactcaaagagattcagaaattgacaagggaaagagaatagctgttatcgagaatgtaaaaacaatggaaaatgaaagaattcaatttgaagaagatatgttaggtatatatatttttgactacacagaatttgtttttttgtacatattttagattgttttattttttttcaggagaacaggatatgaactatgcagaagaaatacatcaaaccaatgttctatcactattggatcaagatttcattgatgtaattatacattgtcagatatcgtatatttgttttattttgatttggttttaatttaattaatatattttaagcaggataaatttacttcatacactagtctaatggaacatattatatcttcacaacctacaagatgcaatgatttggaggtaatttaacttgtactctattgaaaattagaatttcttcattttttttgaattgttttttaaaaactatttttattctttgcagaattcgatgtgagaaagcagcagcacaaatgttgacttcaattataatttggtgaatgaggtattaaaaaaatttattatttgaatatatcatttagaaaacattaagattaataaaaaagatcaaaaaatcattatgttgaattttacatgagtgcaggttgaacaaaatggaaatgattctatgcagactgtcattgatgcaaaaaaatatgtctgaggtgattccagaaattaattttgaagctcaagttgattctgtacaaccttggtctctagatttgttcaatctacaagaatctattgaggtatgaatttttcatgaatatgtatggttcatatcaattaagattgatataaagataaattttcaataatgtaaatttatggtccaatgtttaattacagcaacagagttcaattcagtctagtgataaaggcgaaagtactactgaagttgatcctgatttgaatgaagaatttctaacagaagaagatattgaacagtttctagatgaagaacaacaggaagcatcaaaaggaaacaatgcaagcatagacagaaaatatattccagagttgaatcagaaattcaaatcaatagatgaggcacagaactacttcaatttttatgcatacatggctggattttctattgtcaatgctcacagtgctagaacattaagtaaaaaaagaaatggagaagttattagagaaacattcaaatacaacaagtatgtgaagtcggattgcaataagaaggaagaaacaattacttctgaaaggaaaacaaatgaagtcatagggactgaatgcaaatgtgttcttgtaatcagtgagaggaattcgatttgggttatatcgaggatagatttagatcacaatcatgagctcagtcctccagatgaggctagatttctaagatctcacaaatacatgtcgacagaagaaaagattctaatcaggactttgaaagaatgccatattccaacaagaaatatgattgtaatattatctgttctaagaggtggtctaacttctttgccttacactaaaaaggatataagcaatgtcagaacatcaataaacagagaaacaagcagtaatgatttgatgcaatgtttgaattttttgaagaaaaagcaggaagaagatcccaatttcttctatgagtttgatcttgatgagaatagaaaagtgaagaattttttttggactgatggaagatctagggagtggtactacaaatttggcgattgtataagttttgacacaacttttttgacaaacagatataatctgccttttgcaccatttgttagagtatctggacatgggaacacaatactatttggttgtgcttttatacatgatgaaacaactgaaacttttgagtggctcttcagagcttttttgaaagcaatgaatggaaagcaaccaaagacaataattactgatcaggatggtgctataagggcagcaatcaaaaatatattcacagaagccaaacatcgaaattgtttcttccatatagtctcaaaagctctgaagagatctggttctctattcaagaagagacaaggtctttatgacatatacaatgatatcatacacaactcattgactgaagaagaatttgagtttctttgggaggatatgattcaagtttttaatttgcaagacatcaattttctgagaaacatgtgggaaatcagaaaaagatttattccagtgtatttcaaaacaaatttctaccctttcattcaatcaacagcactaagtgagggtacacacttagtgctgttggcaattacacaaatcaaaaactgtaattacagagataaaaaactgtaactgatagtagtctatatactaatgtaattaaatatagatttgcaaagtctagtcattcatatcatacaaaacataaagtagaacatctcaatcataccatattactgcacaatattttcatctgaacagtcaggttaaaaagcacaaaaacggtataattatccttcactcaacagcacaaactgtactttactatacttatttcagtactcttcactatacaactgacaaataaaatattaaactgtttgaaaaaaacagtaacatgcagtttcaaacatatacaatataaacaatagctaattaaaatgaggagaaacaatatcaaaccaaaaaaaaagatttgaaaagaaaattggtaagcaaaaataaagacatataatcaaacctattattctgttttggcacaggaggataaatcactgagaatctgttgaaatcaatagagtgatcttgaacataaaggttccaggcaagactaaaatttgaaatctacaaaaaaaatattaatagaagttaaattttgtagatgaataaaaaagctgttatgaaatatttacaaattcataaatgtatataaaactaagtataccagtttaggtcttaattcagcatgatagaagctctcctcatcatacaatgaatccagaaaaacaaatctttcagatttcaaatcaatgacaaatacgaaccagtgacgactcttgacaattgggaaaaagagctgaatgaaaacaaaaaaatacatgaaaaagaatttaagttatataatgcaaaatttagagaaaaaaagtaagaaaataaaccaggtcacatgtgtgaacatgtcttgctagtgaagctccatcaaaacacttctttacagccgagatatttgtcatagaacggtccttaaggagatcatcctaacattaacaaaagaaaaaaaatgagactgatattatttgttaatgtcaattatttataaagatcaatatagaaaacaactacacaactacagtttctgtcatattaacttgcactacaatggtattatttcataagaaaaaaattaatactaaataaaataaattacagtcaatttctattgcaattacagaaaacaaaaactgtaattacagagataaaaaaatgtaactgatagcagtatatgtactaatgtaattaaatatggatttgcaaaagtctagtcattgagatcatacaaatcataaagtagaaaaactcaattgtaccatataacagcaaaaaaatattttcctctgaacagtcaggttaaaaatcataaaaacaatttaattatccttcactaaacagtacaaaaactgtactatactatacttattttagtactctttacaatacatctgacaaataaaatatgaaaaaaaacaagagacaagcagaccctgcataatcctagtaaaatcatacataaccagcgagcaaacaaccagtaaatcagaacaaacagcaaaacagaaaagtcatctcaccaaaaaaaaaatcataacttaaaaaagaaaaaataatcataaattcaaaaaggatgccatcagatattaaagaaacacgtcaaagctctgcaacatcatcagacaagaattttaattattctttttaattagtataattaatattcttgcctgatgacgtgctgaacttagatttgcttaatgtagaagatatttatcatcatctggcgaaaagaaaattaaaataatgaaccaaaaaaaatacaaaaattatctacactgtagtacaaaaagacattagaaaaatcaattgactatcaatcaccactaatgttgtaacaagagtgcagaaaaggggttcaaatggaagtttttcattgtgtgattagtaagtaaaagtctaaacatctaatatgataagcaataaaaattgtaattcttggttgatgaagcagaagaagaagatggagagaaacacatcatatataataaattacagtcaatttatatggaaattacataaagcaaaaaccgtaattacagtaatacatttcggtaactgggaattaactatagattaatgtataaaaatgaactgttaacaaaatttgaatattgatttgcaatgtctactaaatcagatcatacaactcaaccaatataactactaaaacaaacatagaaaataagaagttattttacttagaagggcatgtttccttgcttcaagttaagaaattctttctttttgatttccatgagaccagcagggatgtgagcagacctgaatccctcacggaaaatagtccaagtgattggctcgtcaggaggaatgagagttttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcaaaggagaaatgaggtggatgtgttcgttgaacatctgctagcttggagggtgcttgattggcctgctgtgccatggcagcccccatgttttcagagttcgctaccatcctttcaaaaagtcggttttgattagccaggagttgagcaagagatggttcatcatcatgctgttctgcagtggcagcacggcgactacccccggcacgtccagaagaatgtaggccagtgcgaggctgactcgctccctcaccattggcatcatcagtaagagcagccatagagcgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttccagtacaccattctatggaacttcggagaatccgatgggaggttgaggcactgtggttgacggagtggccatagtcaaacggtattgtctcccattccgctcgaactcatagaatggccccagcagcaccggatattatcaattaataatcaaatagacaaatattagattaaaaaaagaaactacactatttttagatacttactcttgaaaattactcttgctgatcttgcaaacaacattataaacttgtctatcatattgtgtcactggaaaagaatgtctctcagggctgtatggatctgtatagtatctagctggttgtaaaattcttctgagatcatgttttggtttttgacttgtgctgcactgtccaacagatttatcaacattgcacaacagaatcctctcaggactgcctgtagacatcttcaacttcttgtctagtttaactacaaatgtgttgatcttattgtacaaaacattagtcttcgaagttatgtcaaaacaattgtctggacattgtttttctccaagaaatatgacatcaggtgaatcctaaataaaaatagaagaaaaaatgagaaaaaaatgtatttattaattttaaacattgttcttgaaccaaaacataatccactacatttcatttcaaggtaaaaacagaattacatagcttcaaatggcagaaacaaaattttcaggaaagcacttttgacagcacaaatcaaacagaaaaaaaatttcaggaacacacttttgacaggcacaaatcaagcaaaaaaacaatcttcaagagcgcacatttgacaggcacaaatcaagcagaaacataatcttcaagaatgcacatttgacaaaaaaagataaattcataatatattagtaaaacaaaaaaaaataaaaataagaaaacatacctttttctgtagttgttcaatgttcaagttttcctcttcattatgttgagtcaagatttcagtatcggtatcctccaaagttatcattactaacttgtcctgtgaaatattaaaaaataaattttaaaaaagtattataaatgtaaagctttgtacaatttagaaagttacctcattagttgaatcgttcaattggctttgtgaatcatcatcgaaatcttgtgacaggtcctttggaatgatctggattaacataaaaaaaattttgagatgaaaaaaacagataaaaaaacatataaaaacatacaaacaggacaaaaaagaataaggaaccattacatttgaattgtcttgatgtttgggtgttacttgagtcctgaaatgtttttcttcatttggaaaatcatcatctgaatcccagattttaaagctaggcttctcatgacccaagaatattgattttctttcattgaaaccaacaatgcttgatattgctttctttggagaagtattactgagtcctgtttccaaatttagaagtaatataactgagattgataatttgggaaaaaaataatcatcaagaaatttaaatttaaaaacaaaatatataaaatagaaaattgaagagaaactaaaatttacctggcttggaaagctttttcataattccatcaacaacagctattttatcctaaaaaaacaaaaaataaggcatatttaatcaatatgctgacataaagaaaatctaaggcagcaacgtattgaagtttatattatgttttgcttttcacaaaaatttaaataaagattataactaaattggaatgttcatatcaactaattaggggcaaagctagaagttcataggaaaaattaaattatatattcttaaagaattacaatctaaaatatgtactaaaagcatttttaaaagaatctacaaaatttcaaaaatcatattacttcaacgagactaaactagcaaacccatcaaaagtagatattgtacggttagaattcagaaatattgaaagcaaaatattatacagttagaattacctttggagaagatgatattttcataggagtttgctcatttccaattgcattatcattacaggtattctggtcttttaccattgaactatcatcattgaatttactcttgtcatcttcattcagattaacatctacataatttaaaagacaaatgtatatatttatgagttgtaagttagacaaaattgaaactaaaagttctgttgttgctggtactaaaagtaaaaatgcagcgattaagaagaaagaatatataatgataaataaatattgaacagtaaacaaaatcatattcaaaatttaaaaacttactagtgttttcaggaacaattggcttgctattagataaaagaacaaagacatctacaagaagattctttgctctttcatcaatgcagttctcatcaggaccaaaatgttgaataagcaattcattgatcttgtttttcatatcttgagttaaatcagcaccaactgaagaatcaagcatatctagaaagcttctctcaataggtttaacaggaacattttcttttacatcatcacttccaatctaaaaaaaagagagataacttaaaatttaaaacatgaaacaattattttttttaaaaaataagaaatagatttataagtttaccattttgtaacagcactcagaaaaatctttactggtcttttgcataaacaccttgctgattttatcaaactttgaaattttttgatcattgacctttccaaacttttattcttggaacatgttcaagtactaatcgcatacaaaaatcagaaaatccaaaataatcaccttattcaaataaaaattaaaatgaataagtanctggcagaaaaaatagttttaacaaataattgaaaaaagagagagaaataacactaaccaccagacaatagaagcaacctccaaaagtttttgacttgtcaagcttgctcagatgtttcattaaccaatcaaagacaagactgctccaatccaaattgtcaatacaactaagatcttcaaaaacactcagatatttcgtgctaggttgaagagaagaatttgggcacaggaagcaattcaaggatacaatcatgaaacacattaagatttgttcatcagacattgtttcatttttgataagcttctctccaaaatatttgacagagggcaaagaagagaggccgaaagagtcaagaaggatctgtttgccaacttcaaaatctgaactaatcggtaaacctccaacatgcaaacccaaaacaatatgaactgattctttggaaagtggaatgactttatctctaacgatgatatcacaagaggtgacatcaactctttgtgccacccataaagcaaatttatatggcacgggacatttttcaaagagtaagagagttttgaaacaggttttggaaataatctctctctaatgttcagacaatgaagctagcacatgagaaaagtatttcacagaaaaccttgtcagtttagtatctaaagttgcagcactcttcattggatttttctgcaaaagaaaagatattttcattaaaaagtttttacataaattttgaaaataataaagacaactaataacatcaaactaatttaccttgcttttatgagaatagagtttccttttcattccatttagaacattatctctatatatctcaagcaaggctgaatccaacttatttttgaaatcaacatctactgtttcggtttattttctctatcaaaaataagagaatgcaaaattaattttttaaaaaaggagcaagacaataaaaggggtaataaagaagagagaaatacaaaaaaagtatgagaaatgcacaagatctaatatgattaagattctacattattggaattgttgtatagaaaatgacatgtttcaaagttcatcagcagatatcaaattcaaaaactaaaaataaaatgcttctacctttagacaagcagataatgtatcccaattaaaactctacaaaccacatttatgtggagtgccctttttacattattttctcaaaaatcaacagcaagacaagtactagaaaaactgaatgtgagcacatattgacaattaatgacataattgcagcaatgctctaagaatgtagaattgatattgcaaatttcaagtattgaaaagaataagaaaaaaagttaaaggtatagctaagggatataaaacagaaagcaaaagccaaattacagtcaattacagtgaatttatatggcaattacataaatcaaaaactgtaattacagaaaaaaaattatgtaatagagagaagtctaaaatttaatgtataaaaaagcaatgataggaaattataatagaacatataacttaaactaaacatagtgttgtaaacaaaaaatgcaataatattttgttaccttggaagtgccttcatcagtatttttcttcttactcaactttcttttcaaagagttcaaaagttcatccttagaaattccaacataactagattcggagtcctacaaagaaaattaatgaaatctaagaatattcttacaaacaatgttaaaaaattatttcataaaaacaaacctcattgtcacaaaattcatcatcatttggagaactttcatattcagaagaaatagaatcaccaaaaagatctttaatatcattaggattacccatctattaaaaaacaaaaaaattgaattaaaataagatagagaaatacacaaagcatgcatatcagaaatcatatatacagtcacaggttcacatcacagtttcacaactcaaggttaaaaaaatgtacagattttaacagtaacatgcagttgcaaatatatctaatttgcaaagtctagtcagaagcacaacataagagctaaatcaaagcctatattgcatataaactaaaaaagagggtgattcgtcaacattcgcacaaaaaatacagactacaacactacaagaccttcgcaatcttgagctcaaatcacaataatggcacctccaattcgaccacatccacttagtgaatcaccaaaaccacccccacgacaaacaccacaaaacgacagtcactagaggccaggataaatcactaatgaatcattgctgaataaatcattcaaataaataactactgaatcgcttgcaagagctcaagagggttattgagtggattagtgagttaacacaagaaacagtatccattaacagattcaagcaaaatgctgcatttgttaattcataaacaaaataacattaggaactagtagtttttggtcatgaatgcaaatgcaagtatctctggaaaatatgtatgaaaaacagataaacatgcgctgcagttcttaatgaacatcataacaaataggctaaaattctaaattaacggcagaacaaacagattctgcacaacatatgagaacacactaagaaaaaatctggatgacttgtgaatgacaggaaggaattggatactcaaacaaaaaaggggaataatgccattgacaaaatgacttgtaaatgacagtagactagatcttattttgtatgaacaattagatctacacctaacaacctaaaaatatcattaacatctaagccataagtgcaaaattagcttctgaatattggatcaaatgaaccatgtcactgatttggattaaaaagtacttctctaccttaaaacagaaataaaacaaacaacaacaattgtaactcaatgtctcataacacattcagtaactggatcaataaactacatgattcacaaaataacagatccactgaatccaaacactcaaaactcacctaagataccagcttcaaatctaagcctcagccaaaagtaacctacaatccaaaacaaaatagagattaaacctaaaaacaccacagaaaaaacaaaaacacaggggaaaaacctaaaacgttgtagagctgaccagatctgagactcgaaacaaaaataaaacgaaatcctcacgagacaatcacgagttcatcacgagttcatcacctactgcacatgctacgactacacaactcatggagttcatcacgtactgcacaagctacgcatgttccaaaccctaacccgtgttgtccgatcaaacaacaacagtgaaatcctaaaaaacaaaaataaaacgaacaaatcaaactaaatcctcacgaaacaatcacgagttcgtcacgagttcgtcacctactgcaaatgctacgactacacagctcatggagttcatcacgtactgcacaacaacagcaaaaacacgagaaggatggggaaggagacggtgtagagcaagagagaagnaaggggnngctgntgtgtggtttgttggtgggcccctgcccgttttggtccgccccccccgggtggtggggntgtgttaaggtgggtggtgtggggtgggggtgggtgtggttttnnttccctcccccccccnngggtnttnnnnnnngcnnnggcagtcgtattgatttaaacctcgggggggggnggggggagaagagttatgagtgaaatatcnnagtaggncngtatatagagggaannacgtgatatggtgctagtctagatatgacg

SEQ ID NO: 24593 - DNA, 771 bp, Oryza sativa
  unsure (1)..(771): unsure at all n locations
catggcccatggaatgcntntcgagctcggtacccgtgcaagttaatatgacagaaactgtagttgtgtagttgttttctatattgatctttataaataattgacattaacaaataatatcagtctcattttttttcttttgttaatgttaggatgatctccttaaggaccgttctatgacaaatatctcggctgtaaagaagtgttttgatggagcttcactagcaagacatgttcacacatgtgacctggtttattttcttactttttttctctaaattttgcattatataacttaaattctttttcatgtatttttttgttttcattcagctctttttcccaattgtcaagagtcgtcactggttcgtatttgtcattgatttgaaatctgaaagatttgtttttctggattcattgtatgatgaggagagcttctatcatgctgaattaagacctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24594 - DNA, 782 bp, Oryza sativa
  unsure (1)..(782): unsure at all n locations
ccgcgcttttgattgtgnaacnnnnnnnnnnnnnnnnnnnnnnnnnnnnnnnnnnnnnnnncatcatgttctcctagttcagtaccattatgagctgacaacttctctgaggtagacataggtgtggcaacaggtttacatcctgacatacctaccctttttaacagatcagatgcatacttttcttgggttaacaaaataccatcgcttaccttgttaacctctatacccataaaatagtgcagatcacctagatctttaagggcaaaatcttgttttaaatctcttagcaacgcttcagctgcatcttgagttgaactagccacaattatgtcatccacatatataaggacaaaaatagtcacactccctttactatagaaaaataatgaagtgtcagcctttgatgacttaaaaccaagatcacatcatttactacttagtctagaataccatgcccgtagtgcatgtttcagtccatataaagccttgtctaacttgcaaacataactagacttactcttattctcatatccaggcggttatctcatgtaaacctcttcttcaagcaaaccatgttgaaaagcattctgcacatcaagttgtcgaaggcaccaacccctagatatagcaatagacaaaatagctctaatagtagcagccttaaccaccggactaaaagtatcctcatagtcaataccatacccgttgttaaaaccctttgcaaccagccgagctttatatctatccaggctaccatcagcttttcttttaaatttatn

SEQ ID NO: 24595 - DNA, 780 bp, Oryza sativa
  unsure (1)..(780): unsure at all n locations
ctgcgcttgacnnccnnnnttttgatnnnccnccttggtacccgttcagcgcaaagtttggattttggttgaaattggagatgatgtgactgaaaagttatgtgtgtatgacaggttgatgtgatggaaaaagactagagtttggatccaaactttgaatctaaacacaggctaatgcaagtggttcagctgaaaatagtactaatgcaggtggttcagaacctgcagcaaatacacacggcgcagaaaatgaaaacagtgctactgctgctggaagtaccacagccgaacctgcaaatggcagtggtggtggcaagtctgcgagtcgcagtagcagcagtacagcaataggtagcagtgttactgctaatcagtcggttgatgactctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24596 - DNA, 3342 bp, Oryza sativa
  unsure (1)..(3342): unsure at all n locations
ccgcggctttgatgtatactcctnnnnnnnnnnnnnnnnnnnnnnnnnnnnnnnnnnnccttttcacaccgtcacacgagtactcatcccttaggcctaatcggtttagaagggattgagagaaaataattccacacctcaataggtgtggaacaaatcccatcatatccctgcctaataatatcggtctgtcaactatcattggataactggaccaaaaccggccaccgaacaacgtcgatgcgagacagatagcacagtactcctactatatacataaactcctctgaaactgatcaatggagcaataaggtcatcagacagtaatcacctcacctcacccacccacccccaccagctgatgaaagccacagcacaagcaaaatcacaaagctggtatacagcacagcagctcagacataccctgaatattcattgatcattattcactcatgtaccagaaacatttcttacacgacaagggaacatgagagagcatatgaacaccagggatcaataaatgaatgaatctagtgacaaacaaatcacatcacaggtggtaacagtagtagtattaattcatcatcaaccaccagcacaaatcaatacattatccaaatacaacactaagaaccagttaaaactgtgggggagaaaaaaaaatactcgagataatagcgagctgtaattcacaacaatggcattttagaatctcaaacggcaaacacaatcatcatcatattcttcctagtctacaacacctttacacatgtggttttttcttcttcttccctttatgttacaaaggccaccctccatcaccaggtgaggtgagggtgtgttcctcaactcctgaagccaaagttggaccacctcctcccagcatctttcttaacacgctgcgagttggtcacgaaaaggttttccagcgatttctgcttcctgttccgggaccgccctgcctccttcagaagctccgcaagccttagcttctcgtcctcgacatccgggtttgctgtgccgagcttctcttccctcaccttaagtacgtgttccagtatttcaatggcgtcctcaaccctgaaggcaaaagggaaatgcacttactcatgtatcaagttaaaatattggaaatctaaaagaacaaattctatctgttttctttttgcacagggaaaaacaagttgtggcaattcctaaatttatagatgcaacctcacaggtatataagcaatcaatacacccactcaaaaaaaaggggggaaaacagcacgcctgtaagtttggaaatcgactgagttgatgcaaatcaccgcaggttaatagcatttcaatgaatagtttatatcaggcaactttataaataattggacagttgtaatcatacactggcatgcagcaacatgtgggcaatttgatggtggtccactaaactaaatgatgccttcatttatttgttgattgattgcaatctctttgttaatgccatcgaaattatgcaaccttacataggatgataatctaattgatcaaccaatcttgcctatccatccaaataatactacacatgaactaaccgcctatccatccaaataatactacacatgaactaaccaacattcaacatttcacggattattagaggaggaaacccataagctgacaccttcagatagcaaaacaaattcaggggattacttctacagctgtgaatgataagggtagatgccaacataactcaataagcatattcaggtgcttgtcaatggcatttcttggattttccccataaccatcaagggattgctaccaagatatgatttgatcctaattctatatgaaacagctgttggttgaggaaaaaaaagtttctggtatgaacacatacctgcccatagcatcgtagattgcagccaaattactgtagacgccgagagtatctggatgagaggcaccacactcctgttctagaactgcccttgcctcttcaaacaactgtgcagcctcatcaatcttgaatagctgcacacaagctagccccatctggttcaacagaactccaaaaaatgccgacttcctctccccgctagctctcaatttggcaaccgcattttcaaatgagttccttgaatcggcatacctccctaccatgtagtacaacacacccatttgtgcctcgatgccagcaacagtgctccactgtcctggtgagtcctcaagcaactttagtgccctttgcaaaagcttcagtgcctcatcaaggtctccaagcgcctcatagatggcagcaatctccattaggcctccagcaacctcatcaggggcagcgccaggcgcgggctttgcatagacacggagtgcattctcacagtaggatttggactcgcggagccttcctggtcggtggtaaaggtctgcgaggcggacaaagacagatgcaaccgaagggtggtcatcaccacgggcagacttgagtactgtcaacgccttctggtaggagaagacagcctcgtcgaagcgggcgagggcaaggtaggtgttgcctatcgcgacatcgatcgtcgcgacctcaatgtcacgtccattggcgaccatggtcatggaggcaagcacaaggtgctccagggcaccatcatagtcacccttggcgtcaaggatgagtgccatcaggcggcggtcggaggcctcctcgagcgaagcgggagcgctgtgctcccggtggatctcgagggctttgcggcacaacttctctgcttcatcgaactgcagggcttgcacatgcgcttccgccaaatacctgctcatagtgcaaaataaatgttgtgttggtcaagtgctagctcttgcagattattgttacttctatctctactttttttttttttgcataataatgcgatggacttgatgaaatttatggcgagatcggcggaaatcacaaaatagcagagggaaattaaaaaagatgtcgcttttgaagaggtagattggagttgaaaagcaaaatggcgtttctaacttttaagagaggagatctagatcgagaaacgggcgagaaggaagggtttttgacctgcaggtctcggcgacgcggggatcacgctcgccgagcgcggccatctggatctcgaggcccttgccgtagcaggcgatggactcgtccatgcggccgagcatggcgtgggtgtcgcngagttgcatccccccgcagaaggggggaagggcccactcctcccccttctgctggtcctcggggggttgctcctccgcngagctctcacctcagccgcgcgaagcgaaggggcgtncgagggggtcaagtgcatncatnttcattcacat

SEQ ID NO: 24597 - DNA, 13210 bp, Oryza sativa
  unsure (1)..(13210): unsure at all n locations
cgtttagccagccccagttggaagtcaaaaagggacacactggttgcccttggccttgccttgcttgcaatgaaaaaaaaaaaaaaaccggcccgccncgggggtttgggtggcgtcataatgaggagagcggcacgagtaattaggcagcggttgatggccaagtttagtcattaatcaattaattaaggtcctcaaggtaggcaattaaggtggctgggcatctctctctctctgtcgcccaagtcttctcgtgtacctagttgattcgtgtactacggcctaaggctacaatgtactgtggctgtgtgcctgtgtgatgcgatggtgaatgggaatgggcttgattagggttgattgtgttgacctgtctcagaatgacaggtgggccatgcgtggttagcttgtgattaaggtgacaaattgttgggggtcttcatccatcttgatcgctgacaaatctgcctggtgttgcaggcatacagagcataactgagaaaaattattgttacagattactgctccctccgtttaatgtttggactttagagaaggcgtcatttattgagagtatatattttgacaaataaatttaaataagtggcctagataatacactaggaaaattatatttttttaagtgtggagcaaatatttcgtttaaatggttcagtaaataatctgaaaataaatgcttgacttagctactcacttgtctattgtaagtgtattttccgaaccactaaacgatgtatttataaatattttttacataaatatttctttataagtatcaaatattttgttcacgtttataataattagtatttaattgattacatgttaatgttaatgattttctcgtttcaagtatcgtcttgacaagcacagggcactactacccccagctcaaagctctgaaagttcgcttggtcggtatcgacactgatcctatgatatctgcttctacgttcgtatacattagcatgtagtttaattaattatatagtacgtacagtacagtgtatgagaaacattataattaagtagagtaggaggaaggattaaggaaggagtgcattacattacgcatgcatgcctacttgcaagttgcaaccaccatcggaagaagagatacaacgaaaatgatgaaatggatcatggaggatcatcagagctgtaatgcttccctggcatgcacaccctgtcatgaactaattagctcgatcatcacactgtatatgtttgtatgtcctaatcattgttttcggatccatccaaattatcctgacagatcttaaaacacagcccatcacaacgctggtttcgtacatggatatgttcttttcagacaccaattgctgacagtacattagtgtactccataggttcatcttgctgctgccattacttgagtgtagacaaagaaaggagaattattgctcgtgcatgcctcggttggtccgacattttcattgccattcgagcaccctatggattacagactgacagttaaattggttcgctaagtgtgatcagtgttcagtaacattttgctctgttcttatctccaagttcccaacccatctccctcgttttccgcgcgcacgcttttcaaactgctaaacggtgcgttttttgcaaaaaatttatatatgaaagttgcttaaaaaaaatcaaattaatccatttttgaaaaaaaaattagcaaatacttaattaatcatgcgctaatggagcactccgttttccgtgcggggagtttagttcccaactccccctatccgaacacagtactcctccgtgaaacctgtcggtgtaaaatccgaagagaagttgtctaacatgttggtgggccttgggcctcgtcgtgggctttagatttaggttgaggcccacttatcaacaacaaatagtacaaaggccacaacaaggggatgacgaactgccgctgctactcgccgtcgccgtcgccgtcgactcctcgtcgccggcgtccccaaaccaagcaaaatgccatctccgttttttcttcttcaccaccaccaccaccggcttttccctcgcttcgcccccttccgctccccctccccccgaaccctatcgctgcattctgctcctggcctccgccttcggcttcgggtttgcgccagcgcccgcggcggcgggggcagcacacgggaccacgatgacggcgcgcggtccatcccgatagcgcggtgctacgaggaagccctcgcgcgccttgacctttcgggaaccgggcggcgggagcaagcggtcgcggcggcggcggcggccgatgaaggcccggctgccgaggctcacctcgccgctgtcgccgacgccatggtcatggaggccttcctccctggacccgacggcgcccggcgcagcgccatgtccacacggctggtgagcgtttcggggttccactcccacctgtccctgtatcttccctttgctgatttgctccacacaaccgattgatgatgagaccaatgtatttatttgttcccttacttgtttactgcttctgcctagtgtgatgctcgaagttgcgtcctaaattccacccggactcagcatcccatcagaattagtgtaacgcacctatatctatttactctaagctttgatgctttattttgcgctaaattcggagtattggttgctctggatttcgtcatttcatacatattacgtgaaatgtttgttggcatgtacacagcctattcaccacacggtagtacatatgatttttaagaacctgtacagggtgaaacaactaactgtacatgctaagttcaccatgtaaaattaatctcttggaactattggttggtactaggagtccaagtgcattagtgactcagtgtctcagcgcaagtggccggctgggaattttatgatacaatagaggtgcttgtacttgtagcttaacaacaaatcagtatctgtgcttttctatcatgttgtgtctaggaagagaacttattgccagttttgtatatatcgaacatggttagatgctttaatttcgatcggaatgtctgtccttgttggatcatgaggaagttctggcatttcattgtagattttgcaagcaaatgaagttacagagaaggccagtaagctaaagaaagaccttggcactgaatttttctctgaaaacgaacctgatgcagagagtgttttggcaatggcctttaagcaagttgtaatggatcagctcacaaactttcggcttgaagtgttctccccaggttcagagatagatctccaagatttgagcaaaccccgaaaggtgttcctctgtaaagtttgggacttgtatattattttgtttcgtttgtttgcttgttgctaatttgtggatgcacaccaggtgcctgcggattttagtatcagatcatcagatgaaaaacttctagctgctcttgcggaagccattttctcctgtgtcattgaggatgccagaaataattacctagggggcactggtggtttgtttcataagtggaagtcaaactgctcattggattcctctgtttgcatagacataatttctgagtcagaagtagtgaacagtgctaggaggcgcttagatagttttgatcttgtacagtcttctcatgtagcgggtaaagcaaagaatggatggtggccagctccaaagtctgaaaggttagtgaagattggtggccctgattttatgctttgggccagtgagtttgtgtacacatataaactacaaattgatgccaaagcattcaagaatacaaagcttgggggtcatcatgtgttagcaaataataagggggaagttctcttatcccacgcccaaatggtacattattattctctccttgtccttgatgtatacattacttgttgccattcttatttattgtatgctattctccatctcccaaacctgtaggtggagttagcaaatattctggacatgtattttgaagatcagttcacattacctggaaaaaccttctattccaactggaattcagaaccatcaaagattaaaaagaacaatgtatgctgctattttttatttcagagcttacttgtgttaaatattttttttttatttatgttcatcaagcattttttttggtgcagggttatttgaacaacctttttgctttgttggctggtagctctattgtttttcttgtcggcgccattgctcagttatgctggcctcagtctcttaaagataaaagattggccactgttagttcatgtgtctcatcatcacagagctattgttctgatatccactctctagatagtagtgaggtatgctttctagttcttgaaatgttgttgcttgcccagggagaatcctgtttgtttttaagtgtggaaacactttggtattttatactattttctggatttttttttacttgataacccattcacaagacattgatcgtcattgtgttgtaatttagaaataactactcaactaattggaagtgtcccaaaccttttgatagtgcaatattgttctctacgtccaaatcaaagaaaaggaaacaagctacctcgatttttagttgctctgggatattttgattgtctgcattatcctatgcaacatagcatgtaagagccgctgctttaaaaataaaggatctctaagaaatggtctgaaactctgcatgattcatgtagaagtcatttcatcaacttgttatggcttcatgatgtgtgttcccattaggaacatcatgtagcatgtctcctttttgaactattacccttttgccagcaaacctagttgctgtttaaatttaattaagggcatatctggtgacaaatctatcataactactttgttgattatctaacatatctgttgtatgcaacctatttacccctgggcagttgcaggcttactgtgtatctgttgttgagaaaattaaagactcatttggttgtactggtgatctaatggttgatgcaaatattggtgcttgggttggagaactgcctgaattcttcaagggcatcaactgtgacagtcatgatgattatgtcgatattcagagtactggtgctattagccaaggagagcaaccctcattggtgtcaagtcctattaagatgtcttctcatctggaacaaaatgatgacactcaagaaactctgcagaatattgctagttttcaggtatgctcatttcctgcataaaaaatctctttgtatcagatgaagaacttggtatttttggtaaaatgatgtgcctaccaactcaaatgtgtatttgccattaacatagttcatgaagagggttaatcaccataaaagagattgatgacgatggtttggaagtagaactgaacctaaggggtagagggttggcaggctgaggaacttggctagggaggatagactggaacatatggctgagatggacttggtgctaacttatatggtttcgcttttatagggacgacatctaacaatccattcaaacctttcctttaaatataataattctaccccatctgataagatcatatcctatctccaattaaacctaagttgctagctaagcaatgtgttgcagataaatattgtaactgccatctcacaccagccctgatgggcccgtgacctaccttatggccatatgcagttatgcacataacaatatcactgtgtgaggtttttagtctgtctattttatattgcaaatttccccaaaatattcatgctaacaggtttaccacacatctgtttatgatgcactgtcactacacattttcagtacttttaagttaccatgtcatttctttatttggttcctgtttttattgttcaatttcctttcatgcttggtagcaaaatgcacttgttttgccatctttattattctaaaacaattgattgatttaagttttgctgttctttacattaatttcctggttttcttattttcagcagcatatatccaagatctaaagtggatgttctataaactataataccctgtttggcatatattcatttgttctttggacataactcatcagtcatgactcaaaagaaagagactacactttctcttttctatttcgtttaatactatgaccacaatgaaattaatcgtttaccttgagtgttacaagatagcacaataagactgcaaaataataatgttttcgttcttttgaataagttgtttgcagcatctgttaacttttcctgcaagttgggttgcacgaatcacccaatgccattgtcttatacttttgaaactatatgatggtagaagattacacttgactttatgatggaaactattgttctattgttcatttccttgagttaaatagttcagacttacactatatcacccttttttgatacaaacttgcaggtggtcatgtcagaaagaggtaaagtagttggatttcagccaacaaaccgcctagctgtgaatcattgggcaacaaatccattaacgaagctcctgtacgaggggcgaaagatctctccaggtaccatgattgaagtatcaaaccatggaattttattgttaatacctgtgctaaagctgtattttgtctttgcttaatactatggtatggatattgtcagcctttctggagcctaggcttagaatttctcgcccagctaaggttgtcccagttgagttgctgatgtcggtgaatccagaatccttttttgctttggtgaggcctgttcaagatccatgctaatggaggtacttttcatttctcctccagttgttctccatctactaccctcaccctctcttctctctcatgtaattctataatcgccagtactttatttacccagagttctgtagttgctgtcctagttaaagctaatgtcatttgttgtcacccaatctatgcttatcttacccttaaaacaggattttacatgctttgtcattacatggtgctgtacagattcatgaactttttaaacatagtagactgggcagttttcttgttggttagtggatgcattttatagtaaaggatatggaattataaactctctaaatagtagctttactctttgtcttgcatgcgcttgcgaatcaaatagaagaactgcaagtaggtgttgcaagctatggaccatgaatcattgcagcacaggctctcacgttggggttctctatgtggttaaagcatggttgaatcgatccacatgtagaagttatcagttattacttcttaatgactccaatccagatgacacaatggagtccctttgtggaatatcagcaccatgccagattgcaatacagctattcgtgacgatatgctgtctgttctgctcatgttggagtttatcatcggttttctgtttctgaagtctcaggtaattaacctcgaaccttctgggtaaattctttttatcagtagtaacaatggtagctcttcatcatcggtatcaggatgctcattttgagttttttttttggggaagaatttgcctcaagcccattttccagtttctacagaaggctggaagcaatttcattttgcgtaatcaagatatcacctgctagacaactttgcaaactaacatacaccctgtaagagttgtcaagtgtacaattatagatcacagtgaaagtagaatgaatggtaaccacttcagttgacatcataggtcttgggcgtctatgatgtaacactctctttcgcacacagcatattttgtatgaaaaatattatataatcgatctcttctactgaactattgttctatgtgctcgtatgcaccacagtaaattaggatgctaaattgatttgtcgggctgcaaatctgaattcacaatcgtgagctaggcataaatttctccaattgagttcattatcacttcctctgtgataatttggttcattctctccgtgtggtgggcagcatcccagtatatgtacttgctgggatgtgtgcatgctcttcggcctctgcatgtttgcccaacttcaataactcctgttccacaacaacctcttgaggtttctgtcaggcctgtagttcagaagaaaatatttttttgaggttataataccaataagtgcacactttaataaggatgctctgaaatataggacaacttaccatagttattggggcttattgttgccatgccgatggttgtataagtatcaacaaatgtagccctgatatttggttgattctttagaagacgcaccacttcaactagcctctcattaaatgaggttgccagcaagttcatgttttcatggcatctggttgtacctgtgcctagcaatgttctagcaataggtaaacacccaattgggggcactccaacaaagacaaatctccttcctccaagtgctgccatcacctgagtaacatggcaatgattaggtcttgagcaaaagttgatataactcttttctgacaagtgcttacctgggtgtagttagcaacgcgtgatatcagctggttttcgtactgtgggccgctctctgctgctgactggtttgaggcaagatagtgaaaaagcagatctgttgttccagcacttacgacgaatgtagccctcctgactagttcttctgctcttcttcgtccaactaacctctgcaggttccttttgtaacgccaaaggtcctctatttggttgggaaatgacagtgcattctatcatgaaaaaggaaagaaaacctgtcatgacagttcattctaccatgaaaaagaaagaaaacctgtctagtcactacccaatgctggccctcaataatcaaattaacttggactactaagtagtcatgattcacatatcaaactaggttgatcatgcattatctgcttggttatccaattttgactactaaaaaatatttggtagtagcttctaattctgtccctggcagattgatttaatagcttttccttactttctgacggtgaaatatttgtgctttgcaggttatgcttaccgaacttctggcagtggcctcgtcatacccggaacctgctgatgcaaaactcacacccctcctgagctgtcctgacctcaaccttgggtcgcggaatcctggaatactcctcgctatacctagtttttccgctgcataaccacaaagcttatcctcaaatatccctactgaacaatggtgaacaccactactaactcaggtcaccttctaaatcaaagcacatctgctcaactctgaaatacttgtgtaaatggagatgcaaggcaatgggtgtatttgtgtctgtaccgagtatgtccgtgatgagccggccgttgctgaaccggccggtgggcctgccgccgaggaagtcggcgccgtacggcaagaagttggccttcatcgccgtctgcagccggttgttgttgccgggatccaccgtcgagtcaccgaacaccagcatggtggtacacccggtggtggtgtagttgatcaccctcgccggcggtggcggcactgaagaccagcccggctcctgcggcggcaccaccgtccgcggcggcgccggctccctccttggtggcaatggagactgccacggctgctgctgctgctggggcggcgttggtggtgctggctccggcgtgtcaggctcctgtgatggcggggaatccggcagcggcggctccggcgaatcggaataccccggcgacggtggtgacaccgggagcccaggcatgggcgggtcgtcgtattggtcgtccggtggctgtggcggtgacagctgcgccgctgccattgttatcagggagaagtgccatgcgacgaggagcagcgccgccgcagccaccgccagcctcctcatggacttgctgcgttgctttgctcagttcagttatgtgctagcttgtcaaggtccaaagacaagagtgcatgcatgtataaataaatgctcagctaagtaaaactgccgttgcctgtcaaggtggcttggtgccatgtaggtaagggagcgactaagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaaattttttgcaaaaaacgcaccgtttagtagtttgaaaagcgtgcgcgcggaaaacgagggacaatctccccaaacactcacaaacgaacggtgcctaaatttgcttaagagttcgagcttgctttgtgtgacatgactaaatttagaagacattttcagtgaaatcacccacttgttagtggccagtgggagattaatcgggagagattcttgtaaaaaaaaaaggagatcggaataaccaaagaggcacatactgcaaaattgcaaagaagagcaggtggtggttggttcagtggtttgtgtgatctttgcgtctgccatgcaaattcgctcttctagaacaatcttctttttttcttttttttccagcgaaaaaggtactgtgattttgtatttcctccttctatagtcaacaacagatgtcaaaatatgcatattcttcctccggtaaaagaaatacagcgtttcaacatttttcagttcgatcttttaaaattttgatcatcaataatttttgaaatgcttattttgaaaatataaaaatggtcaatgtagatttgttatgaaaaaaaatactttcgtaatctcataaaaatgatacatgtgtagattttataagtacctagccatgaaattgattttcttccttcacaaggtagaaccgaaggtaaatactgaaaataatagcaggagagttttcttttaataacaattctcaccatcatggcatcgtctgcttcaaaactagtactcgcaaatccatattcctctagaaacaagtaaacaaatagacatgtcacaccaatacacccaattgtttactcataagggattactcgcaaattactcgcaagaaaattccatttattatgccaaaggacatgagtgtcaaaattttgacattaattaaacaaaaaatgcaaacatttattatgccaaaggacatgagtgacaaaattttgacataaatgcaagagcctcagctagacaaaattgtcatttacaaaagagagtcctacatttattctacgacaaaattcaaaggaaaaaaaaactcttctaaatgtctatcctatcctaaccttggaaatgactgaaaaacaaaaaacccaacttcttcacgttggaatccggtctgcccacctataggcctgtagggatataaaccttcaaaaaataattgaattcttcatacctctaaattctaatatgataatttttgtatactgtatgatcttttggtatcatgtcatgcactctaaaacctaagaaagatgatctaaataaataaataaataatgaggatcaatttccctcatgcttcggctgcttattgtcattagagctggtgccctgctccaatgaggccttcacaaatctgcctctgacacgccttcgcgtgtctgctgttgccttgcgggaggcgtacattatctgcttgacaaacctgaaaaattcaaaagtgtaccagcaacttgtaattgcaatcttgtttcaaaaagctcgtactgaacaaaatattattcctaggcaactaaataatatttcagatgcacatttgagaattttaactgttctttctgaagactaatctgcaatgtaagctacaaagtgagacgaaaaatgcgtattgatacgtacctcctgttgctctttttctccttgtatctctgcacagctcgctgtctcttctccggatcagggcaagatttctcgggcagcacgatatgcgaggtctgttgatcttggccgtcaaacatgtttgagctcccacccagcagcgagcccgtgttggagctctgaaaattcacacagggaaactctgaacctgtgttgttgttgctactgtttgtgtctatcaccggtaactgatcatatgccgtttcgtcgtttatgttcagtggttgcagaagactatgatctgaagattgcggtatgagctgtgcgagttctgaagatgaagttgctgctcctatctcgttgttgatgttcgcgtccatcatcggtaactgaacataaggtgcgttgctcatgttcagaggctgcagaaagctagtatctgataacagtgcgatgtctgaacacgatgaggatgccatttgctgatgatcagggtccagataggatcccaaatcgaaataagaaggatccaaatccagataagaaggttcctgcgatcaattgaagaaaacaagtttgtgaggcggcatcaaactgtacgataattttgatgaatttgaaagggggtgaaataagcagaaccatcgtttacttgcaatgctcctggttccattagtgcgactgaatcaaacgagtttgtccaggcttgaaagtaatcttgctgatttgcattgtcaacaagtaaatcttctccacctattgtcgccatctctttactaatgtcaggattcgcatcttcaaacatctcaaatgagacatgtgtgtatatatatattagtatgcttatgttaattgaatgatggtaataagatgatatgttagtcatataatggaatgctatatattaatgggattgatcaagggatgaattaggtaaggaaaagaaatgcaactcacttttgtttaagaaggcagatcacttagagatttaagagtttaccattggcttcttttaataccagatcacttatttttaataccagatcacttagagatttaaggaaagaatgagtttaccattggcttcttttaatacctcgggataataacaataatttgtatagctcatactattgtcgtaggggacgaatgggagtgtgtcggtgatccacggctcatccgtcgccgccgtcgccggcggcggcggaggtgcggcacgttgatagagaaaatgcgggccatttttggcggggcctggggataccggtgtatgctgacgctggggctgttggcaaaagcccgaggcactcccccgcccaccgagggcaaaacccctttagcgttggggaccggagcgcgccaccgctggcgccgcttgacaccgcttcataaagggtgtaccatccggtctcaatcgcggtcatgtgtgtgtggatgct

SEQ ID NO: 24598 - DNA, 12871 bp, Oryza sativa
  unsure (1)..(12871): unsure at all n locations
ggtgtgtttgtggattgacntnctncntnnnnnnnnnnnnnnnnnnnnnnnnnnnnnnnnnnnnttgtcagtagcacacgcatctaggcggcggcggccggtgcgcgccgcggtggcggccaccggcggcgatcgaggtgagcgtaacgtggcggacgagggtggccgcagggatcgttggatgggggatcgatggacctatttatagccctcgatggatttagtgtgttaaatatagtacggagttgttagcaacagaactaacagaccgacgtacggatcggttcatcatatccaccgactcaaacacgtcacagtggacgccgatacttcgtttcgtggtacgtacgtttagacacgatcagtttcgttcccaattataggaaaggttttcctttaaaaaaaaattagtataggagagcacgtaccatgccgtcttttaaggttcagttttattttatttttctgataaataatccctctatacaattatcaataaaatcaggtcatatctttgttcgttgaaaagatatctcctgactttgtgtagtttacagttataccacggaccccactttactatagtccacatgttacgcgctggaaagcgatctcctgattttgtgtagtttacagttataccaccaacctcacctacatgttactgcaagtcggccggtctcttcattcgtctccgttcggtttttggttttgtcgccgtttttcttttcaatccttttttttttttgcacgtggaagggtttttatgggtggacccgctttactcccgttttttttaccatccggtagttctttcgtcgctggtttttccttcgatctccagccgccgtggagccgaaccttactgcaacttcgatttgcctctcgatgtttcttcctccaattaattaaaaaatcgattatccactcatttctcattattttctccatgattttgtctttcaattcgacttaaatttggaaaattatatccctatttaaccgttagtggccgtctttttcccgagttttttcaattcggctttaaatcttccctgatttccccttttaattcgggaaattcaattcctatctagagcaagtacaatagcaggttacaagtcaactataagcacatatatgaagtagaagagaggagagtcacggctttaattcggggaattcaattcctatttagagcaagtacaatagcagaatacaagtcaacaagtaaactataacaccatatgaaagagagaggagagagaaagcgtgctacagattggtagcgagctactacacggattccaaaagttatatgtgtataagaggtgagactatatattaataatatagtaagcaactattgtatgagttgactattaaattggttataaatgatttggatttagtagttagctatactattaaacttttgctcttataagtaactatttgatagaatgagctattagattgactatagatcatttggaccccactggttggctatactattaaacttcctctcaaccatttggagccggtggttagctatactattaaaacttgggagaatttgaaccatgccacacaaaattttgtaaaatttgtgatatgccaccctgacccacatgtcattgactcatgtgggtcctacatgtcattgagatacgggtggcatatctcaaattttgcaaatataggttggcatggttccaacaaacccaatccgtggtagatgatgtccggcaagcgagcttcctggccatctttattcccgagttttacatattttgattttggaaaaaaaaagggaaagagatgattgagtggatcaaaagccctaaaccaattttaaattttaataaataaagaaagatcagaggtgattgagtggataaaaaccctcaaccaatttaaaaagatcaagaatgatccaattttaaaacatctttgccgaatttgatgggaatgatggcatcggcatcggcatcttatggacagtatgtgcgagctgagccggcttctctcgtggactggccgtaaagagactgaaaatcgtggactgggccgtaaagagactgaaaaggaagaaaagattgggctttagtccaaaccgggactgaaaatgaagaatttattagctttcagtaaaaaaaatatttttcaatttatttctcacctcccaacaactatatattctatttctgaaaaaatatctttacttattacaacgactgacatttttcatagcattagagaaaaaaaaccatgcatgattatgtgttgcaaatgctccttactcccgtagcacggatgaatgatttacgggattcagttttatctaatttttctcattttatctgatttttgtatcgagttcttgtttatcgtaagaggatttagtatgaataatttcacattataataggtgtgaaataaattctctaaatcaccctgagattaactgaacaaaatcacccctggtgtgaaattaccctcaattattttttgtgtgagagattaaccgagcaaaatcaccccaatccttttgtgtgagagattaaccgaactaaaatcacccctcgtgtgatagattaaccgaacaatgcaaaatagaaaaatatccccaaccatatatactccctctatttcaaaatgtttgacaccgttgactttttaacacatgatcgttcgtcttattaaaaaaatttgtgaaatatgtaaaactatatgtatacatcaaagtatatttaacaataaatcaaatgatataaaaagaataaataattacttaaattttttgaataagacgaatggtcaaatatgtacttaaaaaatcaacggtgtcaaacattttgaaatggaaatggagggagtatggattaagaaagacacgttaaggatacaaggaaccctaacaaacattgtgtctcaaaacggcagcaaccaatcgtagacgcgatgatggcccacgtaatctgatttggttatacaaacgtgttgccacactgtggcagcctcctcctccgtgtacttgtgaacgctccagctaattttgtcatacacgcctagcacactagagtcagtgtcataacgcaagctaccacacgtagctgataagtccgatcgtcgccgcgcgccgcgccatggtgccgtcgttcccgcagccggccagtgcggcggcggcgacgcggccaataccggggagctacggcccgccgctgctcggcccgctccgcgaccgcctcgactacttctggttccagggccccgacgacttctttcgccgccgcgccgccgaccacaagagcaccgtgttccgcgccaacatcccgcccaccttccccttcttcctcggcgtcgacccgcgcgtcgtcgccgtcgttgatgccgccgccttcaccgcgctcttcgacccggccctcgtcgacaagcgcgacgtcctcatcggcccctacgtccccagcctcgccttcacccgcggcacccgcgtcggcgtctacctcgacacccaggaccccgaccacgcccgcaccaaggccttctccatcgacctcctccgccgcgccgcccgcaactgggccgccgagctccgcgccgccgtcgacgacatgctcgccgccgtcgaggaagacctcaacagggcccctgaccccgccgccgcctccgccagctacctcatcccgctccagaagtgcatcttccgcttcctctgcaaggcgctcgtcggcgccgacccggcggcggacggcctcgtcgaccgcttcggcgtgtacatcctcgacgtgtggctggcgttgcagctggtgccgacgcagaaggtgggcgtcatcccgcagccgctggaggagctcctgctccactccttcccgctgccgtcgttcgtcgtcaagcccgggtacgacctcctctaccgcttcgtggagaagcacggcgccgccgccgtgtccatcgctgagaaggagcacggcatcagcaaggaggaggccatcaacaacatcctcttcgtgctcggcttcaacgcgttcggcggcttctcggtgttcctgccgttcctggtcatggaggtcggcaagcccggccgggacgacctgcggcggcggctgcgggaggaggtgccccgcgtgctgggcggcggcgacggcggcgaggccgggttcgcggcggtgagggagaatggcgctggtgcggtcgacggtgtacgaggtgctccggatgcagccgccggtgccgctgcagttcgggcgggcgcggcgagacttcgtgctgcggtcgcacggcggcgcggcgtacgaggtgggcaagggcgagctgctgtgcgggtaccagccgctggccatgcgcgacccggcggtgttcgaccggccggaggagttcgtgccggagaggttcctcggcgacgacggcgaggcgctgctgcagtacgtgtactggtccaacgggccggagaccggcgagccgtcgccggggaacaaacagtgtgccgccaaggaggtggtcgtcgccaccgcgtgcatgctcgtcgccgagcttttccggcggtacgacgacttcgaatgcgacggcacctccttcaccaagctcgacaagcgggagctcactcccagctaagctttgctgccgccattctctcactcgatctccatgcacatatgcatgaagaaattaattaaattcaagttgctagctccattttttctctttgagctgctgataaaaaaaacatctctattcttctgtgcaataagccaataattaagcattaatcagagcgtacaagtaaaaattgttttcactgttttatgtggatatatatatgtacagggatccaccaaaattaatttgatactacgtagtacgacatttgtttagggatcaacgattcacgtttcacttttttttacagcgtcaacatatataaacacatagatatgagagtatttaatatacttattactgacatactcgcttcgtcccataaaaaaaaaccaaatcctatgtatgaatggagtattctagtagtacagtagtgtaaaaaaccgccaatagattgatcctgaatttcaggtcaaggagacaaagcaactactccatagaatcatagtattaggatatgtttcatccagtaaaaaaatatatttgaagatggggagtaagaaacacgaaacggaaaaacgagtgaagaagagaagacatttcagggtctgcttgtttctgatgccaaaagcatttttttagataatgccaaatgcgtggacagaatgcttgttctaataccaaatgcatggacagaatggttgataggtatctgcttgtatcttgctcgatggaaaccgcatggacagcgacgcatttcttctccttttgcatgttactactgaacggttgacacaggatatattactggcgaaaaagtacatgttaacatgggttcaaacagtaacacgcatttcaatcaagtgtgcaagtgcaaacacaaaatgatcgtctgtaaccgtagcgcgtaaacaacaagacgtacagttatactacctccattccaaaattttgacgccgttgacttttttaaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagggagtatatgccaaacatatccctgtatggctatattgattggcaacaaatacagtactattgatcccgtgttgtgccaaccacaacagcgacaagtatcctgtcaatttgtggtgctaacaacttgccattgataagtccagattaactagaatagacgcaccaaggcacatacatgtaaatgctagctcctggataggcaaaattgatccaaagaccagctaaactgccaaatcgttgggaaagtttacataaatgtgtctcccttgcaggtaaacaaaaacatatagtgagctgaagaaggctagttcttcgtgcaagagatcagctgtgcaatcctcataaaagggatcggctgatcatagctgatgaagaaaatgaatttgttgatttcatgaataacagtggcactaaaaggcattctgaatataaatgaaaaatacagtgttagaaagacaccaaaaacaaacaaacaaagacttgcaaggaaaacagtacaagacaaacagtcaccatagttctacttctttcacatgtgaaacatggctaggaaaggaaaatgaaaacctagacatgtaggaattgagtatacgagaattgccatggtttgtaatttgtactctgtagtttgtaccataggcattgcatttattcatttactatggcaagagaagaacagagaaccaagagcagttcaagaatagatagcagtctgttagaggagcgagttcaatgcagaagagaagttataatcaattggtatggaaacaatggatgtatcaaatggcatcggaaaatgtcgttgctgcactcacatatctagctacaaaaaggacagatggcttgaaggaggagctagctacgtacatcatgatggtattattccaaatacaatctgaaacaggtttgtagcctgagtttaaatgataaaaaaaggagtaactgaatataattttaaatggttggtttgccaagtcagtaagctatacaagcacagcaatgtacaaggttatgaatatattaccaacaataatctgtctcaatgcagaaaacatgtcgaaataacaaagcacgaatgaacagagcaacgtctgtcatacaaaaaactaaaatttcttgtgtggtcttagcagagccacttatagccaacccaagtacagcgaaacgtagtcatggcagcttaatttctcaatgaaattcataacaagcacatgttcattgattattaattaaacatgttttcttttgctaaggcaggtaaatgtacctgcccatgtttgcctctatattggaattaatttgtttgttttctttccatataaaaaagtgctgggaagcttctattgcatttgtatacacttcttatatattctgtaaattagttaacttattattattattattatctcttacttatggaagaaaagtaattaaccaatgttgcgtgtcctcacaaggatgtgtttgttctagttctcgtaaaaagaaaagaaaagaaaaggaaaggaaagagaggaggtgggtttggcccaactagaaaggcatctcgtacgtaagcccacttagcccaactagagaacgttgtaggggttgcgggaatcaacagccgccgggagaggttaattagggttccaaacttgcatggagcgagagatcgagatgagcgagatggagacgggtaaggcgatcgagttggtgttgaagcggttggatgaggtgcgtacgcgcatggatggggtggagaagctgttgcgtatactcatctgcagggaggagaagcgagcgaaggttgggaggaggaggaggaggtcgacaagatgcagatggtgacggcggcggcaggtggcggtagcagcagcaggaggaggaaagccatcaagagaaactttaaggctaaagaagcagaccgcaaggagacggaagaggagggcaatcaggtgaagaagatcaccagccagcagctgtaagtgtatttaagtactccctccatattttaatgtaggatgccgttgactttttaacaccactcgtcttatttaaaaattatatgtaaatataaaaatacttatgtcaaaaattttatgcaaatataaaaatacttatgtcatgcttaaagaatatttgatgataaattaagtcgcaataaaataaattataattacataatttttttaataagacgaaaggttaaacgtttgtaaaaaaatcaacagcgtcatacattaaaatacggatacggatagagttttatctgtaccgatggatgatccgatccagctattatccatcatccattctgagtttattggtaatgatgatactactgatatggtcaatttaaccctaactagttagtataccaatgttactatgtgatatatctgggcctcccaaaaggaagaggaagaggaagaaggaagaagacgccagcgagaagaagaagaagaagaagcggcagacggaggaagcagaagcggagaagaagattgaggcgaggaaagccaaaaaagaggcgtacgagcggtacctggcgaatttctttgattttgagcccttcccacgcacacccgaccacattctcaacgagatgcccgaggaagagcgtgccggagaaaatcaacttgctgccttcgctgatagtattatggaacgtcgcaggctcctataccagagatgcatcaaggactacatggacaaggacaaggacgatcacgaatagcaagtgtcttcgtctgtctgtgatcaaagctactactactggagtatcctattctgagttggactgtatcgtatcgtctcacttcattatataataatgactatgtcatgatcgatgtaatcggcactgagatatattaatattaactactccctccgtttcaaaatgtttgacaccgttgactttttagcacatgtttggccgttcgtcttattcaaaaaatttaagtaattattaattcttttcctatcatttgattcattattaaatatatttttatgtaggcatataattttacatatttaacaaaagcttttgaataagacgaacggtcaaacatgtgcctaaaaagtcacggtgtcaaatatttcgaaacagaggagtatatattagtactaatatcagattcttctactgctgacttcctgaatgagacgaacattcgatgcaaaattagagaatggttggtagtacgactgagatagtcagatagatgatcacgttgggtgtgtgtgtttgtcttggagggctgaaaacgacagttaagcttagacctgctggccgccagctagactccattgtttcgcttatttgcaaacagaaaataatttgcaaataaaacttttatatatgtgttcttagtgataaaatgcaaaggctgaaaaaactacgattaaaaaaaacctcaaaatcaacttaaggttgttcaattttggtttataagcatacgcataagtcaaaagatgaggctgttagtgttaatttcccagtggccaacaaactgtttttgatcagtgaagaaattaattcaaatgaatgaatgacggagtattggagcttgcacacttaagtatcttagttacataaatgtacgagcatctccctcacagctaaacaaaaacaacgcaaggctagtccttcagttctcatgcaggaaatcagctacgtaatcctcgtagaaaggatcgagtttgaaccaacgtaatccttataaccaacgtaatcataactaagaacagtggcactaaatgaccacactctgaatataaatgaaaaaaaaaagcaccaaaaaagatcaagaagaagaagctgctgctttcaaggaaaacaatacacgacaaatagtcaccatagttctttcacatgttaggaaaaaagaaaatgaaaacccaaacatgtaggaattgagtatacggattgccatggtttgtaatttgtattatgtaccatagacattacatttactatagccagagaacagagaagcaagagcagttaaggaatagagaaactatcaatgggtaattcctacatgtttttatattagaggagcgagttctatgcagaagagaaactatcaatgggtaattcggtattggaaacaaacatgtataaattgacatcgaaaaagctacaaagaggacagatggctttaagaaggagctacaagatgcattccagccaaacttgaaacaagtttatcacctgagtttaaatgacaaaaaagcagtaactgttcctcgagttgaatgttcacaccaaaagttggttgactggatcacggcaaatgatggatatgaaaaaaaaaaaaaagggtgcagaaataccatcaaaatgacttatctttaccatggaacctggaggcaggtcgagctaaaaaacatacatatctaacaaaaatagtacaacagatacacatcatgtaactgaataaaattttaaatggtcagtttgccaagtcagtaagctatacaggcacagcaaagtacaaggttgtgaatatattaccatcaacaatctgtctcaattcagagaacatgtcgaaataacaaagcacgaatgaacagagcaacatttgtcatacaaaaactgaaatttcttgtgtggtcttagcagagccacttataaccaacccaagtacaggaaattgtagtcatggcagctcaatttctcaatgaaattcatagcaagtacatcttcattgattattaaacatgttttcttttgctaaggcatggtacataactaaatgtggggtttctaaaaaaagaaaaggtaaatgtacctgcccatgttgtctcccaggctaaaaaagaccacttggccaatagctcagcaagcaaaaacaaaagaaataaaacactgctcttcaattcaaaaggaagatagtactatcttctcatgaatggataaaccgctacgcacccatggcaacccgtttgcccctcttggatgttgatgatgcattctctgccaatatcctagacaaaatgtctgcttgctttgagtaccctccagcttttaagctgtccatcagggcatcgcaacccttttgatccacgacacctcctttgttcttgatcttgcaaagcatggagtatgcaggcaatgtcttctcctcagtgtacagggcctccaagactctgtcataggttgagaagctgacatcaaagtccctgtccaatgcaaaatcagccaacttatgtgcctccatcactttgtcattctcgcagagggcaatcagcaacttatctagatcaggcaagcatccattttccaccatcagattgacacggccgattgcttcctccacatggcccctcatgaagagagcttccagaatcttatgagccatgtccatgttctctgtaacccctttctcaatcatactcttcataaccctgctagcagtctgaacccggccactgttgaaaagcgctaccatgacagacatgaacagggatgggctcggtacatgcccttgttccatcatactgtcaagtgccgtctttgcatcagctggctcattcttcttcaggaagctatcaacaagcagtgcatgcgattcagggtcagtacggacaccacggcgtgtcataatggcaagaatctcctgtgctgcttctggcacaccttcctttgcatgcccacggataagactgttaaaagcagccttgtcatcaacgcctttcttcatcagctgcctgaagaaagtctcagccttgctggtgttcccattgctgcacaaatactcaatcactggattataagctggcccttcaagcacagggctttttgggctcaacagtgtccccttctcaagaagctcatccatcaccttaacagcaccatcacactttccacccgcgcacaagcttttcatcagcaccccatactgtcttggatccacaagaacatgcttgaactgcccactcttctggtgcacatccaacgcaccatccaagtcacccgctcggcatagcgtcgtcacaagcctcaaaaacactgacttgtcctttggagtgagccgccgctccgccatgtcatccattgccttccgggcctccacaacccttccctcatcatcacagagccctggcatcagagcagcaaacgtcttctcgctcaacctcaaccccttctcccccatttccgagaacagccccactgcctcctccaccttacctgcttcaacatatcccttgatcatgacattgtacgacaccgagttttgtgcaaaaccagctcctggcatttcgtcaaacactttgcgggcactctccagatcacccgcccgaacccaagcattgagaagagtgttgtacgtcgtcacatccggtgtcaccccgtgatccttcatgtccccgaacaccctcaaggctgcctccatcttcttgcacaggccgaacccccagatcaatgtgttgtaggtggacaggtcaggggtgacggcgtcggcgatcatggcgttgtagatccgcctggccatggcctctcggccgcggcagaggatggccttgaggacggcgttgtaggagagcgcggtgcgggcgatgccgaggtcgggcatcaagcggaagagcttaacggattcctgcgggatgttggccttgccgtaggcggcgatgagggcggcgacggtggcctcctcgggggcgatggagaaggagggcatggtgtcgaggaggatgcagcgggcgtggttgagcatgcggtgggaggcgaggatcgggatgaggagggagaaggtggctggctcggggctgaagccggcgcgacggtaggcgaagcggaagaactggagggcgaggtcggcgcggccggcggcggcggccccggagatgacgccgtggacgagcggcgcggcgagcgtcggggagagcaggcggatggagttctcgaggcgggtggtccacggccggcggcggatcatgtagaggatggtctcgtggaggggctcctcgcggcggggcgggttgggggtcgccgccgccgcctccgccggcgtcacctccggcacagcctcggcctcggcctcggtctccgggggaggtggttccggcgtgtcgagggtggagaagaggcagaggtgcttatccagcacgcg

SEQ ID NO: 24599 - DNA, 1524 bp, Oryza sativa
  unsure (1)..(1524): unsure at all n locations
cagggccttgaaattgaagaatcgtatccncgctgcctgcangccgactttananganccccanggngcggagnaaaaaaaanngnnagcacaaaaancnaacnnngaagaaactggtcagcataccagtagaagttgggcatagctgctaattgcttcacattcttgatgttcttccacatcagtttgcatgttttcctcctctgccttttcttcaggctgcataacagatttgagaagtggctcaatatatagttctcaatatatatagctgcataacagatttgagtagtcgctcaaatatatttacctttctcttttttgttttttgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctgcagctctggaagccaaaggaagaaattgctggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacaatcgacaactacacgacacggtctgatcaaaagggttggcagtcaacttgtgctcatcttcaagtatgaactgatcatcaagtgagccaattgcaattatgaaatcattacttccatttgatcctttcgtataggcagccatggatttcttttttttcgccgggccggcgaatagccggccgatgtatattaagagtaagaaagggaatgtacaaggtagcgcggtgcgtcaatgcaccaccatttcagacataaaatgaaagctaaaatctcacagaatgagttgctacagagtgacacatggggctaacaagacctgcagctatccaagtctcccattcatcccccatggcggaacagccatggatttctcatattcggcttggaagacttcaaataaagcaggtgtgtaaagcttacttgcctgtaccaaaataggtgtcatcatcataattcttggcaaattctttcttgattcatattcagattgcaattccttctctctcttttcttcaacaacacgctctacacgattaaggaacctgccgatgtcaagatctgatttctaatgacctttcaagttactattcaaactttcacttaattgtgtgcttcgcatccctattgtgaaaacatctgacatgtagtnnnnnnnnnnnnnnnnnnnnnnnnnnnnnnnnnnnnnnnnnnnnnnnnnnnnnnnnnnnnnnagactggtgtatacacgaagntcaaanncacacg

SEQ ID NO: 24600 - DNA, 695 bp, Oryza sativa
  unsure (1)..(695): unsure at all n locations
cgtggcgcatgaacttgtattgccagtctnnnnnnnnnnnnnnnnnnnnnnnnnnnnnnnnnnnnnnnnnnnnnnnnnnnnnnnnnnnnnnattttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatttagagccttccaactcctgctctgtttccttattgaccactgaattgactttatccagtaaatcaaaaataaagttcttcttaaacaaacacctaagttcgagaagacaattcccgcaaccacctgcattaagtgggcatggtatgcttcccgtgctttttggccttcatattaaactaggagtgcaatcctcttgaagagctgcactaactatcaacctgtcattcctgtgatcagaagcccctttgactacagcactgctatgactact

SEQ ID NO: 24601 - DNA, 3590 bp, Oryza sativa
  unsure (1)..(3590): unsure at all n locations
accttctctgtgcgcgagttcctccgcgaccagtcaggctgtgcgtgggaccgccgaacctgggtcctccaaaactggagtgcgtcgctccaggtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagatcagccgagccgccctttctctcgggccgcgccctatccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttggaaaatcagcagctgacgggatcagctagttcgtggtggccacttgaaaagttgttggcccgggtggccgtttgaaaaactgttggccgggtgccaaccttgttctaagatctaaagattgatacattgcacatactctgaccggacgggacgcactgtctcaaccgtgtcgtttgagaagcactcacctagatgtttttagaaaagagttcaaataaaatcaattacgaaaacaacagccttcccttgaagcctgcattaaacacttatttcccctggcttgctgagtactcccgtactcacccttgctctatataaataccccccagttgctgatgaagatgaagcggaccctgctgatgaggagttcttccaggagcaagccggttacgatgacttttagggtttcggcctagttcccaagtcgcgcctgtgttgtttggtccaagtcccggcttccgtttcccttttgtaatgcagttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaaccaatttttggctaacactatagtctaattattaatcattggtgatctggtgtgactcgaccagagcattttccggttgcatccgacgtagatccttcggctggtagctgatcgtaactagtaggtgtagtacatgttcgatcgatatctgtacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatagcagaaaaatgtacagattacctgctagctgaatagatggcaacgttatcagccgtatcaggcaaaaataattccatcatgggggtttgatgaattggtcaggaactttgaagggannnnnnnnnnnnnnnnnnnnnnnnnnnnnnnnnnaaacggaggtgcatntcatttcatcgcg

SEQ ID NO: 24602 - DNA, 2956 bp, Oryza sativa
  unsure (1)..(2956): unsure at all n locations
actgtccnagttcgacatacgatcttcaagccccnnnnnnnnnnnnnnnnnnnnnnnnntgaccttttgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgtccaaataaaaaaaactgaatttaaatttctatcatgtaaaatccggtaaacggccgttacaagatttgacagagtccgataatcatggacaaacaggtttcaactacttattccctccatttcaagatattagcatttttttttctaggattcaaaattataccataatataaatatttttgggacattgattttagtatatgaaaatccatgtattttcaaccaatcagaagcttaggaagagaaccaaagccattcaaaatttaaattttgagtaatgagacgaataaaaagaatatttctcatcaaccttaatctttgttaaacaaatcataaagcttatattttagaacggagagagtaggtggaccgatgcacatacaaacccgccattaagttgattggatgaacatgaacagcacgagaggaacatttcatttctggtcacatttgagcagctactcgctttcagatcaaatcttccattaatttcctgttccttgtggtttctcagtgggggcatctagtctcagtcgctgacgagccaatgcatcgaatgggcgagcatgattagattattggggggacagtggtgcccattgcgaagtgactaatgttcatgatattcgatcgagcaaccctggagtaccttctactcctactatactatccactgatccacagctattagctagctgctcagatgattggaagagtccaagaaaaactgtaatgcctttaacatcggtcaatcatagatggttggagtggattgggactgacaaagagacattatccgtcagcaatctacattgccaattttcttttcaggcctgaagatgagacatgcattagtcacagagaagattttcaggatttcactagtccttgacagtttttgacagttactagatgcaaaccacttactccctccgtcacataaaaaacagttgccggcaacaaatatagatagagctatcaatttttggctacgaatataatttgttcttttttaggaaggagagtataagcatgaatatgaataactaacagtaagatgactagaacctagatgtccatgctgcatttaagtccaggtgtttgcgtctgggctctaagctacttttcttggtgcagatgcatgctttgcaacttcttcctccttgagctttaggaaagaaaaagaaaagcttaattgtatactataagcaagaacacgttcggttcagatccattttgattcctgagatctcgcagagcgagatttgtcatccggtttatcgatccaaagtgggcgttttcccactaatcttttcatcatcttcttctttctgaacctgttgacatcaaaagggagaaaagaaactcgatgtactcgctcatcttatgttactatcaatcagaggcagagatgatcagatgaagcatcatcattcaggcatcctgctcgccactgcccatacatgtagaccatctcctggaaagaaaaagagatcaggcttcagtggaggcagttcgatccattttatctttctgaaacttcgtaaaggaggctaagctatctcgcagtttttctaagtctccggatgactcatgtcacattgtcacacggcctcctctcctttaagttggcaacgcgtgaaaaaaagaaaaagaacagtgtagtgctgccatgttagtagtactccaatccaggcaagtatcagtctactgaaatcatcatgattcaagccatttgcttgagacatatcaacttggcacggaacttaggttttgtttgatgaatagttagctggtgagaactttctacttctgttcattttctacttaatctaccagtagatgataatatggtctgagaaagttggaggttctaagataagctgtaactggacctcagtcactcactacactattctgtgctcacttctagccattgtggagtaatattgtactagatcatcagtgttctttcagaaaatgtgcagccgtgcatgctgatctgaacaatcctgaaggctgaagccaccaaatgtgtaaaccccccacctttatctgtcactactcactagtgcatttagtacttaattgcgtgattagggcgggggaacactgcacttaatggcatgattagtggtagtaattaagtagatcaccatcatcatcatcatcatggtgtccatattggagagagcctatggggagccaggcttttcaacggccctggaaacaaggcggcatgtccccccaggagtccaatcctgtctccacggcaacagctaacgtcgctctgcagtctccacacaccaattaatccccccttaccctacaaacctttccatgggccatggatgatgatatactcatatgcacccccaaccaaattaaccaacgtctcctcgacgtatatacctctccgccgatggaataaccaacccccaaccatgacatgttgtgtcacgccctcttgttcccctcacgtttttcgggaacgcgcaaaatnnnnnnnnnnnnnnnnnnnnnnnnnnnnnnnnnnnnnnnnnnnnnnnnnnnnnnnnnnnnnnnnnnnngatctgcattcaaaacgcgct

SEQ ID NO: 24603 - DNA, 1906 bp, Oryza sativa
  unsure (1)..(1906): unsure at all n locations
cgcgtggccaaagtgccngngacnctcntnnnnnagannnngggaattnggtacgccgtattaaaaattatgataattttagtaaattttaactttgtaatgtaattcaaatagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcatctgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaatgcgagccctagaaagataattcctctttttttaattcattttggtattgacttcgaaaaagctataaccaattattatagagtttgcagaactaataattgcgaattacagaattatagctttgattaaataatcataaagaagagatcataaacaaaacaagaaaaattactaagaaaatcctagaagaataacatctttcgtacgcgaatctggatatttgtgtagtcttttttaagagatcatttcaatccggttcgggaggctcgaatttaaaaaattatagtgaaattcgtcgaagttgtgagccttggtgatattcagagtggtgttttgttatccctttcttctttacagagcatgtaccatcgtgggctttagtctcgtgcaagagataagggcttgcgctcttgggccggaaaacattgggccgtttgatgacgccgttcatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgttccatccgcctcggccggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctagtgcgcgttgaacaacatgctgcggatggcggtgaccgaaaactcgctgttggccaacacctgctcgacgtagaagatggcgtct

SEQ ID NO: 24604 - DNA, 5592 bp, Oryza sativa
  unsure (1)..(5592): unsure at all n locations
gtgtgattgatttgcnnnnnnnnnnnnnnnnnnnnnnnnnnnnnnnnnnnnnnnnnnnnnnnnnnnnnnnnnnnnnnnnnnnnnntgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgtcctcgtgcatcgtctggtacggcgacaccgccgtgagcgcctgcaccgacacgccgccgaccatctcctcgtagctctcgaacgcgttgaagatgtggtcgctggcgccgcccgggttcgacgccgagtggtgcgcggcgagcatgttggaggcgcggccggtgagctcgacgaggtggagcgcgtagatgaagatcggcgagcgcttcgtcgggttggagagctcgagcagcgagatgatcgacggcacgttgcgggtggtgtgcacgcacgccagcatccggagctccgcgtcgtgcttcgaccgctgcaggttccgccgcttgtacccgaccagccgccgcgccggccggtacaccgtcgtcaccaccggcgtgaccagcgccgtcatggccaccgacaccagcaccatcacggcgaacgactcgtcgtcgagcacctccttgtccctcccgatgttgaggacgatcatctcgacgaggcccctggtgttcatgaggaaccccagggcgacgccgtcgcggaacgtcatggtgtaggagacggcgatgaggatggtgcccatgatcttggcgaagctggccatgacgaacacgagcacgaggaggcccacggtgatggggtcccggaccttggtcacgttcgtgcggaggccactgatggcgaagaagagcggcaggaggaggccggtgacgaagtcctcgagcttctcgattagcacgacgccgagcgggccgctcggcatgacgaggccgtacacgaacgcgccgaacacggagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgaggaggatgacgaggaggcgggtggtggcgacgatgatggcgacctggaggaggaagagggggagggagaagtcaagaggggaggcgccctgccagatgccgtaggcggtgaccatcatcggggagtagcagacgaccgcgccggcgccggtgccggccttgccacgcgacatctgggacgcggaggtggcgttcttgatgagcgggaccgcgccgcccgtgccccccgccgccgccgccgccccactcatgatcggggccatctcggcgcatcggcgcgtcgacgagagagagagagagagagagagtataagctggtggcgcgcggcggtggctgtgagcttctcgttttcgtccggctccccgtggcgcgtgcgatccgatccccacactgcctaattttgacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatattatactagtataaacatgcacgtacaatgtacgtttcataatatatatatatatatattaatatttgtaatattgtaccaaccaaatttatacatctcgtcgagacacaaacaaaacaaacaataggaaacattaatgataatgtggagaggtggtgccatcgtaccaactcactctcagttccatcatacgtgcatgtgcggccatgccaactgcctacattcctccacatataacttgcttctttatgcccatatccatcactacaactagttaacaacttataataataatgctgatatagtctcatctctgcatatcaaccaacatacaacagaagttgcacaaatttaggggaaagaaaaaatgttaaccaattttttatcggaaaggctatatggctatcgcatgtttttgttaggctgtatcattcgttttttggtcccttggattttgtttgagattcgtgctatctagacttttgttttcttttgtatgtgggcttttgattattgtaagttcgggcttccatacgtgggctaaatgggcttctttttttttttacatttttgtgggacccactttgtgttgccgacagagagagatttttttgtgagagtgtgttaatggtgggacccacatacactattcaaattttgaaatccgcaccggagagagagattgtctgaatcagactagagagagagagtgtgtgagagattcattttgctttttgcctttttcctcatcgtctcgtccggcgatttcggcggagatttcgtcggcgacttcgggaggcgacgacgggcgtaagctacgccgcggcgtggattcgtgcaggctacgtcgctgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatcttcgccacttctcagtctggtgctccgcaatgaatcatgctatacaaaaagtaaagccgttgcccacgcttgcttgtggctggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttcggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgattctatccaaaacgggcggccgagatcaacttgatctaccgcggttcacgggacaaggcgacgatgacatcagcggtgacgtcagcgatgatgtcatcaccggcgacggctcggccttgcgcgctcgtcggcgaacgacggcgcaacgacgcaaacggaggacaccaacgggtagaggacaaccacgggccggaact

SEQ ID NO: 24605 - DNA, 6322 bp, Oryza sativa
  unsure (1)..(6322): unsure at all n locations
acgcgtgactganaccttgatgcacttcnnnnnnnnnnnnnnnnnnnnnnnnnnnnnnnnnnnnnnnnnnnnnnnnnnnnagaaaagtcgatccgaatcgagctcaaatccgtcgatttccaaacgtaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcccgacaggtggggcccacctgtcagcgggagagagagagagaggagagcggtggcttggttgcgggccgacttgggccagggagggagagagaaagagagaggttttgggccggctttcggcccaaagccaaaaggaggatttaaaaacatttttctatttaaattattcatgaaatgatattccattgattaaaaatacttccttggctcaaataaatcccagaaaaatctaggaactatagaatcaagtaaagtatttaacaaaattttatctaacccaattttatattgagatttagcaaattagatcttctcttttaagatcatttctaattattccttttaaacaacaatttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtcgcggcagtgattccactagagtttgcggtgtgggcttctccatcttgtcctcgagctcctcctcctccttttctccggtgagtatgttttgattcttctccagcttcatttgttagcttgctgctcgattcgttgttgttttgctccgctagttgtgctccttttgccgacggagagagagagagagttatagaaggagaggttgacgatttcgtcgtctcgttctcatcgtctccggcgacgcggcggcgatttagcgaggcgacaaggctgctcttcggcgagccgactcggtgtctgctgctgttgtggaggtgtcgcaccgtcgattgcgcaagattattccagtggctttcctttttgttttttttccttttttgttcatttccatctcctatttagcatgctacatgctgttgtggagctaaaaagtaatgatctgacccggaaggtcggtacatttccaattgagctgttgaaaagcatctcttaagtcgatttgagacgcaagtctctttttgacccaaacttaaaaagaaataaatcacttagtgatttcaaaaatgttttcaaacaaaagatttgcaaaacaaccttgcctctcttccaagcttgcattaaacacctaagtccccgtgacttgctgagtatgaaagcactcaccttgctctatataaatatatatagttcctccgccttgaagtaaagatgaagtgaagtgaagattagggtttcgtcctggttcccagctgtcgcctgtggtgttgggtgttagaccgttggttccgctgctgctgctgttgctggtgtttcctcgtctgtgtcttcggttgtattctcaggctgtcttgagctgcaacctaagttaaggtaaataagtcctctatttattttaaggatttgcaatgattcatatttgtcaccgtgggtaccagcactatgtcctgggactggtactgagatcgcggtttcgtaggaagtggttcgcgccgttattcctacgacacgctcctgtcaggtgccgttgtacggcggtgccggattagggtgtgacagcatagtgagcgcatagggcagatgtgttgttcgcgcggtgcctctgttagcgtggggaggatgtggtggcggggattgcgcgggcgatggacgatggatggattagatgcggtctgggtgatttcaccggatggatggatgagattagattagatgacggacggacggtagggattgatccgggtgatttggcatgtaggattggaggggtacaactcctcctttttatattagtatagataagtcgtttaactttggtcaaagtcaaactactttaagtttgactaagtttatagataaatataataatatttacaataccaaattagtttcatcaaatcaataattgattatattttcaaaataaatttgtttcgggttgaaaatgttactctttttttctacaaatttgataaaacttgaaacattttgactttaaccaaagtcaaaacgacttataacttgaaatggaggaagtacaaattatatatgtggtgaaaacctagaaactatcgttggattaaaaaatgaaggcccgatatttgtccagatcatcaaaaaaaaaaaaacaacccccaacatttttactcatgattgaatttgcgagtaaaatttttattgtttggtgacatgaataaatcttagacgttcatatttaaattcaaaggcagttttctagatttcgaatatatatatatatatatatatatatatatatatatatatatatgtgtgtgtgtgtgtgtatggtttgcactatatattttcccattgacattcgttgtagccgttggtaaaaaaaaaaaaaacagttttatagaccagtcaagggacccagtggagtcaggtctaagttgtcgatcggtccggcgcgacggcggctgacgcgagaagattttttgaaggaaggagaaaaaaaaacgaagagagggtgttgtacgcggacgactcaatcggttagctcgcttcgtcgtccaccgtctccctcggtcaccgtcgccgcgcacgactcccatccatggcgatcgagctctgcccatttaagcccggggcgcctctcttcgaggacttgcaaacgcttgctgcaaggattggatcctctggcttctgttgatttggggagcttttcatcgtctcgaccgaacgggcagccgtcgagatcgaggaaggaggagatcgaagggcaaagtgatttggcagcggtggacatggatgtgaggtttgggcccgaggagcaaatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatcatgtgtgttttttctatttctccttttttttaatcgtgcgttacaaaatagccctaaaattttgctacaaatttgcatcttcacggtaaagctaaactgcctaaagtgtattttctctagtgagatgagcaatcccatcttgtatttacctttttagaggtcgaactactaaatcaggtttcggtttttcgttataaaaagaaaatttgtgaaatgttcctcagtactgatattaatttatgcatttctatcatccaacttttgagatccaaaaagggcaaagtatcaccatcaatctgcacttgacttccatagctcagtctttctgcttggaacgtcccaccttttcttcttcttctttttttaatgtaggaagaatagtattattcgactgtaaaaactcttgcaatgtatgcagaccagccattacaagtactgaacctaacttctgcagagagcaaagcaactaatagtgacagcttagttggactcgtagacgtttgttgaatgcaatctagccttgatactccctccgttcccaaaaacttgtcaccaaacactattcacaatcaaactttgactaatctttttcccctaattaatttataaaacaattcaaaatatattatattatcaaattaccttatgtgaaaaatataatcacacaattttccatcataagagaatctaacattttttaaaatattcgggaatggaaggagttgctacttgggtgatacatggtgttaaaaatatgaatgaattattacttttttttactgaatatgagtgaattatgaatcactactccttttcaattttgaagactacttatgtcagcatttagtaccacacagtcgaggaggtagccaacggaatcgtgccgtcaataatgcttaaggaccagattacctttataatttgtgaattcctccatcaccaatacggattagtatgtgaagagatataccagattacctttttcattttttttttacttgtcaaaaggctaggtaggtagcttgagaagtacatgcatggtaaatggtaacaagaaaacatagggaaaaaaagaggagggatcaattgttcctgagcctacatgatgaattcattctgcattatattttgtattatgccactgaggcactgactagcttctactccattcttataggtatatgatataactcgtgaagttagctcccggtgctacaagggttataatggactgaatgaattgcacaaacttgagtggaacaacaggtgattaattggagcttgcttgtttttctctttctttttctttgacaggtctttttcaataaatctttgacaggttcttattatcgactaattgcagtattatctaaaaatcaactaacagtagcgatgcatattcacttctcttcatgctagtaattacaactcgtttatccatgttttaggggattctctaccttccacgcattagttgctgctgtagtctctttttatctgctggtgatatctgacctcttcagtaaggacgtccatggtgccatcataattgatcgaaaatcatggatgtctgatgccatgtttggtgtaagtttgcagccctacgcatccaggaaaccatggagaaaagagagaaagatatctgtcccaaaatgtctgaaattttaattattggcaggtatccctgggctacttcttgacagatttgttgatgatcctctggcatttcccttctctaggaggaaaggaatatgtaagtgttaatgttctgagttgtccctttttcttttactacaatttgaggtgacacaagttaacaatctattctgattgtattgatatgttcagctcttgcatcatggattgtccatgtatgcaatctctcttgctctgttgagtggcaaaggacacgtgtacatcctcatggtcctcatcactgaagcaaccacacccttcgtgaacctcagatggtaatactcattcagttttcccaaattgctcattaatcatcttgcttgttcatgtctgagatcacaattattcatgcattctttctgaaaatgcaggtaccttgatcttgcaggccggaaggactccaagctttacctgtacaacggggtggcactgtttgctggatggctggtataatttctctttgtaaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccaataccttattgagtttttttttttaaactaaccataccttattgagttgcatataacctacaattcaacccaaatattaaaacgatgaaaaaaaactaacaattcacttatacctcaagtgataccgatcttcttgttcttgtatgcaggttgctcgcgtcatactgttcgtatacttcttcgctcatgtgtaccttcacttcgaccaggtaatcataatcaaccaatcgtcttctctttaaggttcacctttgtgacaggctgttgntaaattagctcctgcctgttcgattaatttgcccgtgaggca

SEQ ID NO: 24606 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaacttgagtggaacaacaggtgattaattggagcttgcttgtttttctctttctttttctttgacaggtctttttcaataaatctttgacaggttcttattatcgactaattgcagtattatctaaaaatcaactaacagtagcgatgcatattcacttctcttcatgctagtaattacaactcgtttatccatgttttaggggattctctaccttccacgcattagttgctgctgtagtctctttttatctgctggtgatatctgacctcttcagtaaggacgtccatggtgccatcataattgatcgaaaatcatggatgtctgatgccatgtttggtgtaagtttgcagccctacgcatccaggaaaccatggagaaaagagagaaagatatctgtcccaaaatgtctgaaattttaattattggcaggtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 24607 - DNA, 723 bp, Oryza sativa
  unsure (1)..(723): unsure at all n locations
tcggcgcccttgtgatgatctagatctcgcgttctgnatgtaaggagttgggaggtctccggattccagattatngatttncaaccccanatancagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaaatttttcataactatttatgtactttacaattggaaagagattagagcgcccctacntatcatttgagagtattaac

SEQ ID NO: 24608 - DNA, 868 bp, Oryza sativa
  unsure (1)..(868): unsure at all n locations
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggtagctccagcatagtagcaactgtaccaaccgacaattatcacaccaatcttgacggaaacatcaaactgttgactgaaactacactatagcacatttcagacaggtgaaactaacatgagcactctcaggggagaagccaagccagcggtgagtagttcaacgggccttgctccggcaagaacttgtccatgctgctacccgccgccgccgccgtccacttgccgttgtctctgcaggggtattctggggaatcgggagccaagaacgataacccctcacggtagagtctcccatcatccaagaagtagacgccctcgttgaactcagcgtccgggtagttgttcttgctgtacgatctggagcagcctcgcgcgacgaacagcatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24609 - DNA, 2268 bp, Oryza sativa
  unsure (1)..(2268): unsure at all n locations
ctgccgtccnnnnnaganacnnccagtctncncnnagantngggaattggtaccccattaaaagttttacaaaaataatttttcattttgaaaattgacagaagtggtcgcctaccgccctctaggagggggatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttgatagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggctccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgcccccagtttgtatcatgagggaagacttgagtatgcatccatccccacaatcgcacaaaggacggtcacaccatggtggaaaccaaccagcaaagggatgcttcggccagttgagacgctcaagnaagggcgcttccattttgggttgtggggggctagggggaaagaagatatgaagagggtggcctttcggaatgggtcaatatatatagggtggttttcacggcaatataggtgaactcaatgagatacattattcattagaggggacaanaggatcaggggggggcgtgattcacttaggtgnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24610 - DNA, 1259 bp, Oryza sativa
  unsure (1)..(1259): unsure at all n locations
agaatgtgacctgatatgcgcctnnnnnnnnnnnnnnnnnnnnnnnnnnnnnnnnnnnnnnnnnnccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatccgaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagctagcgatgatcgctcccgcgtctgtcttcgtgcacgcctcacagaggacatggtacgtggctgctagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcggggtacggaattcctcattctannnngcntngtgcaaccgacntgcatacagaccg

SEQ ID NO: 24611 - DNA, 8485 bp, Oryza sativa
  unsure (1)..(8485): unsure at all n locations
cgcctaatttcgttgataggtgagttcggtacgtatgatnaaccatagggtggtctctcttccctgccgaagttgtaacccctcagagacgactggtcgatcattttggttagtcttancataccctacaggattaatngncnccgaaaaaacagacaagtcattangcactaattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttgggacgcggaatattttatcgattttctcgtggaatttcatatggaattcctacggttttttgagatgcatgtgttcattttcactcctatgaatctatgatcaactattaatcacttctgcttgctgaattattgcagtctgcggcaggataattaatggtttacgtcttcctgcactgtggttcagaatctagcttggtggcgatatcgtccccaagtcccatcactctaccaccaaaatgctgctacaattttgaagcattagaaattagttcaagatctacaagtttcagacttgaacttggcgtcagcaatttcttgtcacgcatgggcctagtttaggagagtaagcgggccgacatgataatgtttcatgggctgatctaaatgggcctacaggacccatagaagaacgggcctgaagaattgtttaggcagagaactgtcggtcgaaaatacagtaaaggcttcgcttttctagtcccaaataccctgttctgcgattgctagaattgtgaccttaatagcctataaattctattcgcgatagcactcgtaattccatctaataacaatttcgtaccgttagaaaacaatttcgtacccttaaaaaacatttcataccaaataggcagatccgctgatgctacaagttcaggaaaatggatggcgaatgcagattgcagataaacaatgtttggagggacgtctctccctccaaatctcagcgttcccggataaacatcctcttcgtgtctcaacatttactctcatttccccctttctttagagcagaaaaccatctgattactagtgaacaggttaacatggtgcttgtcaaaaggctgtgctactgaaaattgctgagcacttcagattagtaactaataaccatatcttgaccgtttagccggttcatctgctactgaaatatactcaatattctacaccatgcacataataggggaaaatcagggcagaataaattaagtggcatcaatagtagtcctacagaagaacaaacaacacaggacgaattatttactgtacgtttaaacttttttgtcacctttcaaccgatcagacaataacaagtatgaagaaagaaataaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagccactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcaccagggccatgacccatcgccgcaacctgatcctgggaagcatttgctgactgcacgcgccaaaatgcgtgagtgcgtcgagcaacctggaagggccagtaggtgatgatggcggcggcgacccaatcctcgtcctccggtggccaaaaaagcgtcgcggcgagcatgatcacaccagtgttagggacagggccgtctggcccccccaattcagcagccgtcttgtccgggcggacaaaaaaagggaggttgaagcgcaactgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaaggcccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacaaggcgaagggcttccgccatgaagtcgcgcgcgggcgccgccgcgtccatgggaaagncgaaggcggagccggggcggggggcaaggcgtgaaggtgncggtggcaagggttggccgncggcgaagaaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggttgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtctgatcgcatgctggcccacccaccctcttcttccaaaccaagccgtcatctccacccgcttccagaaggaattttttcgtttttagatttttttttaatatttacagaaataatctatcgaccaaaaaaattgcagaaatagcccctgccgcccaaatggtggccggcaagctgacgtagcagacggtgggtcgaccgcgccgtctgccgccgtcggccaaaattgcgattaggcccttgccgcccaacaagagggcggcaaggggctaattgtaattttggnnnnnnnnnnnnnnnnnnnnnnnnnnnnnnnnnnnnnnnnncgggtgatcacgtctcagggtcttatcactcg

SEQ ID NO: 24612 - DNA, 886 bp, Oryza sativa
  unsure (1)..(886): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccttagcaagattacacatcagaatgacttgttcatcaatcaatcttgtaatctgaagtgtcaatgtcgagcttaactgttattgcaggagctttgttggatactagtagagagatgcagaattgctttgctccaataaatttacctctgaattttctggaaaataccggattgatgtacacatgtgatcaggatgatcattagctgcttaaatattcagtgaaactatgagctaattaaccaattaccaaagactcttaccaaaaccatgcagctctgctggctcattgtaccggccaagcttacactggccaatctgaatacagccaaagaatcatcagattgatgtttcgcagattcctgccgtgtagattgctctcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 24613 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcgaggaaagaaaccgtggaggctcttacgaagtgaagaaattcccctcaattgaacatcctggcaagagtgtgctgcaaagctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcgggtgatcgatgccaactaatggcttcgaggaatcctgatattcgaggagggcgcttttttaggtgccctaactatgaccgtgaggtattttattatctgcatatgcttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24614 - DNA, 2117 bp, Oryza sativa
  unsure (1)..(2117): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaaggacctaatatcaaataattaggaggggtgaggctttgaatccaggtcgtctagcccaccaccttgtggagctagccggaagacccctgggcatttctcgatcctctgaagagtggcactagcctacctcagttcatcttggactgtcagcaagaaactcaaaacaggacgcagaagcaattcagattcactgcaaaaccgtttgatgcaaaacatacttctatcaggaaaactagccactgcaagtgacacattgcattgttattgactgcagcataacgatgtactaatgcaatccaagtcatgacgaacggcaaccattggaagcatattgcgttcttgattcactgcagcatcagatcacacaaattcatagtttcatactgcgttcacgattcatgtagttctgacttgaaaacattttctgctacaaaaggagaatttctccagcatcatagcaactaccaatccatgattatgacatcaaatctagactgaaactgcaactgttgactgaaactacactaatccatcgcagcaagaggagacgggacgggacaaagtacaacggctgcaaactaaaccacatctcggaggatcaaatcaacagcgaatcatacctgtaccaggacgatcaaaagtaacatgagcaatctcaggggagaagccaccccggcggtgagtagtccgacgggccttgctccggcaagaacttgtccacacgaggaacccccgccgcatccgccgccggtagccacttgccggtgtctctgcagggatatcgccgtcgccgccgccgagccgtgaacactgccgactcgcggtagagcctcccgtcatccaggaagtagacgccctcgccgaactcatcgcccggatagtcgcccgcgtcgtacgatctggagcagcctcgcgcgacgaacagcatccgcccacccagcgattccagctcgttccacgcgtacagggcctcgatgcgcgtccccgacggcggctccaccatctcgaacaccttgaacgcggacgtcctcggcggcgcgtgtagacgatcaggaacgcgcctgaccaccatgaggagattgccgcgggactccaccaggtagcggacaacgatgtctccgccataatcgcgcccacctcgcgagaagcgacgaatcgccctgggcgccatcttcatgttgcctttgccgtcttcatggaaaatcccgtactgcgaaaacatggaggtcttcctttgtgatgaggaaaaaggaaggccccctt

SEQ ID NO: 24615 - DNA, 4649 bp, Oryza sativa
  unsure (1)..(4649): unsure at all n locations
cgcatgtgcctgatnnnnnnnnnnnnnnnnnnnnnnnnnnnnnnnnnnnnnnnnnnnnnnnnnncatgtccgggcggacaaagaaggggaggcggaggcgcagctgaacgtcgcggaggctgaggagcttgtggcggaaggtctcgcggaaggcgaggaagagccagccaccgtcgtaggcgccgaagcagcgcgcggcgcgggcgtcgtgcgggacgccgaggccgtgtccgccgcagccgcggagggcgcacgagaaggaagggccgtcggcgcgcgggacgaggatccacgggagcgggcggcgatgcggcgcgtgctgcagcggcttgacggcgacgcgccagtcgtggcagacgcgggccatggtgcggcggtcgacgaggcacgtgaggcggttgtggacgaggcggagggcttccgccatgaagtcacgcgcgggcgccgccgcgtccatgggaaaggcgaaggcggaggcgggggccaggcgttatggtggcaagggttgggccgcggagaaggtggtggaacgcgacgaggacgcttcgtcgttgtgcgccatgtttgaacttggcttcttgaagcaggggaagagaggggaacagagtgaatgggaggttttgaagaagcagagaaggccaagccttttgccagccgagaaagtggttgggcccaatttatagtgccggttttcttgggcctgaagtttggatcgctgctctttgctgagcgtttcttcttgggcctaaatgttcccctttttttttagaacgtaaagtttggatgtacatggtgcagaatcgtgtgcgccatgtttgaacttggcttgtggaagcaggggaagagaagagacacagagtggcttggtttggaagaagaggcagagtcagagaaggccagcctcatggtggttggtgttcatgtcttcgatagttcgattgcattaggtaatgtttggttggtggaataggatgggatgggacgggatgggacgaacttacttttagaggtgttttgttgaggggcgagtggaatgggttggtctctagagaggaatattcctcccagatccgggacaaacccatccggcaaaattggccggacgagctcgtcccacttggacggagcacacagtgtctcctcggcgaccgccggcgctccgccacgaccgcctgccaccaccttcacgaccgccgacgctccttcacgaccgccgacgcttcttcacgaccccctgccttaacactggtcgccgccacgagcgagatgctcggcaccatcccgccactcatcgcgatgctcgacgagagcggctgcggtgatgtcgacgcggcgggctcgagtggcggcgaaacttggaggtagggagggcggcggcggcagatccaaaggagggggactcggcggcggcgaaactttaaggtagggagagcggtggcggcggatctggcgcaggggatctcccgatccagccgcggtgacgacggtgggccagcgggttgggtgctccggcggtggtggccgtcttgctgctgccgttgtgcttgatccggttgttccacgcgtggatgcaggtggcgcagtcaacggtcgttgacggtgatggcaaacagcgtccatcccatttctccctcatcccttcaaccaaacaaaaaaattgggattgtcccatcctacaaaccaaacatgtgagtggaatcatcccaaccccaaaattagggatgaatggtttcatcccatcccatctagtcccgaaaccaaacacatgcttagtggatcatcgtcgtgttgtagttagtaatgcattttctgcgatgtgtttactcaacattacttagcgttttttctgttaaaagaatgcattgcattgcatcaaaaccgatttgcagtgaagatcgatgaattgcttcttgagattggtttcagttgcttcaattctcaggatccatttaagcggatgctacatattaagttcataactattaatttgctgttcttctccacttatatcttttaaattactagaaaaaatgcatgtgcgttgcaacattgcaacaggtgaatgttattttaatcctattattgttatacgatttacatgggatgaaattcactgtgtgaattcgcttgaatatttttttagaaaatcatgagttataattaggagtccaactttactctcaagtgaccatacaagtttttttaaagaaattttttatatgacttcttttgtattttctaaagcaaacagacttaaaatccgactcaaacatggatatgtatttccaaaatagagcgaacttaataaccgattcaaatacggatgacttaccaaaataccggtaaaaacatcttcaatttttataatagtagagatagagatatattatttttaacatccgtttgacctattgtactccgctcaaaatatgtgataaaacaagtccaatatttaatatatttaaattattttaaaattgtattcttgttcttagctcttatagcagtgtagttactttagataccatgaaaagttactttcttacagcaatatagttatttctagtaacgtggggtaaatatttgcttttattttgtttttagagttactttcctctagcactgagttacttctaataccgtgaagagtaacttctatttctccagacttgcttttttttctagcaatatagttactctagtaatgttaaaagctacttctatttcttcaaagttttttctaatcccataaaaagtacttctatcttatcagttttacttccctctagaagtgtacttacatctaacaccataaaaagttacttctattctttttataaaaagattattttcttccaagtgtgtaattactttgaatacctaaagagttattttctatatgacgctaaattactctttacaaaatatttatagtgattacttccaaataaagaaaattactttctcctctcaatataattactttgtatttagttaggagtcttttctatattttacttcgcatagtttcttatttcaacatcattcaatatgtttcctttcaatgctactcaaaagtgccggttcgttaaaaaagtgctacacaaaacactagacatggcacccatccgacctcaaaacactaggcatgacgagttggcgtcacaaccgactcccctgttttagttttgaaattttttattaggattaggaattatcttagacgagaaaaattatcttagacgaggctgattcagagtaggaaaaattgcacacatcagtaggagactaggaggacatgatactgatcgtctgatccttctcgcattgggcgttcatggcctcgtgggctacataaaaggccatctaaaagcccatagagaataaatgaggcccattatacatttgagcccattaatctgcctcacgagggagatacacttggggcccaagaaagctagccctataaaagaggtccaaactgatcgcgtgctggcccacccaccttcttcttccaaacgaagccgtcatctccacccgcttccagaagcagaggaatcaatcccacacacacctcgccaccggcaagccgcgcctccgcctctcgccctcttcaatggacgcgccatggttcaacctcaacgccgacgtcctccgcctcgtccacaagcgccccccgtgcctcgtcgaccgccgccgcatggcccgagtctgccacaactggcgcgtcgccgtcaagccgcagccgcagccgcagccgccgccggggacgaggccgctcccgtcgatcctcgtcccgcgcgccgacgggccttgcttcgcgtgcgccctcgacggctgcgccacccacggccgcggacacccgctcccggccgaagcacgcgctgcgcgctacttcggcgcctacgacggtggctgggtcttcgtcgccttcggccgaattctggagtacgcgctactcagcctccgcaacggcacgcgattccacgtccccgacatgagcatgggcatggtggccgcgaccctctcttcgcctccgggcgacgaacgctgcgtcgccgccgccatcagccattcctgcatgatggacaatccacgaatccatgcattcgggatcctgaggcatcgagttgcggaggaggcgactcatgatcctgctgagttcgtcaccacgtcagttctggaggatgtcatacaccacaacaaagccttcaaattcctcacaagagaagaaaacctccatgtttttcctgtagcgggcttccacgaagacgtcaacggcaatcttgagataccgcccgtggaggttcatcgcttctcgcgtggcgggcgagattacggcggagccgtcgctgttcgctacctcgtggagtccggcgggaatctcctcatggtcgtcaggctcgtcaccgatcctcttctcttgccgacgaggacgtcggcgttcaaggtgttcgagatggtggagccaccgacgaggactcccatccacgacaaggagcccgcattcgcttggaaagagctggaatcgctgggtgggcggatgctgttcgtcgcgcgaggctgcttcagatcgtacagcaagaacaactaccccgacgctgatgtcaacgagggcgtctacttcttggatgatgggagactttacg

SEQ ID NO: 24616 - DNA, 4890 bp, Oryza sativa
  unsure (1)..(4890): unsure at all n locations
cagaatacccctgcaaagacancggcaagtggacgcggncggcggcgggtagcagcatggacaaggtcttccggagcaaggcccgttaacgtactcaccgctggctgggcttctcccctgagagtgctcatgttagtttcacctgtctgaaatgtgctatagtgtagtttcagtcaacagtttatggtttcggtcaagattggtgtgataattgtcggttggtacagttgctactatgctggagctacctagtaaattctccttttgtagcagaaatgcagtgtggtctgatgaattacatctatgcagcaatgatattgcagtcaatagtaatggaatgtgtaattttcagtgcttatttttcctgatagaagcatgttttgcatcaaatggattttacagtgaagctgaatttgcttctgcaccctgctttcagttgcttgctagcagtccaagatggagttagctgaattttcaatggctcccacacatttcataactttattatctattcacttttccataagttagctgaatttttaatgggcttctcaaattgctgctgggaaacatgcagattgtttctcttctctttcttcatactagttgtttcatagcaacttttttctttgagccagttctgaacttcagatatgacagttgttgattgtccggttacttcagtctgtgatgtttcgtccatgtgtgcagtgtacttgcaattgtttgatctgccataacatctcttcaatacttcacttcatgatttcagttgctgtccagaaaatggttggtgttaatggcttagattgcatatttgcagcagtgcttcggatcaaacggattttcagtttccgtataagaagtagatcgtttatctttgctttcttcataggactagttagttgctttatgatcagttgcatcggggtagtaaataatctaccttgtgttatttgttcttctgtaggaatagatcgtggcacgggaaaaacaaattcagtggtactatcagtatagtaccacacagatacatgtatgttgataactgtttcattaatcagttcactgctactgaacagaggatgttctgctcatttggtcatctgctctacaggaaaaattggttgctcatttggtcattctgaaattgtagcatagtctgatggtagtggtaccaccaaaaaaaagttcttcagacggttgtttcccctttctcagtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgcttcctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctgcttcctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtggaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggncggtaacccgcttcgncgncgncgncggnggnggcggcagccacttgccgttgtcgctgcaggggtactggggaaggggattcacgaattgggacgcctcatcgtagagtcttccgtcatccaggaagtagacgcccttncttgaactcatcgcccggatacttgttcgcatcgtacgatctggagcaggctcgcgagacgaacagctn

SEQ ID NO: 24617 - DNA, 4082 bp, Oryza sativa
  unsure (1)..(4082): unsure at all n locations
gcntcgtgacgaaatgcangnnnnnnnnnnnnnnnnnnnnnnnnnnnnnnnnnnnnnnncatccgcccacccagcgattccagctccttccaagcgtatggtgcctcgtcgttgttgatgggagtccccagcggggggtccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctgcagattgccgtcgtcgtcttcgtggaagcccggtaccgaaaaaacatggaggttttcttctttcgtgaagaaatggaaggctttcttgtggtgtatgacatcctccagaactgacgtggtgacggactcaacagcagtcgccttctactcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtcccaggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaagtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccacttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctagtgttcagaaataccacatgaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagatccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaancgggttgtgaaagagnaaagnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24618 - DNA, 1302 bp, Oryza sativa
  unsure (1)..(1302): unsure at all n locations
gcttagctgcgtgcgccatccatggagccggccacgggccgcgctttgtgcactgctcnccgtattctctcgtggatttttgtcccctcccaaccagataaccctagtggcactcgggcccagacacacatacatacgtacctccactcacacacaaaccatggtgtacctagctactagtactaccagttatcgttcaaccggaatctgttgtaacgcacggatacttagctgataggatgtacttccgctggtttcattttaattgacgttttggacaatgacacggtctataaaatatatttttgaccttatttttctattataatatatataataaataaatgtatgttacttttattatagtgctttgaaagacaaatctatatatgttgttctaatttctttaaactaaatatttttaaagttattgatggtcaaagttataaaagtttgacctcaaccttgtctaaaacgtcagctaatatggaactggagggagggagtatatcctctctccgtgtaaggattaatccttagccagttcctcctgctctgggacatggtacagcctatccagctgcaacctcggatggaggacaaccttatctggcggtggtcgaacaataccgccttttcgatctacctcgtcggcttataaagctttcttcacggggcaacacttgttcgcgtgtaccgaccccctctagcatgcgcaagcgcttgcgaagtgctggtttttcctctggctggtgctgcaaaagtgttgttggatcgccgatgtcatgttgcgtcataccatggagagccacattgcttgccccttctacacccaggagcaggagacgcgaaccatatcatcatcgcttatgtcttcgactcttcgctcgctaggtctagttccaaatcctcgcgccgctggatgggctgatgttgccctagaccatcatttttgggtccaagaccggtggccgcaaacttggcatcgacttgcgagggaccatcaccgccccttcgattctattgtttcgttgacatcctggcaactatggtagaagtgtaatgcgtgtcttcgacgctgtcctatcgtcagttctgatcatcgtcgagaggattaaacaagaaggaaggctatggacgacagcggatgtatcttagttaggaggcttcttgggaggatatgcttgtgctcgtttgttttcctcttgttttggggacccatctcgaaatagcgcttctttgtgcgtctagctagcccgcccacccttacgagcgctccgacgtattcgtggtatacaaaat

SEQ ID NO: 24619 - DNA, 894 bp, Oryza sativa
  unsure (1)..(894): unsure at all n locations
ccaacgcccaatttatatgtgtaggtaagtccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcttgaaatttttcaaaagnaaaaaagaaanngatccacannncttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggatgttcagaacttttttgaaagctatgtcacaaaaagaaccaaaaataatcattactgatcaggatggagcaatgagatcagcaattgctcaagtatttcaaaatgcaaagcacggaaattgcttctttcatattgtaaagaaagctttcaatctatctggaaatttgttcaaagcaaaagaagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatnnnnnnnnnnnnnnnnnnnnnnnnnnnnnnggntttcaacaannggttctacgagagnttaatacagct

SEQ ID NO: 24620 - DNA, 703 bp, Oryza sativa
  unsure (1)..(703): unsure at all n locations
nccgtggttttgaaccgcncccttttgatgcatgntagnaccgcgaattnggtaccccgatgaaccgaagtgaagaatacggtttcgccctgattcccagctgtcgcctgtggtgttgggtgttagaccgttggttccgctggggctgttgttgatggtgttcgcctccgccgtgtcgtcggttgtattctcgggctgtctgagctgcaaccaaggttaaggtaaataagtcctctatttattttaaggattgctatgattcatatttgttaccgtgggtaccaacaccatcttcctgtcatgagatgctcgggcaatgctctcgatgttcattgaagaaaaatgaaaatgaacaaaacaaaagaaaatatgctccatattatgtcgcatgtcatagtatataatgcatgtcaaaacgtgagcatgcactggtcatatatccacaataaatataaaactaagatataagcagtctgtgaacatttatcaattatcagaagattattagcaactgaagaccatgcaaatatgtgggatgcgacccaatggacaaatctgaggtaaataaaaaaaaatgagtagagcatgtttaaaatcaattaatggggcatgcaagcccaagttcagactttgtaaaagttaaattaatttaangattaattggttcaataccaaagttgtagaaattatagtatatttgggg

SEQ ID NO: 24621 - DNA, 1238 bp, Oryza sativa
  unsure (1)..(1238): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggggggggggggggggggggggggggggggggggggggggtgggggggggggggggggaggggtgggggggggagggcggggaggcctgagtgggaaggggaaggggaggcccgagggggggtgggggggggaagcgggggggggggggagggagggagggaggggagggaggggggggggcggagggcgggggcgaggtaggggtgggggggggataagcggcgggggggggcgggtatggggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24622 - DNA, 1810 bp, Oryza sativa
  unsure (1)..(1810): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaattcgacactcatgctcagcatnnnnnnnnnnnnnnnngcnttagntagtcnnatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctccttacccctgtccctcctaccctgcgccctaatgtgcccctgggagtacgtgagtcagtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtactgaagatcccggctgcaaatcctgcaggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcttcaaaaccggaccaaacttaaggaacctttggctgacaataccggcaaa

SEQ ID NO: 24623 - DNA, 706 bp, Oryza sativa
  unsure (1)..(706): unsure at all n locations
ncgctgctagataatctcctnnnnnnnnnnnnnnnnnnnnnnnnnnnnnnnnnnnnnnnnnnnnnnnnnnnnnnnnnttctacaatttcatacaaaattacaagatttttaccatattgactcttagcttatacgacagtttagtttctgtctaaactttcagatatttcttctgattacttgaatattttgattcaatgccaaaaaaacttcataagttttgaacttctctacttcatttatttgaaatctagttgttcttttcaactcaacttgaaacttgatgaagacactgcgattatacattctcattgcttggcactcaatgtactaatgggaccaaagtttgcttggcttctttgatcttcgaaaagtgaacatcaaactgttccaagttttgaatcgcatccattactgtttaatactctatcatgaagtttgaaatgttgcactggggaccatcattatctttagaccgttggataatgccttcactgagagctgtgcatcttatgaattgacagaaagcacccttggaattcactggaatgaaccttctattgattgaccacgtgtgcattatgaaattggtaaggtgtactgtaacgctggtagtgctgttatgcaaaaatgctattgtcttcctccggaacatggaaatcaggttgaactctacttaggggccaaccgttatattggttgaagg

SEQ ID NO: 24624 - DNA, 1200 bp, Oryza sativa
  unsure (1)..(1200): unsure at all n locations
gcggcacnnatggtcatggcatgcaaagagctgccccatggcgatcgttgctgttgaaatcgtcaaccgggcgccaatgtggcagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaaaatagtacttgacgaagcttggggctcctcaccgggagaccgcacaagcccccctttgccggttcggccgggggcgctaggtgagtttcttcaccctcgatctgtggaatgttcgcgagagagcaaaacgcacgagacacgggcgatgtagacaggttcgggccgctgagaagcgtaataccctactcctgtgttctggtggatctgtgtgtgaagaagttacagagagtcggagagcaagagagttcaggctctagaacccctcttcctctttctctcctctacgagctcaggtattctcagagtcgtctaagagtcctccctccctttttcgttctccatcatcccttttcggtgggcaaggtcctccttttatatctcaaggggataccacatgcaccacttctacctacttttcttttgggtggggacccaccctatcttgaccaaaaacttggctcgcgccttcgcctggaagctaaatcacaacttgtccttgagtgaggcccagcgccgtcactcgcctccacttntacggaagtagatgcagcgtgggaacacggttgtctgccgaagacgtgaccggggttagaccagtcacagaccggtcattcttgtccaccacgcgtcagtttaacatgccgtacatctggccttcttcatacaaagacttacttgtaatggttgcgatgaagcctggcatgaatctggccgggactgacgtgccaactacaggagttagcacgccggctccggctagggaccagtgcctggaggctctcatcattccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24625 - DNA, 4055 bp, Oryza sativa
  unsure (1)..(4055): unsure at all n locations
ntgtgttnncattttngtcangttangaaacnnccccganttngtgaaacnnaccaccgagaattcgtaccccatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccgataccttattgagtttttttttttaaactaacgataccttattgagttgcatataactaccaattcaacccaaatattaaaatgatgaaaaaaaactaacaattcacttatactccaagtgatactgatcttcttgttcttgtatgcaggttgctcgcgtcatactgttcgtatacttcttcgctcatgtgtaccttcacttcgaccaggtaatcataatcaaccaatcgtcttctcttcagggttcagctttgtgacagtctgttgttaaattagttcctggctgttcgattaatttgcaggtgaggacggtgttcccgctagggttctacagtatgatggcggtgccgccggcgatgtcggcgatgaacctcctctggttccggaagatctgcaaggggatggtcaaggccatgtccagcgccaaccgaagtcaatgcgtcaagacagattaggacttgggtaaaaggagatgcaacgctgtctggaagccaaatgcttactagcttgcttgtttgatgattaactaaactgtaatcaatcaattgattatttgaaaaccactcgtgcgtacaaaatctgttacttaagagtagatatgtcccacactctttttctttgttcttttaaagactcattgaccgtgtattatggaataggccaagatgtaatacatttataatctctctgtttcaggttataatatattttgcctttagtcaaagttaaactgctttaaatttaactaagtttatagacaaatatagtaaatttacattaccaaattagttttattaaattaataattaaatatatttttataataaatttatcttgggtcgaaaatattactattttatttctataaacttagtcaaacttgaatcaatttgactttgactcaaaacatcttataacctaaaatggagggagtattatctaaaagaaatgcaaaatcagtcactaatcacttggattttggtcctgatcgtcgtctgtttgccaggtttgtctctgcaatatctcctggatgcgtccatgtaagtgcagacaaaggcaagcggtaggcatcatcagcttcagtatatatacgtagtttaattacattgtcatcgatcgatgatgcatatatcctgaattaattagcacggtacatctacgcatggccttgtcagcctgaattaattagcaggatatatacatatataaatatgttcgcatggccttgtaacaataccaggtcaaattaacagaccacaattaaacatgtagcaaactactatgagttcagtgtgtaatagcacataggaaacgatgagtttgacatgtggaggcaccggcagattgatgctggaattctgctgcttgatgccaattagtccggccaattactcaattagtagctgaagaattaagcaagctaactggccaaattggttgatgatatcgccagccattgattcgctgcctgcaagcgcagcctagctcctcgtcgactcgtcctcaactagcgatgatcaccaagtgatctatcagctcgccattaggaagaagctactgcttcaaagctattttcttactcatttctcaattacacatcacaatcatgaaatgtgatgacttcgattaattcttaggggttctagtagctcggtttcggttttccttgagaaaagcaaagaaaattacgcatcgcaatcgtcaaatgtcagtactctgaaacctcttaggagttaacatcctacccagtttttttctctccttagcaagattacacatcagaatgacttgttcatcaatcaatcttgtaatctgaagtgtcaatgtcgagcttaactgttattgcaggagctttgttggatactagtagagagatgcagaattgctttgctccaataaatttacctctgaattttctggaaaataccggattgatgtacacatgtgatcaggatgatcattagctgcttaaatattcagtgaaactatgagctaattaaccaattaccaaagactcttaccaaaaccatgcagctctgctggctcattgtaccggccaagcttacactggccaatctgaatacagccaaagaatcatcagattgatgtttcgcagattcctgccgtgtagattgctctcacactgccactagcttccaggttgacctagtaatactactcaaatgataactagggcgctctaatctctttccaattgtaaagtacataaatagttatgaaaaaattcggaaaagacagaggactagatatcctccctattcaatattttaagttacgtattggatactacggagtttgcacacactatagttattttaaggtaatggaaacattttatttgagctacagctaatattctaaaattaagttttaaaatttaaaatttgattgcggttgataataaacaagcaagcagcctctgctggttgccacaaaaagtactcctttcgtcccacaaaatacaaacctagtactgaatgtgatgtattctagctagtacaatgaatctggagatgtcacatccagttaggtttgttttttgtgagacggagggagtatatataagcacattgctttctcttgctccactcatcttcagctatgcagaaaccctacttgattgattgatccttgataaatcaacttatgacgggaagaggttcagacatgcaagattctctaggcttgatgcagtttcttgatcatcaccagtatctatacagcagcagtagcagcaacctgccactgcagcagcctttgttgtcccatcaccaccgatttcttgaagccaatgagggttgcgccggcgaggacgactcgccggagttcgtcgagccgccggcggcggcggcggcggccgggacgttcgagcaacggccggagttaggagcgtgcaaggaggtgtactccgaggaaggcggcgcggcggaggagaggacgggcgtggcgatggcgggggccgacgtcgaacaggtggcggtggaggatgaggaggaggctcacggcgtgcggatgatcgcgctgctgatggagtgcgcggcggcgatgtcggtgggcaacctcgcgggcgccaacggggcgctgctcgagctgtcgcagatggcctcgccgtacgcggcgtcgtgcggcgagcggctcgtggcctacttcgccagggccatggcggcgcggctggtggggtcgtgggtcggcgtcgtggcgcccatggcgccgccgccgtcgtgcggggccatcaacgccgcgttccgggcgctgtacaacgtcgcgccgttcgcgcggctcgcctacctggcgtgcaaccaggccatcctcgaggcgttccacggcaagcgcctcgtccacattgtcgacctcgacgtcgtccccggcggcgcgctgcagtggctctcgctcctcccggcactggcggcgcgggccggaagcccccccgga

SEQ ID NO: 24626 - DNA, 5974 bp, Oryza sativa
  unsure (1)..(5974): unsure at all n locations
cggggtgtaccccttttcggaatagacatctccccggggggtcctggggagaaaaaatatatgtaaagcaagcaaagtttgtgaattttgtgagaaaataagggatcatgtattcaaaatattctttnaatgaaatggtggtcaagaatattgggacaaacaaaggaaccttcgacccaatgttgtaggatttatggaacgaagaacctgccaccgatccccacacctgtattttggacgggcttcccatgaaggaagtgccgtagttagcacccgccagtcgtcttgttgttcacgacattttggttaataagcggcttttttcggtaagtattgctcagtactttggaatgcgaaaacacaagcacctttctgttaacaaggtgttaggttcaaaaccggattttttggtttaacccccttgaggttatgcccaacctaaggtgggatttcgccaaataagtaggcttcgagcgagtacagctggtgaccacggcgtgtccggacggtctgggctacacggtggcgggagaccacgacggcacggtgcggctggggtggaagaaacacccccctctacgcggtgtccgcgtggacgtggtgctccccgcctcacgcgcgtgcttaatcgaagctagttttaatcccttttgattagcacaaagtacatggtgattaagcactaagctaatcacccgtgcgtgccaaagccagactggtctcttgcaagtgggcccacgtaggaatagtcacatatgcaatgtattgtactactactactgtggctcctgggccaactcgtcagttgccagctcgggtatatttatccttatatatgcttgtatccacaattctacatcaagtatacaatttttttactgcactgagtataatatagtgcatctaaagaagaatgtttacactacactccctccgtctctaaatacaagatattttgtccgtctctaaatacaagatattttggttatgtgacatatcctagtacaatgaatgtggacaactttcttatactaagatgtgtcacatccaatcaaaatctcttatatttagggaagaagagagtactatttatcactttgtagtactacttatcatatcaatcacttccaattcaaattccccctactctactgccaatcatcatcccgaatcaaactatacattagtatttaataaaaaccattagtctttttttaacctctaattgcagccccaagaaatgaagaacggcctgagttggatagttgcatcaaagacttcaggaaataagatgagctatggatcttgatggtcatttagagaaagatgatgaatattgcaccattgcaagggtatgagtactatcaaagtcaacgaattccaagcatggtttcaacagaacgggcacagaatatatgcagtattttttttgggttaatgccccatgatcctaatctactgaatctacaagccccaaaaggctcttctaaactacaacaccctcacccattttgtgatgctggtgtacgaatcagcatctgtccaatcctcactgtacattgatcaatgaacaaatggaactactactcaacataccacggtagacgaccagtttgcaaaaaaaaatcaattttacttcatatctcagcagcatcctgaaagatcctcagtagtttgggcggtgctcactgaagcccctctcctctcatcaaatttcccgcatacagtgaactctcgctatcgcacaaggtggtgctgttcgtcgaacatggacttccggactccaggactaacaaaattgccttgttcatggattcacattgcaatctatcaagaatggatcatcccttggcaggtaccttctccaatatttcctgtatcgccgtatgccgagttctaaccacggtttcatgttgccgttgtagtgcaatatgccagctttctttatagcaccatgattgactccatagtcatgaccaagaccagactggatccactgtgcttcaataggatggaccagattttgaaaagcaagcaggcctgcaggtaacaccgcagctctccatgacgcttcagggccatgttgcagctgtcaaaagtgagacataggcacaaccgtatcagttaagaatttgcagctcttcgcttaacaggccaaacgtgcaagaaaaaaaatacatatcttaaataaacttcaaggcttcaagcaagtttatcttattagtgaagatcacggtacagtagggtaagttcagttgaacacaaacagaaaatcaagagtatagccatgaggaatatgccttatgtcaaatataacatcgaaagtagtttcttaaaaacaattcttgaaagagagaagaaaagacagctgctaagcatcactattcaatactaaccttttggagtactcgattacgaactgcagtcacatcatgctccctccatttattgagatcaataacactcactccagacatccagatacatgaactagcatcatatgggaagtcaaccaagtatggtctgagatgccttaatctaactcgacaagactgtacagcaccaatcacttttcctttcaaatcaagattccatatgtgtgacaagtctctctggactatagtatcatcttccaaaacaatcacccgtttaagattgctaaacagctcaggaagcaagaaaagagagtgtccaaacactgaaatatattcagttctcatttgggtatttggaattcgggcattgctatgggaagcgatgcggaactcctcatatggtgataagtgttcaactctcctattatccaaatgtgttgcttggaaatcttcaaaattcagaacaccgatagtggcttccttgtaagaatttctaatgaaccaattcttaaatgcataaaagttctgtgcatcagtaacaagatgaaaaaccacatttgctgattcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagcttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgttattcgatcaaactacagagtgttaatacatttcacaaaataataaggactacgaacatgctaggtgatgaaagagataatcctaaggaatcattcaggtaatgctcaatcaactgtaggctgtcaattatgcataagttatcttgtatacgtgcatattagacgacagtggatatcaaaatctgtgaaaataaaaaacaaacagtgaagcacaacagttagtaggtagaccatttttggtgcaaagtcaggctgcttaaatacccaacagtttcatgtatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaccttgttcaaaattgtccttaggatcagcatcagtattctgcaacattaggtgaaaaataaaaagtatgtaatatatgataattctgcaagtccgcaaacaagttacaaaggattattgaaatgtttctttaaaatattgcaaaagcaaggtgcatatcacatgccctgctcagaaattcatgcgaaagcagcatatatatttactgcacgaacagacaagggcatgttaaaaataactgtaaagcatattagctcttacactcagtaatgatatatcatcaaagatcacgatttgtttgataggaaggcctgcacattacaagaagaattaaagctgtaacttgatatttaaaattttaaaactaaataagtggtcaaagaatgggccctgcttacctggatggattgaggtattgctaatcggtttgtcaatacttggttgattgttggtcccattgctttttgcatcagaattaccggtatttgttttgctccagtcctgtgaacgaacaactaaatcaattaggtaacgcaaaaaaaaattgcatgtttcggtagatagacaagattttcagatgatgcaatgcaatttttgggacatagtgacaaacagttagtaagttcaaaaccccattcagctctgagcctcttacatgccaaaaggaaagaaacagtgccttgattgcagtagaaatgcaaaagagggccatgtgaaacaagatccatgatatggcaaaagcagactgacatttccaaaaaaatggggccatggaccatgtattaaaaggcaattccactcaaacactacccatgagaccacaatcggcacgatagcaactcacaacaagcactctacttggataaaatttcacgcatgaacaaagagaagaaacagctgcggccgatgggctcaaatgcaaaccttttcaatcgatggcggaaatttgttcgtgtcgttgactggcagcctgtcattttcctgcgaaaaaaaaatgcatcactgatctaaagattaaattctcttcccgcagtagtaccccatcagtcatcattgaccaaacctaattaggataaatacacctaaccacacccccatgtgattggaacatttcaggtaatagaacaaaaatatcccagaaatggcaatcatgagcacaccccctacctgcgatgtatttggctcccaaccaccaccctcgctgccgccaaacacctgtgcaacagaaacatgaggcaaaaatcttaacagcaatggattaaacaaatcaaatggcttaagcatgagctactagttagtttcaatctcaattgacactcaccgacacggcgctctcgtcggccaaatacactgtgatatcaaaagacaaaacaaatacaaacaaaatcgagtcaggggagcatagagagagagttgatgagcccctagatcgagcgcgagccggcgagccggacgggaagcccagatctgggagcggagaggctgaagagaaaagtagggttttggcaggggagagaggggtgggtggttacggactggacgggaagcgctggtggaggccgagcagcacggcgagcggcacgccgacggagaggaacagcagcgccagcgcggcggccgcggccgccacgctcctccaccgccttttcgccggggcccccgcgctcgcacccttggccttcattncccgttccccccgaccgaacgcacaggggggagcaaagcttagcttccacccccccaaagcaa

SEQ ID NO: 24627 - DNA, 1213 bp, Oryza sativa
  unsure (1)..(1213): unsure at all n locations
cgctgcatagatnnnnnnnnnnnnnnnnnnnnnnnnnnnnnnnnnnnnnnnnnnnnnnnnnnnnnnnnnnnnnnnnnnntttttcctttttcttttttattattattatcgggcccgtgcaggtgcaggtagtgacggtggttctcgacgacagggcccacacgcacgcgtggtactcgttcgattggaacgggcccattatagttgagccctattgggctgggatctatatgcgggccttacaaactgggccgtaactgtagtgtgcgtacgtcgatcgggaagggaagtcacgagagagaaaaccctagaatcgaatctcggcgactaggcgagattggaggcgggcggaggaagaggaaaaaggggagcttctccggtcgcggccatgtcgctccgggccatcggttaccttctcacccgaagccggagggggttctcgccacgcgggatcccccgtgcgcaggcggagtcctcgctgggtatcctcactcgggcggggaggccagcagctcactctttccactccgttcgtctctcatctcacccggttctcaaatcgaaaatcttttcttttgttcactcgcagctcatatgtctctcatctcgttacgcgatacagatgggtttcgccgttggtggtggctctgttgttgtagccacggcttcattggttggattggcggccacaattctgtgtttcaagcaaaacactgacaagtcaggaggtatgaattgaaaaagcggattcagatggtgacataggataagcatgttaaaggtgatatagcgtagatctcagccctccaaaataacatccaaagctgagattccccccccccccccccccccccccccccccccccctccccgcccccccccccctcccccccccccccccccctcccccctcccccccccccccccccccccccccccccccccccccccccccccccccccccgccgccgcccccccccctctccccccccctttccccccccccccccccccccccccccccccccccccccccccccccccttcccacccccccccttccccccccccccccccccccccccccctctcccccccccctcccccccctccccccccccccccctcccccccctcccccccccccccgcccccccctccctctcccctccgccgcgnnnnnnnnnnnnnnnnnnnnnnnnnnnnnnnnnn

SEQ ID NO: 24628 - DNA, 3910 bp, Oryza sativa
  unsure (1)..(3910): unsure at all n locations
nnnnnnnnnnnnnnnnnnnnnnnnnnnnnnnnnngggggggggggggggggggggggggnggggggggggggggggggggggggngggggggggggggggggggggggggggggggggggggggggggggggggngnggggggggggggggggggggggggggggggggggggggggggnggacgaatctcagccgttggatttgttttggagggctgagatctgagctatgtcaccttgtgacatgcctaccatatgtcatccaatctgaatcctgaaaaggccaagatttctcattgtttgttagtaattttttcctagtcaaacttaacaagtttgataaagtttatagaaaaatttagaaatatttaaagtatcaaattgatttcattaaatctaacattaaatatattttaataatatatttattttgtgttaaaaatactactatattttttttataaacttgatcaaacttaaagggtcttatgatatgaaacaaagggaatatttagctctgatccatgtaacttaaccatagccactaccactatctgtacataacctgtagctagggaggaggataaggaggaagtcacgaagaagttaccagctgcccaggacgccggcaaggagccttacctgagcaaggaagcagcaatcgaggcagggttcgtggacaaagatggcaagatcctgtggtctagctatctcaattacgtcgaacatgggaagactctcccggacgatgaggcatttgctaaggaggcgagagactaccaagaagccattaagaagcaggaggtgaaggtcgatgaggcgaccatgaaggccaggttccatgacttgatgaaggagtatggccgttcatacagcactgaggaggagaaggctcgccgctacgaagtattcaaggaggccaccctgtgggcagacaaggttaacgcactagagccaaggacgatcccttatggccctaacggatatgcagactttactgatgaagagttcaagcgtatgcattgccattgttctgccattgactgggagagatacatcgatgaactcaacactatggctgctcgtgggtggacctactttcgcgatccagatgcgacgacgaatgtcagcgaggcagtgaggaaggtatatatatttccctcactatcatcgcatgtgttttctttgggcctgtttagttccaaaaaaacttttcgtaaaaacatcatatcgaatctttggacatatatatggagcattaaatatagataaaaagaaaaaataattgcacagtttgcatgcaaatcgcgagacgaatctttgaacctaattagaccatgattaggcataagtgctacagtaattcacatgtactaatgacggattaattaggctcaaaagattcatctcgcggtttccaggcgagttatgaaattagttttttcattcgtgtccgaaaacccctttcgacatccagtcaaacgtccgatgtgacataaaaaaattttcatttcactgtaacgccccgacatttgttagccataaacacagcaaactcacaccggggtgttatgcattacctgtgatatagtaccagtcccaggatacactagctggtatacacagaataaatgtggaatcaaagtaaattgctttattacatcactgggtagtagtccttacaaacgttgccatcatggacaggcccacatatgagcaacacagcattacagagaaccataaaatcgacggcacagaagcgaacagcgcggagaactaagcgactacgcactaggcaaagaacttaggcaactaacttattccacaggcgaggcttggggctaggcacaaaacatctagaagtcttcatactcaacttgctcctggagatactcctcagctgtcaggtcgacgtcttcatcttcaaactctatagattattataaggggcaagggtgagtacttaacgtactcagcaagccggggaaaagaatgacatgtcggtctaacaaggaggctacggttttatttgcgaacaccttgctgcatcatcgcgtcaaaatctttcttttgatcaggtgtgaacttttctggattgatggtcacaatgttcccttcatcaacgtccgtgaaacataacttttggattttttctttaacaaatcctgggctagccgaggacggtgatggcggtagtttctcggccatgaagaaaattgcttatctgactcctaatctgtcccaccgggcgtgccaaaagcgtgttgacgaaaaacacgaggcctgggagatctgcttaactccagtgcaggtccaaagctcgccttcgggtgtgttagcgtgccagttgatttgatcctgcaatcaacaagaaatagatacaaagaaaccgcggttaaatctataaacgatagccgatcggctaggtgccgatgacatatcatttatctttgagccgatgtcatatgtaaatcgatcggcgtttgtaaataggtaataaagaattaaatctacttgatcggctgtagatattagcaatatacaattattatatcgatatatacttaaatcaaatgattgggatagatcggtcgccgtgccgagacagtataaatcacttagatcgaaatatatattaataacaggactatatatgttcgtaccatagccgatcggatagatctagcatatatcggctaatactccgatacgactctatattaagatgttaaaacaagcagaatataacaaacagaagcttaatatacttggatgcaataatatcttgacataaagggcagatttaacgtgtcaatgaagcatatagagcaaatatagttaaattagataagatcggctgaaactccgatactaccctaatcggtaaccagaaggcaggctagagattgatattctaagcatgacttaatagatcaaactcaactgatacagcattaagtatgaaaagaagaacaatatctagacaatcaagccgctgaagtttcatagagtggtagatatcttatataatctaaaccaacgtcgatatctaacctaatcggctaccctctgttaacagatgttagccgattgtgggttagatggtgatattgctagagattatgtaagatatatgataactcgatgaattacataaacaagattagagtatcataaagatgtaagcactaatcccgagaacgcaagccgtcataacaagttttacctcttgttgaagatcgaaaccgatgcagctcaacccgaaagtaagaactcgtcgaaataaaacaaaagcaaaagggtggcgatgcgccgaaattgtattgaacgtgtgtgttaattgattacatggggttcggggtctatttatacccgaaaattacaaactatgtccatatcggacacgactcttatctctaacaaaatctaagataccataagtctttgcgacagacttttacccaaacatatctttaaggaaattacataaaatattttaattaatagatacaattgccttctcaggactctatccatgtgcggcaattatcttgaagcacctcaattcaacccgatgtcatacaccaagtcgtattgtcggaatcggctgcatcggcttacctagtccgactcagacccagccgatcctaatcgtagccgatctggactccagccgattcttgctctgttctcaaatcgatctccgccttcgactccacttcgatctaatcttcttttccgatgccgatattaccaaatttggttgttaacaaaaatataaggcacatttctttttgtcaccaaaatcaagaagtaattaactcgtccccaatnnnnnnnnnnnnnnnnnnnnnnnnnnnnnnnnnnnnnnnnnnnnnnnnnnnnnnnntgcnntgtaactccgttcgca

SEQ ID NO: 24629 - DNA, 1885 bp, Oryza sativa
  unsure (1)..(1885): unsure at all n locations
cgtgtctttgannnnnnnnnnnnnnnnnnnnnnnnnnnnnnnnnnnnnnnnnnnnnnnnnnnnnnnnnnnnnnnnnnnnnnnnntgtttgtgtctcgacgagatgtataaatttggttggtacaatattacaaatatatatatatatatatatatatatatatatatatatatatatatatatatatatatatatatatatatatatatatatatatatatgtgagcgatgaaatcatatgtataatataactccaccattacaatggtttttagagggcatatcgaaattacatccagctgacgacgacggcgctcagcttcttcataggacgtacgtttcagtttccactcctcttttgttcttcttttcgcggggacatgcaataagcacgagcccaaattaagttgattatttcgccagattaagcaaaagatcacaaaaaatgtcaagaacaagagaagaatgtcatcgggttcagtacatatatgcatcgatcgatgaattaggccgggaggtaggacggcggcagcggcaggccgacgaccttgccgcagcggagggcgttctccggcatgttgtactcgtcccggagcgacctcgccggcgagacgacgctgatgtagagctgctcgccgaggtagtgcctctcccagatgttggacctcacgttccacatcccggcgttgtcgaacgtcagcatgatcgccgtccacgacctcgggtacacctggaccgagtgccggctcaccccgtccagcaggttgtacgtcttcctctcctccgccgaccacttccccggccccatcctgcgccatcagtcagtcagtcaacggtagcatcagatcgtatccatcatttatcttatttaaaaattttatgtaaatatagaaaaatcaaatcgtatttaaagtacactcgacaataatcaaattacaataaaattacaataaaatagatgataactgcataattatttttaaataaaataaatggtcaaaactcaaacgtttgtgaaaaaacatatattataaacgaatgttaaaagtaaaaaaaacatcgtatattataaatggaggtaatttaaaaaactttttttatatcattcgtcttattaaaaaattttattattatgcgcatcagtaagttagttaacagtagtatcagatcatatacatcattcataatattcaattttttatgcaaatataaaaaaaatcaaattatgtttaaagcacacttgacgataaatcaaattacaataaaatagatgatacttatataattttttaaaaataaaatgaatggccaagcctatctttaataaaaggttaatggaggtagtagtaatggggggcgatgtatgtacgtacccgacggcgaagaaggcgtagccgtcgaggtggacggagtccatgctcttctcggggttctcgaagatgatctcgatgaaggtgcggaactcggcggtgatgacgttggggacgacgtggagggggccattgacggcgggcggcacgtcggtcatctggttgtacctgaagacgccgtcggtgacgttgaagtactcggcgagcttgagcggcgtctcggcgtcgacgtgggagacgccattgaagccgtacttgagcttgccgtcgatgtggccccgggagaccatgagcctgatggtgcgcgtgatgttgatctggccgtagtggtaggacccctgcgggttggggcgggcggcgctcgccgtcaggttccaccggaacgacctccactggttgatcgaccacgcccatcccgccggcggctccggcacggccggcgacggcggcgtgctcgagccggcgtagcggatgacggctgacaccgacttggcctcgtggatgaaccgcgtggg

SEQ ID NO: 24630 - DNA, 988 bp, Oryza sativa
  unsure (1)..(988): unsure at all n locations
agccgcggtcacccacgtggcctgaccccctcgggggggtcgggcccgagggtgacatggccacccctcctcttgtctccccgaggggtcgggccgctcccgtttcggccccaaggcaaggggcgccccgaccccctgtgattttggcgccacgtgtatgggttaggtgagcacagcggggctcacctaactgcatttattgcggcttggacgagcgcgccacgccgcatttaatgcagcgcagcgcgcgctcgtccggtccgtgaccggtcgcagtgtgtgacaccggtcagatcgcgggttaggtggcaccaggcggcttgtcacacgcctcgccccgtcccgtcggaatgatgagagcctccaggcactcgtccctagccggagccggcgtgctaactcctggagttggcacgtcagtcccggccagattcatgccaggcttcatcgcaaccattacaaggaagtcattgtatgaagaagggcagatgtgcggcatgctaaactgacgcgtggtggacaagaatgaccggtctgtgactggtctgacgccggtcacgtcatcggcagacaaccgtgctcccacgctgcatctacttccggcgaagtggaggcgagtgacggcgctgggcctcactcaaggacaagctgtgatttagcttccaggcgaaggcgcgagccaagtttttggtcaagatagggtgggtccccacccaaaagaagagtaggtagaagtggtgcatgtggtatccccttgagatataaaaggaggaccttgcccaccgaaaagggatgatggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnac

SEQ ID NO: 24631 - DNA, 977 bp, Oryza sativa
  unsure (1)..(977): unsure at all n locations
tgaaacgtggctgatatgcnnnnnnnnnnnnnnnnnnnnnnnnnnnnnnnnnnnnnnnnnnnnntagttttccattttgaaaattgacggaagtagtcgcctaccgccctctgggagggcgatttttaaaaatcaccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttaaggcgtagtacagaaatgcgaggttaacgcagttattgttttcatcaggcacaatgtcaaataaggtcacatttcagatagttcacggtgaaggaaatattagatttggtccaaatggtgttgatctgtcagattttgaatgacatctaagggcatcgataggcctgccgagagaacatttcagtcaatttatagttggttgttgagaggattagaatagcccaagagtctacacatggc

SEQ ID NO: 24632 - DNA, 1664 bp, Oryza sativa
cccctcgttatatttgtgtgggtacaagagaaagatataaatgtttcaatgcaagccagagatgtagagggtcctatcaatccaggggatgttgttggaccatcgatgcaaaatgaggaaaatcaaccaaggagggagcaggccatgggcatggcggattagggggagagagtcggtataattgttgatgaaatggagagggaagattcggataatgaggaagcggcggacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacactataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtagtgcatgcgtcacatgggtgcaaatttctacaagcaattcaagaacaagcatcttatggagctctttaagaggctatgtgcacagagccaagagaagaaatttaatgagttgtgggacaagttggatgagttgacaatgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcgtaaggagaagtggtctctattattcgacaccgatagatctcggtatggcataatgacaaccaatttggcagaggtgtacaactaggtaatgcgaggagttcgggtacttccattgttgctatggtgaattattct

SEQ ID NO: 24633 - DNA, 5616 bp, Oryza sativa
  unsure (1)..(5616): unsure at all n locations
nttggctgaanaataaggggcctatgntatngtannnccntngnnnngtagncagngganccaagcttaaccagttcgaaccccgctccggtggtattccctccttccgccgttcctcgcgccgccccgccgaggcgcgccggtgtcctttttacatctcggccagccttcgtcttcctcctctcgccatccgacgcggccgccacgtaggcgccacgtcggctagaccaagtcaacccgccagcctcgtccccgctcgcgtgcgctcggtccacggaaagcctaacggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtaactagtcggttcagggaaacctcgcatgccaatagttgggaacgccagggcggggtcggttggagccaaaccgggttcctggtaagcaaggaagagaagcttgctgaattaccgatcgaggtggttggagtttgatttgtgaaaactaaaatggcctatatttatgtgaggatttgatccttctatgtggcatgaggtaaccctgggtcggcttgggaaaggctttgtcgcgagcctctgacaccggccagtgtctggagtaagttcgtatcttgtgggtaaagtgtacccctctgcagaggttaactaactgttcgaacagccgtacccacggtcatgggcgggtgtgaggtggttcccgttgcgtagatttgtttgcctgtactttgtgaaaagtggttgtggtttgggaatcgttaccagaatcagcctatgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcctaatcaagtgaaatggctctggaagccgataagtaatgatctgactcggggggtcgatacatttccaattgagctgttgaaaagcatctcttaagtcgatttgagacgcaagtctctttttgacccaaacttaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctatataaatatatatatagttcctccgccctgaagagaagatgaagtgaagtgaagaatagggtttcgccctgattcccagctgtcgcctgtggtgttgggtgttagaccgttggttccgctgctgctgttgttgttggtgttcgcctcgtccgtgtcgtcggttgtattctcgggctgtctgagctgcaaccaaggttaaggtaaataagtcctctatttattttaaggattgctatgattcatatttgttaccgtgggtaccagcaccatgtcctgggactggtaccgagaccgcggtttcgtaggaagcggttcgcgccgttttcccctacgacacgctcctgtcaggtgtcgttgtacgacggtaccagattggggtgtgacatttaatttcatatttccttttacatttataatttgttttatttaatttttcaagctcttctttccaattctctacaagcgccactggtttgttttcattgttcatctggaagatgaaatgtttgtctttcttgactcattacatgaagaaggttctgaatatcaagatgaagttaagaatagattggtcagtttattttcaaatttttaaatatatgtattactgttcaatttgtgatttggaatttataattacagagttttctttttatattttgtagacatccaattttgcacttgcttggaattccatcatggaagaatatcaaatcaattttgatgctttcaaaattgtatatccaccagtacctcgccaaaataatctgtaagttgtttttctttactgtaacttttagtccaataatattttttatttgtttttttttgttagagttgtacagatgcccaattgttctcttgttgacaggaatcttgtatgttttgttggtcattcagaaattcttgactgttctgtttttctaattgttgcataacctgtttgttttgttgttaatgcacaattttagtttgtttgttatgattatcattcaaaaaatttagttcctgtttgtcaattgtttcattcagaattactagatgggataagagcctgtttcttagtacaacatggactagaactgcaatagatttcattagtaaatttacagagtaaatagtatgaccataactgcattagctttttttaattttttttgtttgttttattttttatgataagtaactgtggttacttatgtcctttttctttttcctagttttgattgccgagtttttactctaaaatacatggaactatggggtccaagagttcagctgacaaaccatttctatcaaaaagacattcaaaacattaggattcaatatgtcaaccgtcttttcttccatccagacaattctgttctcggtacaggaacaaagaaactagtgattgactttgctcaggtaaattttttttagaatcattatttttttcacaattttttttatttagtccttatatttttatctctctttttatttgtagggaaattgattctggaataaattttgtttgttcaaatatgatagttggcaacttttgcaggactacaactgtacataaactcatgtggtagataaaatgcaaagtagttcataaaatgtagttgatataagaaacaaacatttaagtacaaaccagagtacatgttctggaatattacagaaacttatggaatatgtctatttccattgtattcaagtaaacctctctctattttcagtcatttccatttctattcttttgtgccacccctttttgatgaagatgaatttctcttctttttgccttctaattcatccccagaattatgcttctcctgtgatatatcttgttgcaaatcttttcttttgtttgaaacatctttctttttctgctctacaccatcctgcaacaaataatatctttctttattactttttttaaaaaaatcaattcatatggatttgtaatttttgttacctgttctcttgtatttttaacctttcttctcttcttccttggcaagtcaaactcaacgtgtttcagagggcacgttgaaaatgtgtgatctgtcctctgaaaatgactgcaatgatatagttctttttgctgtatttcttccataattgtcttgtatctttgagctggcctgcctttggattttgcaatatctggatccaacaatatttcttctgtattttcctcagattgttgattgccttgttcatgtgagttcaaattgtcttctgcatttggatctgaatcattgatctcctgctctgcatctttatttgaacacattaattccaattgtttagcgattttgtccatctcttccactgcaaactggaaagtttcattgcttttcgatccatttgatgctatttctgcacttttccttgacaaaatgttgaatctcaggattgagctctatgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgttcttgaaatgtgatcatcaaactgttccaagttttgaattgtatccattactctttcatactctatcatgaagtttgtaatgttgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccagatagattgaaagctttctttacaatatgaaagaagcaatttccgtgctttgcattttgaaatacttgagcaattgctgatctcattgctccatcctgatcagtaatgattatttttggttctttttgtgacatagctttcaaaaaagttctgaacatccatggggtccgaattctngagtttnaanngatggtctcaggagttcgtcct

SEQ ID NO: 24634 - DNA, 2466 bp, Oryza sativa
  unsure (1)..(2466): unsure at all n locations
nnnnnnnnnnnnnnnnnnnnnnnnnnnnnnncggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgaacaaatttccagatagattgaaagctttctttacaatatgaaagaagcaatttccgtgctttgcattttgaaatacttgagcaattgctgatctcattgctccatcctgatcagtaatgattatttttggttctttttgtgacatagctttcaaaaaagttctgaacatccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattccaaagttttcatcatatcattgctgcttgtctccttgttaattgtggttctcacattgcttatatctttcttcgtataaggcaaagaagtcaatcctcctcttagaacagataaaattacaatcatgtgccttgttggtattgtcggagacatgggaccgggggtatcttgactagaggtttggggcagctgcagtcacccatgtggcctgaccccctcgggggggggggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcaccccacgccgcatttaatgcagcacagcacactcgttcggtccgtgacaggtcacagtgtgtgaccggtcacagaccggtcagatcgcgggttaggtggcaacaggcggcatgacacacgcctcgccccgtcccgtcggaatgatgagagcctccaggcactcgtccctagccggagccggcgtgggaactcctggagttggcacgtcagccccggccagatacattccaggcttcatcgcaaccatggcaaggaagtcattgtatgaagaagggcagacgtgtagcatgctaaactgacacgtggtggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaggtgcaagccaagttttggtcaagatagggtaggtccccacccaaaagaaaagtaggtagaagtggtgcatgtggtatccccttgagatataaaaggaggaccttgcccaccaaaaaggggggaaaaaaagaaaaaaggacgctagaggggttctggagcctgaactctctagctctccggctctctgtaactccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgtccccggccgaaccggcaaaggggggcctgcgcggtctcccggtgaggagctccacgctccgtcaggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactgatttggattgagaagttggtttgccttgtctattacatctgaacgttactctagtcacttctccaggggtacggaattcccgagtcaaagagcaatcgagtcgaagcgcatatcaaaaggcggatntcaaaagcacg

SEQ ID NO: 24635 - DNA, 4481 bp, Oryza sativa
  unsure (1)..(4481): unsure at all n locations
aacttcaatcatcaatcattgttatctagagaaaaaggtacaaccaacaaaaattaccttttcaccatctaacaaattgaatatatcaagattccaattatccattgcatcctcttcattactctcatcttcctggaatttgaattacattacaaagttaaaatttactaaaattatcataatttttaatactacaacaggaagtaatacatccaagacaacatgcctcatttgccgcatcattattccattcttcaatattagcattagtacgatttgttgttaatatcattgaattctgcaaaacaaaatttttatatcaatacttatttgcttttgaatttgaattattagattcaattaaataattaatatttcatacctgaaatgcacttggactcgcaacaaaagtagagtgtgctgaattttgttcctgtaaattccaataaaaacagaaatattacaactaaattatatatgatattcaaatattgtttttcttacctgcatatcagaaatcgtaggctgtgatgatatgatttgttccattaagcttgtgtacgacatatttgcaacctgcaaataaattttcatatagtattttgactaccaccttcaaatttttcctttaatagcaaaaactttgtaatatgaacttactgaattcattgatccgaaaagagataattcatcatatgaatatttgttgctgtaatcaacaaatgcttctgtcacacttgctgaattatccatactttgcttttctactgttgcatcttctgctcctaatccaatatgatctgttatatttgcaattaaagtaattgtgatcaaattatatataggttccagtcaaactgtataacaatcaagttgaagtttaaaattattcttattctgtttcaaattgactgtaatttttgcattttgtgtttttttactgaaggaattatgcatttgttcaattccattttgaattgttacctgtgtttggttcatccagagcattgcttattcctacctcattacctgttatgcctgcaatagattgattgattcaacattaaaaattagagtaaatttgtattccagtttgaaatttttagtattggaattacagttttttatgtaatttttatacaaattaactgtaatgaaagaattgttctgaaatagaataagaatacctgtgtaagatcttacctgagtttacaaaagttgtttcatactctgtcaaaatactttgtttcatattctgaatttgttttgactgaatacttctttctccttctgacaattcaattgtgatacctgcaaaataaaaatcattatgaaggaagttaagatagatactgtattttcagttattgttacatgtatttttattacttcttctctgtaactagttttaatgttaatattttagattttaaaaagtacccacttgaaagtatatagttcagatcatttagatgtttgtcatttttttaaaaatacattgaactacataattttttgtttcttacctgagctcaacatagctgtgttaatttctgtcagattcgattgacttataatctctgtatccatttctgtcagagctttgaagtgcttttttatatctgatggcattttttaaaaaaaatttcagactcattttaatcttcttatttgtgaataaaatttgaaattatcttgttcacctgattctttttcttctatttccatagaactcttgctttgtttctccttttgtatgccacctgcatagaaagaataaattaatattgcaaagaacttttgaatttctaaaccagcaagttctgaaacatagagtgtatttcccaatctttttcataagtccatttacagtgaacatatatttgtattacagagaaattatactataattccagtaaacagaaactgtaactacttaaaaatccaactacaatcaatttgatacttgattatagatactgaagtgaacaaatgaatcagtttgtataattctttcaaaataattttaatattacactaagtatgtatttcaattacagtgtaatgctactataattccagttaaaatttactgtaactcttgtttacctatattttttccttctatttccttagaacttttgcattctttgtccttttgtatgacacctgtaaagaaatattcaagatagtctttaaatgtttttcaaacctgtatgagtatgttccataagtagtattacagtaaataagtatttcaatttgagtataatgctactgtaattccagttaaaatttacttatggaacaaactatctgatggcactttttcttataatatctgatggcactttttcttttctatttctttctatttcaattagatatgatttgttttggtttttacatatgtactacttttgaagtatttgataccctgttttttgctcgaaaaatctgaaatcatcttgaaattgagattgaaactgcattagatcatgatttcatatgaattttacattgtttctttgtagttacatgtattttcaattgaaattgtagtgttcactctatatatttgtaatacaagttcactgtaactagtttcattatattctattttgagacattgaacaaatcaacaatgatctattatctgaaatcttcattttgttgtctgatgatgagagaaacattgaactgagatagtcttgagtttaaaacatatcttgaatgtgttcctgaatttgtgcatgattgtgtgagctaaactattttgtttactgaactaatctttttacaatgagttaatactagaattattgtgattcttgtatgtaattttattacttttttactgtaacatgttaagaaatttgtgagttcatatgaattggctcttttgtttgtgctgtatgagatattgaacttttatgtaatattgagttggatgagacaagtggttgacattgagatttgaatttgtcattagtttaatatggtgattatgctgataaaattgaatgtatgacaattcaggatatgctatatggcctagttgttatatttctgtataactgtataactgtgatatcttcagagtgaaattcagtaaggttggaagattaatcaatctgtcatgtttttttataaagttagtttggtattcatcaatagtacacagtaatacaatcatccagaatgcagtttcgtagtactgaatgcagtgtagttttacttctaacattacatagttcagatctacagagcaaacatatgaaattttcagttctgagttgttgtatttatccagcaaagtggattgttaaccttgtttcatttgacatattcagcaatttcatgtattcttttgaattgtatatttgacctaaactctctctttgatctttttcaggaattgtatataggggataagaattggagccttgaactaaccttgaactggagccttcttgtttctcttgattttgccttcctcttgttttttctttgtgttcgccagattctgtgtttcctttgtatggatctcaactttctgttcagaagttgtctttgatttcttctttcctctagaactactctttgattctgacattgtactctctccttccatctgcgatttggatcctctttttctctcttctttctcttctcctagctccatgtttgattcgtgctagatctgtttgtgaactaatagtgctgttgaaaagtaggggattgaaaagtgtggtcccatacatggttgattcatgtgacatgtttttcatctacttggcttccaagtttggcccctactacttttttggataggctgttggattataatttgggctttatttccttgtgttttgcttctaattttgtatcttgggcctgctttttactaatgggcttttatggatctggatatggacttgggccttcaaataattcgcatgggcgaaaaaatcatgggctttgtttatttgtgtttgattcaaattttgtattttgggccttctttttactaatgggcttttatggatctggatatggatttgggcttttatggatctggatctagatttgggctttaaaaaaatggcgttcaaataatcaaataatatatctgtttttaagtgtaatatctatttgtatcactttttctgagttgttggatgtgcatcctatggtagataaaatctgcatgattggagcttcagaaatcattcgattcctatatagacagccccattttttatttgtcttggatcgaccaaaaaaatgcaatagatcttggtgcgaagaaataactgcttacatattttcattttagttctcgatatttttagaaatgtttctaggtaattaacatccaattgtagaagagaaaatataacattgtcgtcctgaaaaannnnnnnnnnnnnnnnnnnnnnnnnnnnnnnnnnnnnntgaggcgcattcattccagcgcg

SEQ ID NO: 24636 - DNA, 4047 bp, Oryza sativa
  unsure (1)..(4047): unsure at all n locations
aacaagtagtgctacatgcatattttcttaagcatggagtaaccttagggggatgatacagaacggtatcccgtttggatacattttcctaaccttatgagtcccctaattttagtactgtatttcttgattgcttattcatgcatgacaatatcagaaatcgatattcatcattgccaatcataagcagaactgcattgatgcgtgtcatatagctacaggtactatcatgacactcatgattcttattttgcatagtaatgaaagcatacatgaaaaaaccacttacctacagtttgcctagattatttaacctagttaaacattgtagacagctattgaagtatttctgacagtaatgactttctcaatctcagatggttcaaattgctagagcctacctttccaattatatagctctctctctctctctctctctctctccaacatgtaggttcatttgggaatcaactaactacctcatgttaattccgtattagttttgcagtacacagagcagcacaagctcagatgatgcaccgtagcatcggtattgaaagacagtcgagcaggacgtatgtgaccaacttctacaatttcatacaaaattacaagatttttaccatattgactcttagcttatacgacagtttagtttctgtctaaactttcagatatgaaaagatcgcaaattgtattgctccatctaattgattagttataagactggttggacatgccatccaaaatagatagactggttgaatggacttgaaaattacttcaaccatgttgaatggagttgagaattacttcaaccatcttcctgtcatgagatgctcgtgcaatgctctcgatgttcattgaagaaaaatgaaaatgaacaaaacaaaagaaaatatgctccatattatgtcgcatgtcatagtatataatgcatgtcaaaacgtgagcatgcactggtcatatatccacaataaatataaaactaagatataagcagtctgtgaacatttatcaattatcagaagattattagcaactgaagaccatgcaaatatgtgggatgcgacccaatggacaaatctgaggtaaataaaaaaaaatgagtagagcatgttcaaatccaattaatgggcaatgcaagcccaagtccagactttgtaaagttaaattcaatttaagaataatttgtatcaatacaaaagttgtagaatttatagtatatttggcgatggataatctagaaaggactaacatatttggaaagagtttccaaaaaaattggcatacaattttgcaggagagaaaagggaaaattcctaattgcaaatgcacagtgaatagttacatgcataattgcataccaatataccattcaactttacaaactttacttttgtctctgaaaatgaaagattaatgtgtaaattacaagtaaattattaaggacaattctataaaagaaaacttggtggaaaagaagtaaacccaaacctttcatggatcaaagaaaaccactgcaattggtatcatgccttataatgctcagcttcgttacaggaagaacacctatatctttgtcgatacctatttgagagctcaataggaaacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaattaatcagattgactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcggccgggacggtgatggagtgaagcacagtcaacacagcgtggtggagcggaggaccggcgcgtccgagatgatggagaggagcgcatgcaggcgagtggagccaagtgtgatcgagggaaaggagatggcatatgtaacgctccgcttttcgtgagacgttaaaaactaattcggtaaaatcctaattgcgaaaattttcgttctttgtgtgcgagtctaagtcgtgccaagatctcatttcaaatctcgttgttccctctcatcgaaatcaaaatcctccacctcaaattcctcttccgattcaagtctccaaatcaaattccgaaattcagtcgcatcctttgaatcctcgctaaacgctcgctcccaattccgaaaaataccaaactctatcttgagccttccttgattcctccctgaaccctcgagttcgaatatcgaatttgaatccaaatccaaactccaattctctccaaatcagccttctctgtgaaagtctattctacctccctctggctcagtgggccgactcttcttccccggcccatctcctctcagcccgctcccctcctcatgtgcgttgcacgtgccctacctgagagaaagcgcctctctctctcccccgatctctctctctcgttttctctcgctctctctcgcccgcgctccgcgccgccactttgtcgttcaaacccgccaccgccttcgctctttcccgcgcgcgcgcgcgcgtggccgaccggccggtcgctgccgccgtccgccttgccgcgcctgcgccgcgcagccacccagccccgctcgccttttgccgacgtcgccactgtcatcgcctggttccgatgcccccatgccgcatccttccaaaaccaggagacagagctcgtgctcctctctctcgttctcatatcctccttcctcccaaaatagcaagggagcaaagctcgtttctctcctcttttcacctttttccttagccggcgtcacgcccgtgaccgcctctgccgccgcttggccgctagctccgagcacgaccgccagctgccgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccgtcctcgccttcctccgccatcgcgtgtgccgggaagccagcgtgcgcgcggagccaaagaggactctggtcgccctctctccctccccttccccggcccgagaccgaggtgatcccgcatgtgccgtcggacgctcttcccagcgatctcccgacgcggtagctcctgttctccctccccactcttcctcccccctagnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24637 - DNA, 744 bp, Oryza sativa
  unsure (1)..(744): unsure at all n locations
aggagaacggatacaagtatttatcnnnnnnnnnnnnnnnnnnnnnnnnnnnnnnnncctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttctaagctaccagccttccactgttgcgaggcaaaattccccccccccccccaattaatactagaattaactaacaatatattgtacaaattcatccaaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggaccgaaggagtacatttctgcattttctttacacagcgtctgaaaccacaaactgcatgtctgaattgtgaacatcaaaactgtctgttctccaccttgcagagactgtacatgccaactctgaaccagagagactagacctactactgtctctgaactctgg

SEQ ID NO: 24638 - DNA, 1009 bp, Oryza sativa
  unsure (1)..(1009): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagttctccaagatggcgtccgtgctggtcatgcagcagtacgtcatcacggcgccgctgccgccgccggtggcgctcgccgggccgccgacggatgaccccgtccggcagtatttgaccattcgatgcattggctcgtcagcgactgagactagatgcccccactgagaaaccacaaggaacaggaaattaatggaagatttgatctgaaagcgagtagctgctcaaatgtgaccagaaatgaaatgttcctctcgtgctgttcatgttcatccaatcaacttaatggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24639 - DNA, 991 bp, Oryza sativa
  unsure (1)..(991): unsure at all n locations
ttaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24640 - DNA, 741 bp, Oryza sativa
  unsure (1)..(741): unsure at all n locations
agtgtagaanatcttgtagactcncgtaangagacnnnnnnnnnnnnnnnnnnnnnnnnnnnnnnnnnngcgcgtgatgttgatctggccgtagtggtaggacccctgcgggttggggcgggcggcgctcgccgtcaggttccaccggaacgacctccactggttgatcgaccacgcccatcccgccggcggctccggcacggccggcgactaaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagtaaacactgtaattaagcgaccaaccatgaaccatctcatgaacaaatgaccactattagaccaaatggtgcttccaggtcagaaaaaagaatatgccg

SEQ ID NO: 24641 - DNA, 980 bp, Oryza sativa
  unsure (1)..(980): unsure at all n locations
cgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcgcccgggacggtgatggagtgaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24642 - DNA, 1001 bp, Oryza sativa
  unsure (1)..(1001): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaacgcgccgcatctccgcccgctcccgtggatcctcgtcccgcgcgccgacggcccttccttctcgtgcgccctccgcggctgcggcgggcacggcctcggcgtcccggacggcgcgcgcgccgcgcgctgcttcggcgcctacgacggcggctggatcttcctcggcgagacctgccgcaacacgctcctcagcctccgcgaccatcagctgcgcttcaacctccccttttttgtccgcccggacaagacggctgctgaattggggcggccagacggccctgtccctaacactggtgtgatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcca

SEQ ID NO: 24643 - DNA, 742 bp, Oryza sativa
  unsure (1)..(742): unsure at all n locations
atgcgggttagacnactcattgataacccncgnnnnnnnnnnnnnnnnnnnnnnnnnnnnnnnnnnnnnnntgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccggaggggcggcgcggcgtctacgcgtggcgcgagggggatattcgggtggcgacgatgaggtagacgacgcgcgtgggggcggaggcggcggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgttatttaggtgcagctctttttattattattattttagattttcatttcaagcttgccaaccttgtaaaaagtaattattgggtatatatttctggataaaata

SEQ ID NO: 24644 - DNA, 759 bp, Oryza sativa
  unsure (1)..(759): unsure at all n locations
aagtcgttagatactgggttgcaaccnnccccnnnnnnnnnnnnnnnnnnnnnnntgagtgaaatttctgatggacgaccctgacctccttctcattgttggtgggtcatcatgtaatgcaccaagaggtatgggaggctcgtcaccttcaacttggggtctgcgagattgctcatctgtttgcttcattgtcaactcatccaacttgtcccacaactcattaaatttcttctcttggctctgtgcacatagcctcttaaagagctccataagatgcttgttcttgaatccgggcgccgagttcaacgagggcgtctacttcctggatgacgggagactctacgatgaggcgttccaaatcttgaatccctttgcccagttcccctgcagcgacaacggcaagtggctgccgccggcggtggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatccatgatgtgttctcgagatccatgtgtgcttgcaattgctttgatccatcatagcatctcttcagtactctgctattttcaccatgttagactaatgcaagaaattgttggttctcatgactcagattgccttaattagtgaatcaatatattgcaaccaaacactgat

SEQ ID NO: 24645 - DNA, 1037 bp, Oryza sativa
  unsure (1)..(1037): unsure at all n locations
gataactcacccatcatgctcatctcaaattccccgcgcatagtctcagcaaattttcaagcaaagcgtgagtcgaacaaccaaagatgatatcatccacataaatttgacaaaaggttgattatcaccatgcttgagaacaaaaagtgttttgtcaacctttcccattgtaaaacctttcgtaagtaaaaagtttttcagcttatcataccatgctctaggagcttgtttcataccatacaaacctttagaccatttaaaaacatgattgggaaaatcagaattttcaaaacctggtggttgtttaacataaacttcctcctgtataaaaccatttaaaaaagcacttttcacatccatttgatacaatttaaaaccttttgaaacagcaaaagcccaccaaagtctaattgcctcaattctagcaacaggagcaaaagtttcatcaaaatccaaaccctcaacttgagtaaagccttgagcaacaaatctagctttatttttcacaatcaaaccatcttcattttgtttatttttgaaaacccacttggttccaataatattatgtccaaaaggtggttcaactaaagtccaaactttatttctctcaaaattttcaagctcttcatgcatggcgttaagcatggagtcatcccttaatgcatctcacaaatcttggggttcataataagcttcaaatgcagcatttgctccaacatcagcagtcgtatcctcagtcgttgcagtacgcccacctatattaccaataatttgttccggcggatgtcgtcgttgaatgtgcaaaagagcagtgacttctaaagttgatccatgttctgtatcagtactggtcgaagtagtaatctctggaggaccatctcgatcagcatcaacagtacccgaacccgacgaccctggccggtctgaccgcacgtcctgtgccggtctgaccggaggtgtgtcggcggtctgaccagcctgnnnnnnnnnnnnnnnnnnnnnnnnnnnnnnnnnnnnnnnnnnnnnngacactaccc

SEQ ID NO: 24646 - DNA, 696 bp, Oryza sativa
  unsure (1)..(696): unsure at all n locations
caacgttgtnnncgcatgacaggnggccganncnnagnnnnnntagantggaggaattnggtacccccaacttcttagtggttttctccactactacctcttgttcttcacccgcagcctggtttaaactgatcagtggcttgtgcggcactggagactggaaggttaccacttctcctttcacattggtcaacttgatggtgcggctagcgcaatcaatcactcctctgtgccttgtcaaccaatccattccaagtatgacatctaggtccttggattcgagaagaatgaggttggctggaaaaatcaacccttggatttcaactgtcattgacgggcaatagtgagttgtggtcatgcctcctccaggagtatgaactcgcataggtatcttaagcttcactaaagataacccatgtgcaccagcaaaacgcttacaaatgaacgaatgagttgcacccgaatcaaacaatatttttgccggtgtcgagtcgacaggaaatgtgccccatataacctntggtgctgactgcgcctcctctgcaaacccatgattgacaccggcctgcacaaacatgggtccaccatgtnttgggttcggcactttcccaccctgtgtccccgcttgctaccattgaaggagagttccggcttttcttccaanctcttgggctgttntggcacagcttgctgagc

SEQ ID NO: 24647 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnatggatatcccatggaatggggcgaccgggatatagaaagccttgggaaaattaccgcgcactccacaaagggccaagggcgacctccaagctcaggaggaaagctcggccctttgctctgacccaaaagagaaagggcagcgatgagcgtgaatagaatacccgaggggtcggacgttcacatccccataagactgaatggcgagacggtaccgccctctactgttttgaggggtgggagctaaaactgaacctcaataggaagggataagaacggatatatgatcaaggactgggatatatagtgtgtcagcaggggacaagaaaactctttgggatgagatgaagaaaaggttctagttccctgagggatcagaagcaatgacaaggaattgcgcattgcaaacaatggacaaggcgtggcgcggatagaaaaacactctgaacacacaattcgtgcagaaggggaaggcaccatttaagaaatatgggaaaataacgctgaaccaatgggacaaatttgtaaagttcaagacctcgccggaagaaatggccaagagtaaaaggttgtctgacttggccaatccaaaaaaatggcaccatcgactgggctacggtgggtacgcacgtaagattgcactgtggtataaagaggatgaggaaatgaag

SEQ ID NO: 24648 - DNA, 701 bp, Oryza sativa
  unsure (1)..(701): unsure at all n locations
nttttggccttttgagactagantancntcnnnnnnnnnnnnnnnnnnnnnnttgaatttcctggttctttgaaaagaattcaaagtgataatggtggagagtttaaaaatgcttcatttgaacgattttgcaatgaaagaggtcttgaacatgaattttcgtctcctcgggttcctcaacaaaatggtgttgttgaaaggaaaaatcgtgttttggttgagatggctagaacgatgttggatgagtataaaactcctagaaaattttgtgctgaggctattaacactacttgttatatttcaaatcgagttttcttgagatctaaacttggaaaaacttcttatgaacttcgatttggacattaacccaaagtttcacatttgcgtgtttttggttgcaagtgctctgtcttgaaatctggaaatttggataagtttgaggcacgttctaccaatggattgtttcttggttatatcgtgtacttattttggggactaacaaaatcgtggagacttgcgaagtttcttttgatgaggctagtgcaggtattagacccgatattgcaggtacactgtcacaggttcagggggaggatggttgtattttttgagatgagagcgacgacgactaccacgacgaggtctgctcggccgtcagaccacgcaccagctggtcagaccgccacacacctcccggcaga

SEQ ID NO: 24649 - DNA, 1362 bp, Oryza sativa
  unsure (1)..(1362): unsure at all n locations
aggttnnnattgatggctgtcgagnnnnnnnnnnnnnnnnnnnnnnnnnnnnnnnnnnnncaacaccaatttggttctacagctgtgttggatcctgatgaagatggtgaagctgttgatcaaaaagagtatagaagtatgaggggatctttgttgtatctaactgctttaggccagacatacaatttgctgtgtgtctgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggaagttgtagaattgataggaaaagtactagtggaacatgtcattttcttggtacatcattgattgcatggtcttttaggaaacaatctagtgttgctcaatcaactgctgaatctgaatatgttgttgctgctagttgttgttcacagattctttggcttttatctactttgaaagattatggtcttacttttgagaaagtacctctcttttgtgataatattagtgctattaacattgctaagaatcatgttcaacactcacgtacaaagcacactcatattcgctttcactttttgagggatcatgttgagaagggagatgttgaattgcagtttttggacaccaagttgtaaattgctgatattttcactaaacctttggattctaatcgctttgcttttcttcgtggtgaattgggcataattcatccttttggcatggtttgagggggagtttgtacctcatggttttatcaagcaataatatgacaatgagaaaaattgagaaaagagagctttgtttatgcatatggtattttcttgtgcatgctagcaatactttgaaggtttatttgtttctagcatagcttgtatgtattctagtcttttcatgagatttagattttgcttttaagggagatgatgcatgacacttaaattctatacttgaattaagaaaatatgcaatgttgatgctagcatatggtttgatctataaatgctctatatatatgctttattgacttgttattcctcaaatagctttaattgcttattgtgaaaaagagaataaaaataagaaaaaatgaatcccgaatccttgaaaacagtcatgacgacaaggacatcgatatatacttaaatcaagtgattgggatagatcggtcgccatgccgagactgtataaatcacttagatcaaaatatatattaataacannnnnnnnnnnnnnnnnnnnnnnnnnnnnnnnnnnnnnnnnnnnnnnnnnnnnnnnnnnnnnnnnnaggcgcgg

SEQ ID NO: 24650 - DNA, 5057 bp, Oryza sativa
  unsure (1)..(5057): unsure at all n locations
tgtaaacttgaattaaagaaataatcaatgtttattgtagcatatggtttattcaataaaggctctatatatatgctttattgacttgttattcctcaaatagctttaattgcttattgtgaaaaggagaataaaattaagaaaaaatgaataccgaatccttgaaaacagtcatgacgacaaggacatattcgatgtgagcaagaaaaaatggggtgccgaatccctggaaacagccttgacgacagggacgtacccggaataatagagaaaaatatgagaaaaaaaaggttcaaaaaattctcttggttattttgtgctaaaggttgtttgagaaagagtgataaatacaataggtatatgtgtttagtgtttattcttcaacctatgtgcttgttaagatgttgcattataaatcgtatgaaatcatgaatttttattattgtttcaaacttaattgtaaaatctttggttcatggttatactttaatgcatgcttgttatgttatagatggattcatcttctttttattgcaacatatgacttgatatgctatatgtatgctgagctcttgaacattaatgaacataattcctatgcttgatgaaatcattgtcaaatgggggagaagtaatgtgaaaattttggattttatgaaatcattgtcaaaagggggagaagtaatgtgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttggtgatgattgggtttacaggtgaatcgcaggattgttatttcatgtgaccggtcagactgggctctggtagccggtcagaccggcgtgtaatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactaaggctagagttgatgcacgtggttgatggagattccatatggcatacgatggagttattgtgtgcgtgtgggatgcggagttgaatttggaaggagtccaaatttggtacgattggttatgtaaagtttctttcttgtactagagggtttcctaaggtgtttaggactcctagtatgagtttggttcgtggctttaggctgcctaccccatgtataaatagagggggagcgtgaggcttccctgtatcgctttagagagcaattgagttgagttttgagttagggtttcgagtttagtcgaaatttttgtaaggagtgctgttggtgcactttgtaaacacagagagaatcaataaagtcgtcatctactttaagagttcttcgatttgtgtttaccgggtttcggcggtctaaccggcaactcaccggtggtcagaccgacggcaatcggcagtcacaccggcgggaacacggcggtcagaccggcggcggcgatagcaagcagcaggcgatctcggcggttagaccggtagatcaacactggtcagaccggcggctcgcttcggtcagaccggctaatctacttcggtcagaccgatctcatcgaaattgagggtaacttttatttccgctaaaagttttcggtttttgggtataccaaccattcaccctcccctctctggttggcttagttcttgtaattcgattctatagcaaccagtcatgccagcatgttctaggacctcaagacaatactaacacggactgagatggatgtcggtaggacgagcacttatcccaagaaagtgatggaatttgccaagatccttcatagagaactcagactgaagagcagtgataatcatccgtaggaggtcaccaaagaaagctatatatggggacaatatcatcaacatatagtaatagatagatcacagaaaaacctcgatgataagcaaattgagacgcattagacttagcctctgtgaagccaagagaaagcagaatgttggcaaactagctgtaccatgaccggggggcctgttacaatccatagagggacttgttcagacgacaaaccatgtcaagcatggtgggatccacaaatccgaccggttgagagcaataaattctcctgaatagtaccatgcaataatgcattcttaacgtcgagttgatgaatcagccaatcccgagagctgaaagtggatggttcgacaatcagcgtaaatgtctcatcgaagtcaatgccaagacgttgtgtgaagccacatagaacccaatgagccttatatctgtcaagagagccatcatcttaaacttgtgacgaagttagtgtcgggtgtattcggaatgagctcccaagtgtgattcactagcatagcattgtactcatccattggaacatgctagtgcgggtctattcggtgaggagttcatataagcacgaaacctccataatctattcagccgactcatagaaatataatcaagagagatatggggagggtcggtagggatcagacttctcgacgaggtcaaccggacagtgcacagttgataacaagaggagacgtagtgctgtgattgtagggttcggatcatgttgatcgaaagccgaatcatgtttgtcaatttccatcaaatcaagagttatcaatacctaccggaagatcgagacctagtttcttgtaataaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtaaccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtagaagaacacgagcacgcaccatgatatgtgatattatcttctaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaggattagattttgtttaacttttaaatttccaacgtaccattagttttatattattagaataagtttgtaaaatttaacagaaatttatgttatgatggtatagtttgaggcaaatacatgtatgcggtataggatgatatttattacatcctaaatgtatcgttgtgaacgggtataaatccaactccatctatctagtttattttgtgagagcgtttcacccaactcaactcccactatcaggtggatctaaatctaactccatctatctagtttattatgtgagagggttattccacccagcgttatttcagatctcatgttttattttggcacgtggcgcgcacatccagcgcgagagaaattaatgaattgatttatgtgcacttgcttctcaagttgtaataatcactagctatgcgctttgtaacgtcaggagcaatgaaccaagtcacaaggaacctggcttgtgagtgggcgagcgatgggatcagagtcaattccgttgcaccgggctacatccagactccactcctaactgccgtaagttcctcgttttacaaatactccctcctcctattttatgacgccattggcttttcgaccgacgtttgaccattcgttttatttaaaaattttatacaaatatgaaaatatttatgacattcttaaagaacatttgatgataaatcaagtcacaataaaataaatgataattacataatttttttaataagacgaatggtcaaacgttgaataaaaagtcaacggtgtcatacattaaaatatggatatggaggtagtaatatttttcaaaaataataatagctaggtactataattttagtgccgctttgttttagtatcttgctacgcnnnnnnnnnnnnnnnnnnnnnnnnnnnnnnnncaacgcgtgcgcattcaagagc

SEQ ID NO: 24651 - DNA, 2554 bp, Oryza sativa
  unsure (1)..(2554): unsure at all n locations
cagtacattaagaattgaaaagtttttcctacatttaatgtgagagttcccaccctattggtgctatatgtcagatgagactaaagtggaaattgtaagagaaagaacataaataattaaatactatttacgaaagtttgtaactaggacatagtactacttattatgaaaaagtttataactatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacttccaagaagaatgaaatctttgtgtgcccgtgtaccaaccacacacaacaggctagctagtcttctctgcatgcgtagagcatagactgggtgtaatgtgtaaaatggccaatatatatttgtattaagtttgggaaatcatgtggagaagattggcaagccgagtgtaatgaattttccatgaaataaaatttacggttcctatgattattgatacaaaacagtatgaatgagaccttgatttgttttgacttaagattcattataaggtttattcatgctgtattggaaaaatcaactattcattggattcgttccttttatacactagtacagatcatcttatctgtgacggctcctcacatgtctaggttttgcgggccgtcacaatgaagtcatctcaaacaggcccaaaacgaggccgacaaagatatacttgcacagacatgttagatgtgcataaaaatcgagcccgtcacggatgacacctatttgtgacgggctccaacttgaggaccgacaaagataactgatgatatctttgtcgggccctaacagaagcacgtcactgatgtccatcattggtgacgggctccaacttgaggcctggttgaaataactattatattaggcccatcacgatgaatgttatcggtgatgagcttttacttaggcccgacaaagataactaaaatacctgttaccgtcgtattttttttggccgttacagatatttattgcacagtataaataccccaactacctagtgtaatggttatcccactgttcactattttggtgggagtataagacggtgatttttgtctcttttctccaagaaaatcataaattgcaaatttaattgaaaaatagtagtcaattctcaaaaatttagtaaatacttacctacaaaatgtatatgtaatatttttctacttttatgaagctcggggatggatcaaagttacatgtatgggaaaactatgcgacgtcataccaaggtgtatagaaatggcatattgaattttattaacgccgcggaggaggataggaaaagaagaacaacgattgcatgtgttgtccatgtgcagattgcaaaaatgagaatatgttttacagcagagtggacgtacacgctaatctgatacaaagagatttcatgaagggctacacatgttgggtgaagcatggagatcaaggatcaagaagtggtgcacaaaatctagaacatgaagatcatgagcatgaatcaggaagtggtgcacaaaattaggaagatggagatgagcatgacatgtttgtacattctccactgggcggtgaaatggttgatgtggatcacaatctactgcaagacatgttacgtgatgttgagaacctagcttacaacgagagagattctataaagtttaacaagttggccagtgactcggagatgtctctgtatgccgggtgcaaagcaaaacacaccaaattgtcagctaccttggacctaatgaagttgaaggcaagtagtggatggacgggcaagattttcatagatcttataggaattttgaaggccatgcttcctaatgagaacacattgtccgagatgacatatgaagctaatcaggttttgtgtcccctggggttagaggtcagtagaattcacgcttgtccaaaccactacatattgtaccacaagcaatatccgaacatagatcttttaggaatttcatgtgatggatgaaatattttgtattattaaaaaaactttttgtacgaatgaagtacttatattcctatgaatttctattgtagcattaaacaagcctttctgttatatgaaattagtaaattatttagtgaaatatatgaaaatagtaatttttatagtgattttagttaatttggtgaattatttagtgaaataaataattatttagtgaactattgttcgttactaattatttagtgannnnnnnnnnnnnnnnnnnnnnnnnnnnnnnnnnnnnnnnnnnnnnnnnnnnnnnnnnnnnnnnnnnnnnnnnnn

SEQ ID NO: 24652 - DNA, 723 bp, Oryza sativa
  unsure (1)..(723): unsure at all n locations
cggacgcgcactgtatacncctgtnnnnnnnnnnnnnnnnnnnnnnnnnnnnnnnnnnnnnnnnnnnnnnnnnnnnnnnnnaacacattatggatgccaagcatgttggagggaagctcaagctggtaagcaacttcacccctgcgttccaaaatccgatatggtcccacaaagcgtggtgccaactttcctttggtttggaagcagtgtactcccctgagcggagtgacacggagatacacataatcccctgcttggaaaacgagctcccttcggcggttgtctgcatagcttttctgccgagattgcgcgattctcaatctttccctgacagctctaactttttcttctgcctcatttaaagcttctgtaccaaacaactggcgttcccctgtctgatcccagaagagcggagtacgacaccttcgtccatacagtgcttcaaacggtgccatttgcagactagcctggtaactgttgttgtaggagaactcagcatacggcaagcttttgtcccatgctccacccaagtcaagcgcacaagctcttaacatatcctccaatatttggttgactcgctcggtcggaccatcagtctgaggatggtatgctgtgctgaaatttaaaacgggttcccaattttttttgaatttctgccagaactttgaagtgaattggcttnctcgatcgacaccgattttttatgtacaccatggtaacaca

SEQ ID NO: 24653 - DNA, 1013 bp, Oryza sativa
  unsure (1)..(1013): unsure at all n locations
acaccgtcggtttggtttttcaaaacctcctatggcatccaccagaccagaaagctgtttctccctcttcaaatagtggtgcaatgggctgggcactttagaaaggttctcaatgatccgcggttattagcccccatgtcttaagaacttcggatacagagtgactgtcctgggtgggtcccacttggtacccgactccacatttggtgatgccaccgctactccttgagcattcacgatgtggccgagaaactgaacttccttaagccataagtcgcacttgctgaacttggcatatagctggtgctcttttaacttttcaagtaccagccggagatgctgctcatgttcttcctcggacttagagtagataagtatgtcatcgatgaaaaccacgacaaacttgtccagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtcgatcttagagaacactgtagctcctttcaactgatcaaacagatcatcaatccttggcaacggatacttgttcttaatagtgacctcattgagtgcgcggtagtcgacgcacatccttttggctttatctttctttttcacaaaaataactggagcaccccaaggcgacgtgctcgggcggatgtatcccttctgtaactgttcatcaacttgcttcttgacttccgccaactcgtggctcccattctgtaaggccccttgtggatcggtgcagttccaggtaccaagtcaatccggaactcgatatccccttttggtggcattggtgtcagatcatcccgaaaaacccctggatactctctgactatgggaatatcctncaacttcttagtgggtttctncactactacctcttggntcttcacccgcagccttgt

SEQ ID NO: 24654 - DNA, 1426 bp, Oryza sativa
  unsure (1)..(1426): unsure at all n locations
nnnnnnnnnnnnnnnnnnnnnnnnnnnnnnnnnnnnnnnnnnnnnnnnnnnnnnnnnnnnnnnnnnnnnnnnnnnaattatcttaatcttgattaaaacactgaaaaagaggcacgcaactcctaattgaggcagtcataccactgacacatgatatcgaccaccgactaaccctcaagcaacaaacctaaacacgaaaactagcaagcaaacagactaagaagacgataaagctaagggcggcgactctgaagctcggggcggcgcttgcaatcgagggataggactgacatctaaagtagacaagggataggaaccaattcatgctcaaatccaaattaaacaaagcaacaaatgactcaaataaataacctagcatggtgatttttatgcatggaacaaccttttccacgaaccgagacaaaagacactaatgcaactgactaaacaataaattaatgcatagactagttgcatggaaaatgatgcgcataacattgccccatcgaacatagacacgacctaatgcataacccccaatagattcccgactgactgtcgaataaactccaaataaaattttactaaaaccctagactgagctaattttaaagatccgatccgaatgaacgaccaagattttttttcccaccaaccaaagaggcaaaccccaaattttcccgaaacaaaatccaagtgaaaaaggcatatgcatatgaaaaagggttcagagggctcctaggttttctagttggcttgccctacggtcaaggtcggctctgatgctaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccacttcacaggcaatccttgacggcagcgacgaaaccaactttgacaaaacagctccaactaggaagatcttcagctctggtgtggggaaaaagagagcaagactgagtactacccactgtactcagcaagtcataccggaagaggaggtatgatgcaggatataaccaaaggaggctaggggttcttttgcataaagatagcatttaaaagcagtagttgaaagcagtaaaacagttgtagcaattatcaatattaaccaaacactgtccaacgttacaccacgttgcaacaggcccaaccaaccacttgaactacacccgttcattaagctaaactaggggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24655 - DNA, 5279 bp, Oryza sativa
  unsure (1)..(5279): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgataatgacggccgcatagatgaactagcgctacgtccacaccacgaaagaagaaaaaaaacgaaaaaaagggcgagcagcaacagatggccaatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaacacaaattttttcataggccgggatcctttccacaccgggttggtccacgggggttgggtcatgaccccggccgttccgggtctaatcgaacatagccttatggaattagaaggcttataggtgttggcaaaactaaactaaggtcagggctatggcctaagcttatggcaaggtaaaaaaaaattcaaaacaatttattattttttggtttatcatgtgttcatttatatatcttcttccatttattccctttattgaaatatttgttgtggttttgaattcatatggtcttttatgttttttatcctattatgatgaatcttgatatagattggtgttcacaaacattttgggaaaaaaattgttactgataaggttttattagtgtttcacttatatgggtgtagtacaacttatagcaattatccgaagtgtcaatgaacctctattttaaaagataggttcaatgtgggctttcattttgctataaaccttgttttagattgtgtgggtgtgttatttataaatgcattcctgattttacccgttgtcatggagtttgatcattcgttctgattgttgtcatggatactgattacgatcaaatattgaatattgccttgtttattttatttcttgtacaatgtgaggcatgtgttgatattaatcacttacaatttattagtatatgcacttttagcttccttagggccaaaggtcaaacagaacattcacttataatttattttggcacaacatttatatccttaacacatttcaaattttaagtttcatgtcttagggttaaaagatatgaatcatcacattttagagttacgagcactagttaaaacatagataaacacaatttttagtgtggttaataattacctaatttggtatattttgcatactgtgcataaaataaacttttgaccaattttattcctgtttcaacagatagatcagcttgaattcacaaaattttagaaacaagtttcactcaatttggagttgatttgaattagttataaattttcttaggttaattcacttttttcttcattgaaataattataagtgtattacgcctattttttattcattttcccgaattagttttctaaaggaaaagtccccttacactgacaggtgggtcccagtcattttattaaagaaaatattatttttagtagaaaatgttgaaccatggtgacggtgaaactttaccatcaaatggcaatgggtccatgtgccaggaacgagagtttctttaccaaggatctggtcctagatgtcaatgtcccaaattttcattaggacatgagcatttgcatgagatattgatcaaaacatttcctggtgagctccttatatcatacgctcttttcttgggaaacttttattgcatagcgtaccggatgagactcctctaactttatgcagttggggctcacatgtcagtggcataactatatatttacatatatttacattgtaggaagtcagcgatccgtttccaacagcacctaagctgagagccatccgatgagcttttctattcgtgttgtacttcatgcattttgtttggcgcacggatccgatgaggcgacgaggcaacggcacatcgacgcgatggtgcgcaagcacaagtgcgactggttcggcctacctcgaagcagcaacgtgctggcgcaggtctgcatcatatgcgacgtgaacgcgatgcaagggaggagcaagtaagagagagcggtggtcctgcgcggcttgggttagggcacgacgggcggtacccctcaagcactgcagcagggtgcggccggccggcccgggtcatcgacagaaagctcaacagagcagggtgtggtggcggagcttggcgagttgcccgcacggtgagcacggctgccattgctggtaggaaacgatggagaaataaacgattaaaaacaatagatcaatcacagaagacacgagattttaacgtggaaaaccctcctaaaacaggagagaaaaaaccacgggcgctagcaagcaaaatatcttcactatatctagggtgaggttacatcgcggtacggcggcttacaagaggtatatatatatggtggaacctaaaagggatgacgatcggtctccagcctccactacgctccggcccaagccttcgggggacgggcctccgctccattacagaaagtgcaaatgaatttgaatcacaagtcaacaattgcgaggcggccctattggctgggagcctgcgggcctacgggagctgtcttggttcgcttggtggcctgccggctctagtgggctgtttggcctattggctgggccattcttgtctagccccactgctccggtaggcaggcctggtagggacaaggggaggaaaggatggatgggtttgttgacataaaaaggaataagttcacctgtgcttcctcatcttaacatcgagatttttttctcttaacaataaaaaccagaaatatatacacctaaactcaaacaaatagtcctatgatagtatggggcccacatatcttatttctaccagcaaaaccacccatatatactgcttaggatcttgattgcacgatttgtttgagtttagggatactcatttctggttttatggttaggggacctcaaaaatctcgctgttaagttgagggaccttcggtgaacttattcctcatagaaaaagctatgaggttggacctttaaaattgatttctcgatttagggaaatattttacctcgatagtgatgagcacgggttccgatcttgtaaagataactgttgatttagcaaaaacatgatacacattacctcacttcagatcaatattatctgaaccctgcaatcgtagaaccatgtcccctttggttatcatttatctcgccgagaagactaatttctacatgtgaatcgaataatacaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctattttaaagataaaatattgttgggctgggcataattcttttattttattatataaaactaaagttacatgtggtgtttgaatctcctgaagatgaagatgaagttttttacgcaaaacgaggtggtaataacgtgtgattaattgagttttaattattataaacttggaaaatgtattaatctgatattttagaacaactttcatataaaaaggtttcgcatgaaacacaccgtttagcggtttgaaatacgtgccatgaaaatctttatctccatccaacttttgttggactaacgaacagggatatttacattgcacaggacgcaaggttcaaggaaagatgtaactaattgtccacagtgttttgtaaattgttcttcattggttcattccatcagtatgtaagagaacggccttctttttaaatctctggaaccatttttttgtggcacatcccctggaaaattaaatctttcatatgcttccaaatatgccatctaactagcaaaaagacctgcataaaacctgttcggttgaattgcattcttgcgagtaacactaccagaaagaagtttaattagatatggtattttctaagtattattctgaaaataatatgggattgcccgacctttatgtagaatcactccacagacctaaccacgcaatctgtgaaaatgtgactatggaaatgtattcctctgacattggcttaaacgttgtagacgtgtatgtagttcacttcatctctgccgttgaagcaatccgggggcattccaatcctgcatcttgccttctgtatcatgcggctcagtagcgcaccacgccgccagcaatggaaggacaaaatctaattcgtgcgctctctctgtattgccctatcgcgtgacatgttcaccggccgtccgcccgatcccacaagcactggtgcgtccgtctaaaccacacatggcctggcgattcacgtatgtggcattatcgagaagaatctgaatctgaagccatatgatgctctaggctacacctgcgagagggacacatccacctatacacctctactttaaaaaattttttttcttaaactaatcatctgatctacgatctgattacaccgttgtgttcgtaagaattgaatctttataaaaagatctcacatgattatattttgataaaaaaatataaattacttttataatatatctaaattacttttagatttgactaaattacttcttggatccataaaagtaaattcaataaagcctaaaagtaatttacatatattatagaataaacctccacacaaaagaaagtacctgtcatgacattaaaagtaaatccgtatgaggtaaaacatn

SEQ ID NO: 24656 - DNA, 2130 bp, Oryza sativa
  unsure (1)..(2130): unsure at all n locations
acgcgttgacccgtcctcacnnnnnnnnnnnnnnnnnnnnnnnnnnnnnnnnnnnnnatatagaaattaaattaaatcagcataaattacgtcattaactaaaaatgattataaaataaacaactcacaacattataaatgtataagaaaacctatgcttcaaataaaatgttctcttaacttacttatccgatctttgatccgattataccattgtgttcataacaattaaatctttataacgtgatctcacatgtttattttaataaaaaaatataaattagttttagatttcattaagttgaatcttagacatataaaaataaattcaataaaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccataacaagttactttacttttactttttgttttaagttacttctataatatgggtaaattacttttatgactaagaagtaatttaataaatctaaaagtaatttagatatattataaaagtaatttatattttttataaaatataatcatgtgagatcttgttatagatttaattgttatgaacataatggtgtaatcggatagtaaatcggatgggtaatctaagagaaaattccatgagaagaaaaagatacatgcacttttgagtatacaagtagcaacttatatgagattgaggtaggtgattattaccaaacagagaacggtctcgttgtagacacgttccaatggaagaacagacacaacgatggcatttttgtttacgatcggtctttccatactccctccgtactcgtaaaggaagtcgttttatgataatatttaaggtaatctttatgaatataaatcatgaataactctcaggttgttgagtttaaaaatgtaaaaattatatgaatagatttgtctcgaaaaatactttcataaaagtatagatatatcacttttcaataaatacttttatagaaacaagaagccaaagttgtgttttgtagaccgtatcgctatccaaaatgacttcctttacgagcatggagggagtattttttttgaataagttcactttgactcccttaactattgtcgaatctaattcatatccctaaacgacaataccagatatttcgacccccaactattaaaaccgttaccatttaactcccacgacggttctggagagcggtttcgctgacgtggcgcctatgtggcgatgttgacatggttttattccacgtggcattgacgtggcacttaccgggcattataattttaaaaatatgtgtggcatctgtttatcattcatgaaaaaaaaaaactggggggacacctcgatgtgaggtaagcacatctcatccaaatcgatcagcagaaatctctaactggagaaaccaagccggcggtgagtatttcacggggccttgctccggcaagaacttgtccaggtccccggcagccgcaagccacttgccgctgtctctgcatggccagcagtggcatcgccgctcctcggcttcggcggcggcagcctggatacttgttcgcctcgtacgatctggagcagcctcgcgtgacgaacagcatccgcccacccagcgacgaacaactccttccaagcgtatgatgcccgtggttgttgatgggattccacggcgaatactcctccgcgccaccaccgccccagcgcacgcgacgccggcgctccctcctcttcagcggcggccgccccttcccggggtgcccccacatgcgcgccttctcgacggcggaggcgcgagaggagatcgaggccgccatggacagcaaggagaccgtctacttcgacgacgtggccgcctgcgtgcacgatgctgccggcgagacgctccccaccactactacatgaaacatttttctggacacaagaaaatgagagatggacaccagtnnnnnnnnnnnnnnnnnnnnnnnnnnnnnnnnnnnnnnnnnnnnnnnnnnnatacctgcntgtaaacttggccccgtctttn

SEQ ID NO: 24657 - DNA, 2057 bp, Oryza sativa
  unsure (1)..(2057): unsure at all n locations
cgcgcgcttgtagatcatacaacnnnnnnnnnnnnnnnnnnnnnnnnnnnnnnnnnnnnnnnnnnnnnnnnnnnnnnnnnnnnnnttcatgcctcttatattccagcacagcacattccaagatttaaaaacattacgcatctcgcgtgacgaacagcatccgcccacccagcgacgaacaactccttccaagcgtatgatgcccgtggttgttgatgggattccacggcgactactccttcgcgccaccaccgccccagcgcacgcgacgccggcgctccctcctcttcagcggcggccgccccttcccggggtgcccccacatgcgcgccttctcgacggcggaggcgcgagaggagatcgaggccgccatggacagcaaggagaccgtctacttcgacgacgtggccgcctgcgtgcacgatgctgccggcgagacgctcccgaccactactacatgaaacatttttctggacacaagaaaatgagagatggacaccagtccgtcccccgcacaaggaaatatattttcgtgtgcaggaaaataatccaccccacacgctaccatccttatcctcctccccatcctcccatcatgggcgcgcgctgccatttcctccccatactgccatcctccctctccctctccctgtccttctcccatctacctgtacccctctcctcctcggcgacgccggtgcactcggttagggtggcggaggcggcggcatcggcggccggggtggcggcatcagctaccgtggtgttggcggagcggatccgtctccggccgacacgtggaggtcggatccatcgctggccgccgtggggaggccgggtccatggcctatcaccgctgggaggccggatccattgccgactgctgcggggaggccggatccatcgacgaccgccgcgggaaggctggatccaccgcctgccaccgtggggaggctggatccgcggcctgccaccgtggggaggccggatccatcgtccgcacacgattttcgcgtgcgggtgcgtcacccgcatgaaaaaatcgggattttcgcagacgccgccttccagacaggtggaagctccgcacgcgaaaatcgattccacccgcacggaaaaatatttcatgtagtagtggaccttcgagtccctcgcccaccttcgaccttcgagtccttgttgggcggcgacggctcgtggcagtgggaggaccaggggaacggcggcgggatcttggtggttgatggtggtggcaatcagatgcgatataggcactgatgcggtagctggcgacgagtggcacagctcctcattgccgccttccgctcctcaccagtgccttccgaaggaaagagaaagggagagagaggggggaggatgaaggaagagaagagagcatgatttatgtgggacctacacatatttttttatttttaatgccacctaagcaccacatcaacgccacgtggaaagaagaccgaatcaatactgccacgtagatgccacgtctgcgaaactaccctccaaaaccgccgagggagtcaaattacaccagttttaagagttaggggttcgagatatccggctttgtgatttatggtcacagaatagatttcgatcactttcgagggtcacaaaactgaacttattcctattttttccggccttgtgagaacggatgttttgggccgaattcaacgggccagcagcgagtggctgcaacacagcatgggtatccggcccaaaatagacaattttttttatttttcttaaaagttaaaaataaattgtgtgaagtttctatactttgtttaatgtttctatatgaaaatgcatatatacaacatttgtatgtattatgagttgggccataaatgggctgcacatagcttgtgggcaaaaaagactaaccaataatttagccgaaagagggaaagtgttacaagtaagctacgttacagggggaaagtctacggtatgttcttnnnngnnnnnnnttncnnnnntnnnnnnnngnnnnntncaggcgttntcaatgnnnagcaatcaagggccgc

SEQ ID NO: 24658 - DNA, 5640 bp, Oryza sativa
  unsure (1)..(5640): unsure at all n locations
cgatgtgnctnattgattgacttgcagcctcnnnnnnnnnnnnnnnnnnnnnnnnnnnnnnnnnnnnnnnnnnnnggtaacttgcgcgtgctgtgtgttgatcttaccgtccctcaatgtccgcctcgtcgtcatgaggatgtctgcatcgccatagtggagcctggcgtccccgagcaagactggtatcatcatcgggcactcatatcggatcatatctttgaagttcacatgtatgaggtttgtgcgcactggacggttaatttgaggagaataactgcttcaacaaacgacactgtatatattatgtcaatcggggaagaaagtgctgctagcagctcctaattagttggccaatctgtcatgcgcgtgcatcatatggaaacatgcacttgcgtggctgtctgttgatgctcatgatgatcaggaaaataacttggcgactgacgtccggtcatgccgatcagagaaacaactcggcgacgacagtgattggatccatcgcttaaattaatcttgccggctagattggatccaagttggagaagaaaagcttagcgaattcgtcggcgacgaggaagttgcagctcccgaagtaaagaggaagccggcgactcgtgaagttgattccatcgtacttgtcgatagaaactcgacgcacccctacctagcgcgccaactgtcgaaacatgaattcggcaataataaaagggggtagcgcacgagacctaaaagtggatggatgcggagacaaggatttaaacaggtttaggccctctcaatgagaggtaataccctactcctgtttagggatttaaatccgccgggtgtagtatagatctgacgatcatatgtgctcatgccccctagagggcctcctgtccaccttatataggatgggagccaggattacaagatagaaaccttaaccaatacggtatcggtttcctaaatctattttacaatattgtcaaatcaggactttaggtcgctccataatataaaaggaaacgtaatacccaagtcatgatttgttacatattcctttgatataagctatcccctatgactagtcagataaccatgccgtatgggtatgaggtacccataatctccacatggcaaacacataattgccgatgaccgcttctctgtcctctgatgagatagcatgatcaggttctctccaaaatgttaggaaaaaatttcaatggcaaccatatatcgtaaacaggatacttgtttgatatgcaatgcccaaaccattgataacaggtaaagagtactatgatctgctcgtcaaagaccacgaagaaaaaatgatctacagatgtctgtaacacactaattcttgaggatatattagcaacaataaccttttggtatgcacttgtgttacaaattttataacatcgaatgaataacaggaaacctaaccattaccagaaggatattaatagtgtcagcaaataaagttgggtaaacattgcaaaaatcatctctcgggatcaaggtatattgcaatcatgttatcttacaggaatcctataaaaaaagcaaaataccagggcctatattgtccatgttggaagatttaaaaaattggttaaagcaaatgtaattggcacattaaaatgacaggaaggaataatatgagatatagcttaggaggttgacaaattacagattaattagcattctttaactgtagatagaaataaatgtaagatttgatgcagacgcctactcagtgctcatattacttccatagatactctccatgcactttagcttgttttcacttatagaaaatcggcatccttatgagagatttagagtctcatgggagcataaatctctactatctcataaccatttgtgataccttttttttcgagggtgctcatacctaaacacaaaaaactaaaatacattcctatccttgaaaattatcaaaggccattgatatgcagcttgaggtgccatggtagaaattaggcgagattccccatgttgatacatctgctgatgatctgcagttatgcacccatccacaacaaagtcaattagtatacctggggatactaccagctttttatgaatgataatcaaatagtgtgttcccaaattagataagatatattgagcactcaaccattgggagtttatatattgaaggacaataagtacaacgtatctgagagcatatttttagagtttatgaaaaattgggcggcgaccggccggcgatggaatcagtctgcggcgcgatgtagagagaccacttaacataatggttctagcatgtagatcatagaataatcaaataatttgatacccctggatacccctattctggaaatagtacaactgaataaattggctagactacagtacaaagaagaataattgaataaattggctagactacaatacagagcataataactgaatatgttggatagattatagtaccaaccaagtctaggtataattctgtccaacagaattaacagtgcacatgctattctcttcaaaattcacatgattcataccaaaattaatggttcagacttagtaacattttaaacatggaatcaggtagggaaacatatatacatgatgagagttgaggagaaacaaagacctttctagcagctgttgttagggtctggccgtttgggcgtctgacacccaaattcagatccacaggagtcagaaaagcagcagtgtcgatcccattgaactgcagctcaccgagaatgtcacggaggaatgtcaccgaatcccagtcccaatgtataaagtctttgaggtacctgatttagatttcagtaaacaaatgactacatatgattgagtaaataatatgggcacacatctgcaaataaaagtaacattattatgatatagttattgtagtgaatactcttttcatatatatactcgaactgcttgtaaaataatttaacaacaatgttctcttctccattgcaaatatacaaataaataaaaacccatgaaacattaagctcaatttattgtaaatcccatcatcatgacatcataccatctcattttcaaattacattttcaaggaaaaaattattagtctgcacaagcagaatttgaatgacaactaatagtaaaaactgaaatcaagaaaatgaataatctgaaaacttttccctgcattagttagtacagagtacgtgcagatcagtggtgagagggacataccgaactccttggcggaggtcgcgctggaccggacggcatgggcgaagcccggtcggcggggaaatccatttgcgatgcgatgtagagagaacgaaggaagcacgacggtgactggatggtagcggcgcgatggtgacctgcgggggcgacggcgattgacggtgacctgcggggagacggcggttagggttgggaatcgcaaggcgaggaggtgcgatggtggtgagggcttccggtggcgaggaacggtggcgaagcgtagaagatcggtgaggaaggcaatgccggtgggagagatcgctgcggagcagatcggcgcaggcggcgacctagcgacgggagggtgaggatggattttttttcgggagttacgggggatagacggggtgagcgtgtcgatgagtctgaccgttggataagcgttgaagcgatgaggtgcgttggatgtgtgacatgatgaatgatgaatgagtaaaccatttgtttaactataggatagattagacattctcaaaaataagtttatggggattggattttagcagtttcatagtgatgcatgccgtttggacgtacatgtgtgttttcgtgtaattcaaaaaaaaattgtatttttttcatgtgcagacgctcaagaggaccgtatgtgatgtggttgcattatgggtcctcttagagcctactggggttctcatgtagaaaaaattatttgtgaagtagtgttgtgaaaaataatgggactacattaagtgaaaatcaaaggtcggatgtttttgtctcttcattgaattttattaggccatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagccaatgtaatagccaattcatacaatagttgcttactatatgtcacgcccagaaatttagcccaaatttttagactattttgtgtattaaatccctgtccaggactagccagggtacacaaaatgacaagtaataaatagatccaaacgtaaataaagcgtaaaatacttaaagaataggcacttagtcctcacactgaaacaaaagcagcagcagcggaaaaggcgatcctagcggggcttcagctccactccataggcaaaactcaactgaggtctgaaccttggtcctctaacttcatcttcagctcagaagcactacacttctgaaaaaggggaacaacagcaaggctgagtactaccaccgtactcagcaagccacaccaatgatgcagacgtgcaagggcagacaaagaggggtttgtggctatttgcataaaggcggttgtaaaacattttattgagcaaaacggtaaaacagttcagtaattaaagtaatattaaatttccactgatcaacgctacaccacgttgaacaggcccaaccaacctaccagaactacagtgcattgggtcgatttattaagtgtgagactaatcacggtgaatctggtcgatcgcctataaccgcgggcacggctattcgaatagttttactttggccaaaggtgcacaactgtacccacaagacacaatccaccggcatgtcaccatgtcatcatgtgccctgatgcacacatcaccatgtcgagtgattgtgacaagacccttcatataaccccctctgaccaatcgcaccgcacctcaggtttcacccccactcctcgcaaggcagcgggcagtcccctctcgtgccacggtgaatccagaagccgatcaactgaataccccagccaacccaactccattacgcccacccttgcctgggaacgtcagccagaggaaagctatacttcaagtcaggcagttacccattcctgcttgtggcaagcgctgtatgtcttccagggtttcccgcgaactggtccttcattgccatgtgtgcgaccagcaaaaccatgcacccacagcccaccaataagtcgcattttagttggataattatggccaataaacatgcccgcatgtctcgagcacgcagctcattcagatactaaaaaggtctaatactgcaattatnnnnnnnnnnnnnnnnnnnnnnnnnnnnnnnnnnnnnnncgcttgnagctnggtacnttagtcntccatcgaacccgccccnnnnnnn

SEQ ID NO: 24659 - DNA, 1316 bp, Oryza sativa
  unsure (1)..(1316): unsure at all n locations
agctccaacgagcaggcgcagctcggcctcgcgcgggaaagcgggagaaggcgcgacgggctcgggaaatttggggaaatgggagaggagagcccgaggatcgtttttatgggctcggggtggtgagatcgtggctgtggagggtggaatcggccggcaacggccgacgacgtgggtgacattgtgggcgaagtggggactcgatttggcgcaaaaaattgcggaaaagtgggggatttggtggaggagatgaaggggaaccgatttcactcggtttgggcgcaagggcgcgggtggaagggccccgaattcggcggaacgtgggcggcaacggccggccatgggcggcttcggcctgggaagccgaaggtagtaggaggacctgacaagtggggtcgccgggcccacctgtcggggagggagagaaggaggagaccgagggggttattcagactttgtgcgaggggaagtcgatcgcgccgagaagggtggggtcggcccgagagggaggagggaaggagagaggggcgagcaggctaaggagggggaaaagatctagggccgaaaatggcccaaggagaaaggggagattatttgattttctttttatttaattggttaaatgatatttgtaatagtaaaattagatattgagcttcgaaaattcgcgggaaatttcagaaagttcattagggcacaaagaatattacaaaatattctcggccatgatttttaaaggaaaattttaatttcctctataatttcacttgattaaattgatttaacttttatttaatttctagaaaatgcattattaaatgatttttaatcccgacgaaaatcggggcattacactatactattaatatatggtcccacctgttatacatatattacgtcttggagtccgcgctgcagctggctatatatctgtaacccactgctcttctctctctttttttatctttttaaaatatatgtttatagctggtttatagcatgctattgtacatgctcttagagcaccacaccatagctaataagtgttcctagaaagcttaataaattttaataaatttttatcgtatggtatatactccgtagatagaagataaattccgtcgaccgatatctcgactcaccagtatggaaacaagagcgtatggtagtccatcattttctccgtgtgagacagaagtgtgacacccttgtttaaacctagggcaggccgtcataaagtcctgaaataacattccacttnccaaactaatagctaactttctgtctgagctaggaatcccaaactcgtattacct

SEQ ID NO: 24660 - DNA, 725 bp, Oryza sativa
  unsure (1)..(725): unsure at all n locations
cgcccacacgctcgtagnctacngatagcccctnnnnnnnnnnnnnnnnnnnnnnnnnnnnnnnnnnnnnnnnnnnnnnctgccagcgtgtttccggctatagctctataaaccgtttttgcaaacaggtggattgcattttggcatgcggttggccggtacacatgcgctagaaggtctgcaaagatcacgatctttgcatgccgccagtgcaaccgcatgcaaaaatcggattttcgcatgctgatgcttaagccggctgcatgcgaaaatgaaaaatcgcgaaaaaaaaataaaaatccccaaaaaaaaacccctagccctaagcgcccgagctcgccgatgccgctcgcaccacgccggatccatcgtgcccgagctcgccgacgtcgtcgtcgtctcggataggtcgtcgtggccgcacccaagctcgccgccgtcgtcgtagccgaggttgtcgtcgccgtacctccgccacgctcgagctcgccgtcaccacccgtcgccgtcaatgttgccaaggtcgccgtcgtcgcgaggaggtcctcgtaggtgtacccgtgccggatctcgccgcctcgagcttgtagtcgcccgagggagctcgttgtcacccgcggggagagtgcccgtgcccgatcccgctgaaggagggcggctgaccccggatcttgctcggggagggctacagtcccaaatccgatctggccgcctccgcccccccg

SEQ ID NO: 24661 - DNA, 729 bp, Oryza sativa
  unsure (1)..(729): unsure at all n locations
nntttgggcccctttgngnnaaaaaagttcccaaganatnnntcacttngnngggaggtgtnnggatncaagnttatngatttngaaccctggttcgacaatcagcgtaaatgtctcatcgaagtcaatgccaagacgttgtgtgaagccacatagaacccaatgagccttatatctgtcaagagagccatcatcttaaacttgtgacgaagttagtgtcgggtgtattcggaatgagctcccaagtgtgattcactagcatagcattgtactcatccattggaacatgctaatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagcccatgtaatagcccattcatacaataggtggttactatatgtcacgcccagaaatttaagccaaatttttagactattttgtgtattaaatccctgtccaggn

SEQ ID NO: 24662 - DNA, 1397 bp, Oryza sativa
  unsure (1)..(1397): unsure at all n locations
cccccttcttggggtgtggccccgcccatcggcgcgtgaacggtggtcttcggccccggccgtcgcctcgggccatgcgccgccgcctttggccgtcgccccgctttcccgcacggtcggtcaccgccgtcggtggcggtgcatcgccgccgcctcgctttggtcggccggtcggccttaggccgagccgagcccggccggcgcctcccttgcctcccttttgagccaccgcctggtggggcccacttgccaggcgccacctccctccctttggagccgctgacccgtggggcccacgtgccggcgccccccctttggctgacgtcagccctgggctttattgcgcaataaagtgattaaggctttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtagatttcggccgtttcgtcgatccgcggtttctcgaagacgttgctgaggtctcatcagtgcgagagcaaggcaagtcatgcaatacgtttgatcatattgtacccaatttacaaatatcccgcatttctattaaatgttgcattcttttacaatatcatgtgggatgggtcctactactcatccatatattgtttaccttatgccattgacaacttgggtattaaaatgactagatgttgatttaggaaatgcttagccatgcttagttctactagtacacaaaaagggaatcacattaaagcatagactttgattattggcaatagctttggattggtgccaccgcaagggtgttggttaattaaaatacactgaatggtgggctgtgggtgcatggttttgctggtcgcacccatggcaattaaggaccggttcacgggaaaccctgggagacttaccgtgcttaccccaagcgggagtgggtaactgcttgatctgaagtatagctcgaccctttcctaggcaccggtggcgagggtgggcgtgatggagttgggtcggccggggtgtccggttgtccagctgccggattcactgcggcgcaagaggggacccgctactgccttttgaggggtgggggtgaaaccttagcgtggtgtggatggttaggggagggttatgtggagggtcttgtcacgattttccccctttgcagtatcatggtgatacttcggggcatggcgacatgtgtggaatcgtgtcttgtgggtacagntgtacacctcttgccagagtaaaactattcgaatagccgtgcccgcgggtatgggcgatcaaccagattcac

SEQ ID NO: 24663 - DNA, 4483 bp, Oryza sativa
  unsure (1)..(4483): unsure at all n locations
aggcgtgtgnttttgtagaacctttgtcttgtnnnnnnnnnnnnnnnnnnnnnnnnnnnnnnnnnnnnnnnnnnnnnnnnnnnntatgacttgctgagtacagtgggtagtactcagtcttgctctcttttctcccacaccagagctgaagatcttcctagttggagctgttttgtcaaagttggtttcttcgctgccgtcaaggattgcctgtggagtggagtcgcccgctgctgaagtcaaacttcccggtttagctcgcttttatcttttccgcagcatttgtaatcttttctatttttggtagacgtggatctgtatgtaaacaaattgtggttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaaggtatatgcgagattgaggtaaaagagatggagacatggatttttatacaggttcaggcaccttatctaacaggtaatagccctacatcctattggccggaaccggtgttgctctttatttatctggatcacacaagtagaatatttgggaaaacctatctagttgtcgtcaacttggtggcagggataaccaacacgtagtcaacgacagggtagtcttcctcctcgagcatgaactcgtcgagatcagagatagcgctagatccctctagccggcctccgtaggcaccggatgcggtatgtctaggctaatctctgatgtcgagatctggcggggtgtgttggcttatgtatatgttgtgtcttgttggtcttgtggcttgctttttctcctcctggggggcttgtatttatacccataggtgtccccttgtccaagaagaactagggagaccaatatggatacaatccaggtagtccttgtcattttcatatagaactctatttgtccttccttatccgaatctccttctatatacgaggtatgattccgtataagatatggtatgtggtgggccttgtcgtgcttagtcaactactattaggtatgtggtatccataacactaacagccccgcccgtgtgttggtatttcttaacgacattactagaaatataattcccagcaatggcccagaaatactcctggtatattatggttacagagttcatccacaagcgcatggatataccattgtagcatttcacccgagaatattccaagggtatcgtatttattttatcccgtgggaagataatgtagagagaacttgactaataatttatatattacttgtgataatcatattctaagcaggggttaagataatccaagggtagagtgacacacaagcattaactactcattctcataataaatcatctaaacacacaatgccgcgtcgccgcccacgcgtcgttatcgtcgttgcccactcgttgtcgtcaccgcccactcgtcgttgccgtcggggtcaggctcattgtcgtcagggtcggcgcctcctcgtcgtcgtcagggtcggtgatgagaacatcaacaccaacgatatatccacgcctccacaagtacaacttcaacgtcctattactcgcgctcgtgcacgtcaactcaactatcaggtgcattcattcttaaattcatatgattcttatttattccccggagacacgtgcactcttgttttattcaggaacaatggagagaatcaaatgggtgaggattcgcgcggggtggattcggactgcagcacagtcccaacttttgacggtcgccatgacttcatgcgaactctgatttgggcgtgcaagtactatcaagtctaccttcaaatggatctagcctcttgtccatatcagttctggagcagccgcaatcttcatttttctaccgagttcttttctgtccacggtgttgcgtcacctcttcgggcccaatgggccgtgtatcaagttgggtccattagggatgcgtcctagggttagagaacgaccccagcatccctgtggttgtccccttcctcttcttatagctttctccgccaccaagaataatcgggttttgtttagatcaaagtacagcgtcgctactttgccgagttgatcccgtggtcgattagattgccggattgcttgttactgaaccccacttgttacttctattgattcaatcaaacatctttgattcgcaaatttagttgcttgttcatcttgttcttgctggttctcgattgcttacaccgcctctggagttggtgtaacgattgctaaggcgcaacatccctggatagttgtagtcggatcgccaacgtcactccatccaatctacttatccctctcatcgaaatatcgggacaccctcaagcacatcagtcggcgccgccgcgaagggggcagcccgagcgacggggacgacgcggcagccgctagccaccagcacgcgcacgccgcccactcgtgctcggtaccgagagaggaagagaaagagagggagaggagagaaagagtgagagagaggaagagaaagagtgaggagaagggaaaaatatcagggggggagagagagaggaggatgaaagatgaaatattttgaagtggtgaggagggaaaattttcatttgaaatttctaatcgatttttatggcactaaatcaactcgtatgaaaaagctgtcaaaaacaaagttgtagaactcatttaggtgtcctgtttttcttttggtcatttctctatctgagttttattgaactatagaaaattttaatttcacagtcaatttcacaaactacaggtattttgaccaaattatcacaaaactacagatttaaggagttgtatcacaaaactacacatttagcaccaaatttatcacaaaactacagattttagattaaatatcgtaaaaatgcatatttaatattgaatttatcacaaaactaaaacttttggagtttaaatccctagcaccattgttatgatggagctataaacatctttactttttattaaattgattctaaacctgtagttttgtgataatttagttactaaatatgtagttttgtgacacttcatcttaaatgtgtagttttgtgataaatttggtgttaaatgtgtagttttgtgatacaccgagttaaatatgtagttttgtgataatttggtcatagtatctgtagttctgtgaaatttacttttaattttaaaatataagaaattcaaataaattttcgggtagtaaatgatacaaatgaaaaaattgtcaacaacaaagttgtaaaatgcatcaagatctacaacttttgtttcggtcatttttctatatgactttttttcgacagtttgaatttgaatttcaaattatgacaatttcaaacaacattttcaaatactaaatgatttcaacttaaaaagttatcaataacaaagtgtcataacttatcaagatctataacttttattttggttattttttcatccgacaaaatgatttgtaagattgttcacaaaatgcacatatctctcttataaagttttataaactatataagagatatgcaaattttgtgaaaatgttactatcactttgtctgatgaagaaatgaccaaaaaataagttatagatcttgataagttatacaactttgttgttgatgactttttcagctgaaatcattactgcttcaaaattttgaaattcaaaattttaattgataaaacaaagtcacaagaaaaaaggccaaaataatggcagtatgaacataataacatgacagagcatgattttagaaacttttaggaaaaataatcatctaatttaaagttcatatgagtgagataaactagttttaaatttttcaaattttatttttgcatacggctccttaagtggtccgtatggaaaaatcgatttttccatgcggtcgcttaagtgagccgcaagcgaaaatgatctcatttttgcatactgtcctcttaagaggcctgtacgggaaaatcgatttttccatacaggccacttaaggggctgcatgcaaaaatgaccatcgatttttataaacgccactagttatggtccgtttgcaaaaaatcatggggtctcgtaagataaatcacttttgtagtagtgcgcgcgccgctccctcctgccggtcctcgtgcaccgccgccgttttccgccgccgcagaccccgcgcacctcgttctctctcgtggctgccttanagctcgttnctacctttgagcgctcttgtgttgaccttccngcgcacgcatgcgccgttgtctttccttccaccttcggncagctgcccgttatccttcct

SEQ ID NO: 24664 - DNA, 1646 bp, Oryza sativa
  unsure (1)..(1646): unsure at all n locations
cttgcccttcctcggaacaccgaccccgtgcacggccgctcctttccctccctcccgcgggtgggatagcgccgccgctcctcccacgtcagccggcccgacgatctcgcctcctccctcgtggcgttcccgtctgccctctccgctagcgcggcgctcccgacagtggctggataacatatagttgtagaagcaaaagaggaagaaagaatgaaaaagtagggaggatgacatgtggggccacatgggcccatcatttttattacttttttgtgtatagctgacgtgggtcccgtgggttttattattttttcggatcaagttaccatgtaagcgccacgtggaacgaagacctagtggagtgccatgtaggcaacacgtgaaacaatactacgataggaccttatttgcgtggttttataagtttggggatgcgttgtatccagttttgtgatgtagggatgaatttcgaactcggtgacaaattgagggacctaatatgaacttattccacagcatgagaactgcatgaggaggaagaaaagaaaaacaaccaaaaggagtcaaagtctcaaacaaaaggaaaagagtgtgtaataaaaagagaaaatatttttttagagacatagcacaaacacattattgtcagaaaactttccgaaagaagggtatttagaaaattttaaacatagattaatgaaacacatgataaacaaaaaaaaccaaaaagcaaactacggtgcagacaaaaaagtttaaatagttaattattgaaattaaaccatttttatttaggaatatccataaagctagaattatttaattaattaaacatctaaccatttttttatcgtggagtaaccatctatcagacattttatttccttaaataatttcttgcggtacaatcttaaaccaaatttcagtctcagaaattttaaacactacatatctaccacatacaatctctaaaagattttaaatattaaggaaaaatatgtcccaccataaaatctactctctctctctcagcagtcgattcgtaacagaggcaaactttctaagttctcgttgggaggaagggagcccgaccgtatccgagtggttctctcctctctctctcgatctctctctacgcacacagacacgccgcaaaaaacgcatgcaacacgcacgccgctatatatataattaaccatcactgcgtcgctgcggccgcccacagccaccgagcggattagtggaacaaaccctagcctgagtagattcttcctctagctttcgcgagccgtatcgtatccattggatggagccctagagcaacaagaagaagccaagaatatttgcgccatggagggtggtaattccagcaagggcgccatggagggtggtcaccgctgccgccccccaaacgtcgacgacgatgaccagatcgaggagggagagatctgctacgactgccacgtctcgggctccgagaccgacgacgacgagcaccacagacgcgccgtgctccctccccgcgacaatggcgatggctgcgcggagcacaaacggtgccggctcgacaatgctgctaccgcgcccgcaccctctgccgggccggtgctgaccaccagcaaaacgagcgncatcgtcgncatcgc

SEQ ID NO: 24665 - DNA, 1379 bp, Oryza sativa
  unsure (1)..(1379): unsure at all n locations
aggttagatgttcgtacgtgnnnnnnnnnnnnnnnnnnnnnnnnnnnnnnnnnnnnccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaggagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgcaatgtggtctcaggtgttcggttgacgactggcaactggcaaggctgttttgtttggggtaatcctgatcctgaaggaaaacatgaaaagaccatgggaagtgaggggtactactatgtcccggacatctgacacgaggcatatcatcagacaaactgtggatcatccactgcatttgggcttttcatttgctctctctttgttacttacgaatatatacctctcacattttcttttagctgaagctctatgtatgcatcatctatccctctcacatttacatcttttagctcaagctctatttatacatgtggatgcgtgcatgtcctccatttacaaaatttaaataatttttcggatgaactgtttatccaatcaataatttgattacaccaccatattcatttcaagtaaatctttattaaaaagatacgtcctctgttcatattataagactttctagcattgcccatattcatatatatgttaatgaatctagatatatatgtgtgcttaaattcattaacaactatatgaatgtgggcaatgctagaaagtcttataacttgaaacggaggtagtattatataagtgtattctcatacaaataatgtatatataaagttttaaacgatnnnnnnnnnnnnnnnnnnnnnnnnnnnnnnnnnnnnnnnctcacgaatcccn

SEQ ID NO: 24666 - DNA, 743 bp, Oryza sativa
  unsure (1)..(743): unsure at all n locations
ngtcccgcgactcgagtanacgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaggggggtggtgattgggataactttgtgcagcaacagtaggctgcagaagcaaaaatagaggatgcttggggtaaggatcacccaatgggccagattgaggaaaaccctaggcaactgattgtgttgcctaatcaagtgttagaagaacataatctgatggataaggatcaacaggtgcagcttttcctggctaggctcaaaggagatagctgacagggaagggccaaagcatccatccttttatcctatggaaggtctattggaaaagattgatcatttgtgcaaagctagaaatcatgcatacaactttgaattctggcccttcagctctgccctatggaagccctttcatgaacttgatcatgcccctcctgtagttaaaagagcacattccagctgggccctattgccttcctcttctgatgatggacttactcatcaagaagatttagatgccatgactttgcaagcccagtcattaagtccagaag

SEQ ID NO: 24667 - DNA, 1706 bp, Oryza sativa
  unsure (1)..(1706): unsure at all n locations
ttttaaacccgcgaaaggaatcaanggaactacagngngggagntntnggatnaagcttangatttccaacccatggcttgtcatggatcgatccaaatccctccttacaaacctgtttatgggcatgtggctgttttgccgtgggaggttagaatcggctctcgaagaacggaattacaaaacgatttaacagccgatgagtattacaaccttatggccgatgagtgggaggatctggttcagtcacgattgcgtgtccttgcaaaggttaccaaggacaaggaatgtgttactcggcactataataagaaagtggtgcctaaagatttttcagaaggagaacttgtatggaagttgattttgccgattggtacccgtgattgtaaattcggcaagtggtcgccgaattggaaaggaccgttccaaatttataaggttgtgtctaagggagcatatatgttgcaagggcttgatggtgaagtctatgggcgagcgctcaatggcaaatatttgaagaaatattacccaagtgtttgagttaatgcatgacagccgatatgttttcatcgccttgagatggccgatatagttatatcacccttagttgtttttatggtgtaatcggttgtggtttgccgatgaccaatggccgatattgttatatcgcccttagttgttttataattttatcaatgcttttgacattgtaaaattaggggggcacatacatatcaaaatgcaatgcagcttacaaattttttgagcacatatcaaaatgccatgcagattgtcaagacagtaaagtattataacgtcttagccgattacaaaatttgtaagttctattacatacaagttattgagacaagtattgctggatagccgatatagccttctgcctaatctgttccacttcttctatggcttgggcatcttgagcgtcagttccagggataactttcaaggacttggtcatatcagcgacattcttgatagccgattttagctttgccttttgttcttcaacagcttgcgggagatcggctagctttttgtgctccatatccagctcggcgttgcattcttgaagttgtgccatgagatcaatcttacgagcttcaagccgatcgatatttgacttgattatgccttcagacagctgatcaagcttggacttctctacatgcacaagctaccgattgtgctggattgtagcttcaatgtctttgcgttcccggcgatcggctaatctctgcctagccttctctagtttgaatcggtgttggtcaaggtaaacggctagagtaagggcatcggctaagtcatctgggagtagagcttggatgtctgtgaacctcgctcggatcgagccacaattggtcaccaagttatctagtgatgcttctagccgatgagaaatatcttccagtatttttctcacatcatcggaaaggggagctaatgctttgcttgaagtatcttcttctgcttcatcaaggtaatctctgatgtcaaaagagaagagatcggctagaacctgtagagacggtttcggaaagagtaagagctgggtgaatatagccgatctaattggtaagacaaaggaagacttactgggatagcaggagcaactagtcacagccgatgtgatgacttcccacagccgatggagtctagtcacttgatgattgcccaccagaggaat

SEQ ID NO: 24668 - DNA, 4841 bp, Oryza sativa
  unsure (1)..(4841): unsure at all n locations
ctcccgtgatgaatgccgactggaagnatgcatggggtgattgcagataagaagatttctctaggcttttgatatctgtcattgttgatgtcttcgaatctgaagtcccgtggattttccagaagtgttgagtctccatagataatccttttggaacccctcataaaagctacaaaaccaatctttgagcagatcggccgatagttttgctcctgcatcagttggtgtagaggcgtactctccatatgatgtgcatctccgatgagtgagttcctctccgtcatcgttaacagtcggctctaatcttgggaattcagtttctgttacagatggctgattgacaaccttaatgactatcaggtttaaccaagtttgcagcagctaccatggtccacctgctccaactattgagccgacggctgttttagccgatgcattgttcaacatttggtacagatagccgagaaggattttgcccaaaggaaattctttctttgattctaaggcttcggctagaaattgccagttggttgtagggccacaactggatccacagaagaggaacttttctaaccacatgagcaagaaagctacatgctctcgaggggtaacggatccttggcccatatatgccgccacatagccaaaccagccacctatgcttttggtcttgaagtcaaattagttcttggtgttcatactcatagggttagccgatgaagttacatctaatccagtaatcatggtgatatcgattaaagttggagtcatcggcccttgattaaacaaaaaggcattgatggtgtttgaccagaagtaagaggcagttgccatcaggggttcatctttggccgagtttactatagtgaggtcaagttcttggccgattccaatttcatcccagtgaacccttttgcttgctgatacacgtttgaaccatgtggtccaacttttttcaggtggaactttctctagagacggccaagatttgaaggtattcttccagtgacctagatctgggttggttaatctgaaggggatcctattggtttcaccaataataaactcagtggaatcagggttgtcgactgggccgagaaagtagtagttttcgtatgagaggcttggaatcgcgactagattggagagatgctacaaatccaaaacaaccgagaaaaagagagggatgtaagataagagaaaatcgatctgctgctaagaaaggggatctagccgattaggacttacctcagcatactcggctgatggcgtatcagatgggttggtggaggacgacatcactgcgggcggaaatctcgccgaagatgaagtcgcctggaagtcgcttttgcgttggaggaattgccggagagaaagaggacaaggtttcgcttgagcggtggaaatggaagtcacggtgtgagatttctcgaaggtgacggttagtatttaaagcacggcaataacggtcggaaaacagcaaagtgcgaaatttgctcggagtcgatttgcagcaaatccgaaacattaccaaatattctggacttggagggcatgtgttaacaaccagatttggtaacatcagcatcaggaaagaagattagatcgaagcaaagttggaggcggagatcgagttcggaaacagagcaggaatcggctggagtccggatcggctacgactaggatcggctgggtctgagtcggattagaaaagccgatacagctgattctgataatacaacttgacgtgtgatgtcgggttggattgaggtgcttcaaggagattgccgcacatggatagagtcctgaggaggcaattctatctattaattaggatgctttatgtaatttctttagagatacgattgggcaaaagtctgccgtaaagagttatagtatcttagagtttgttagagatggtaatcgtgtccgttatggacatatcttgtaattctcgggtataaatagacccgagccctatgtaacttaaaaacacacgttcaatataattcgggtgcatcgccacccttttttactttagttttgtttcgacgagttcttgctttcgggttgagctgcatcggtttcgatcttcaacaagaggtaaaccttgttatgacggcttgcgttcttgagattagcgcttccatctttatgatactctaatctggtttatgtgattcgtcaagttgtcatatatcttacataatctctagcaatatcgctatctaacctacaatcggctaacatctatcgaggaaggtagccgattaggttagattctgacgttgactcggaatatataagatatctaccactctatgaaacttccaacggcttgattgtctagatattgttcttcttttcatatttagtgctgcatcagttgagtttgatctattaagtcgtgcttagaatatcaatctctagcctgtcttctggttgtcgattagggtagcatcggagtgtcagccgatcttatctgatttaattatatttgctctatatgcttcattgacacgttaaatctgccctttatgtcaagatattactgtatttaagtatattaggcttctgtttgatatattttacctgttttaatatcctaatatagagtagtatcggagtattagccgatacatgctcgatctatctgatcggctatgctataaacatatatagtcctgttattaatatatattttgatctaagtgatttatacagtctcggcatggcgaccgatctatcccaatcacttgatttaagtatatatcgatataagaataatacattgaaaatatctaccgcccatcgaatagatttagtcctttattgtttatttgcaactgccgatcgattcacatatgacattggctcaaagataaatgatatgtcatcggcaccctagccgatcggctatcatttatagatttaacccgggtttcttggcttctatttcttgtggattacaggatcaaatcaactggcacgctagcgcacccgaaggcgagctttggacctgcactggagttaagcaaatctcctaggcctcgtgttttctgtcaacaacatccaaagaggaaaaagaagaaaccaaagcattcgacttagaatcaacttttcgagaaagaacattcatctcatgtgttttcagttttgtataaagtgaatccaaagtcaaagtagacatgttaacagactcctgaatagatgtaactttcatctcccaaatagacatgtcgagaccattcaaaaagtgacgagaaatctcagattgtggataattagcttcataagaagaatcaacagatctaatatcactcaaaattttattaaacctagaaagatagtcatccaaagcttctccaggtttcatctcaaatttaatatactcctttttaaaaagatctcaacgaagctctttaatgttatttgttccttgatgaaaattactcaaagcaacccaaatctcatgagcagtttgaagatgagcaacacgatcataatccgaacgagaaataccactcaaaagaatgttgcgagctttgcaattttgttcaaaagcagttttttcagcagcagtattaatagcttcaggaatcacataagcatgagaaacttttctccaaatatcataatcttcagccataatgtaagattgcatcctactacatcaatgagaaaaatccgttccatcgaaaacataaggcttagttgaaaacctagcgggagtagccatggcaaaaactctagatcgataaaaatccaaagaagaaaacaaggctctgataccacttgtaggatcgaattacaagaactaagccaaccagaggggggtgaatggttggtatacccaaaaaccgaaaacttttagcggaaataaaagttacccttaatttcgatgagatcggtctgaccaaagtagattagccggtctgaccgtagcgagccgccggtctgaccggtgttgatctaccggtgtaaccgccgagatcgcctgctgcttgctgtcgccgccgctggtctgaccgccgtgttcccgccggtttgaccgccgcttgccgtcggtctgaccaccggtgagttgccggttagaccgccgaaacccggtaaacacaaatcgaagaactcttaaagtagatgacgactttattaattctctctgtgcttacaaagtgcaccaacagcactccttacaaaaattttgactaaactcgaaaccctaactcaaaactcaactcaattgctctctaaagcgatacagggaagcctcacgctccccctctggttggcttagttcttgtaattcgatcctacagttgcaagccctattccatgacagttgataccaatgctaagctatcctccactgatggtaatcctgtgattgatctgaccgtctatcgtagtcttgatggtgccttggagtacctcacctccactcgatatattagatatctcttatgttgtccagcagattttataccgccataaagcgtattctatgctacctttgctgtactctggatcatggcctttacttccaaacattcctccacatttgacttagtggcatagtatgcagctgactaagctggttgtcccgacacgaagatgtttacttaaggctacgtcgtgtttttaggtgataaccttgtctctttgtcctccaaacgtcagaactatgtctcccgctccagttccaaggctgagtagagtgtcatggcaaatgctgtggccaaaatatgccgggtcannnnnnnnnnnnnnnnnnnnnnnnnnnnnnnnnnnnnnnnnnnnnnnnnnnnnnnnnnnnnnnnnnnnnnnncaaaaaacatcct

SEQ ID NO: 24669 - DNA, 17554 bp, Oryza sativa
cctctcttccgccagtccgccagaagggaggcacggtggtgccgcacgcgttgaagcggaaaggaagccaccaacgacgtattgcagcaggaggggaggcaccagcgacgtattgcagcaggaggggagccggcaggcgggtgacgcccatggagcggcggtggggggcgcctcccctcagccatatccaatgactgccctccatggttacccaacggtgagtcttcaatttctttccgtgatttgggtggagatgaattgatgttgaatttatgtgatgcttctgtgatttgtgtggggatgaatcaatgttgaattatttctgtgatttgtgtgcggatgaatcgatgtgatggttctgtgatttgtgtggggatgaatcgatgttgaatttctatgatggtgagatgttgatattgatgaattgttgtatgtgggatggggagctggctcgtgcatcgagccggtttttttgcttttgtgcctctcaaaggtgccagttgtgacctagggtcatcagtgccgcctctgagatgctggttgggaaaaccggcacccaagggtttttcaatcagcacatttatacctttatgtagtagtgttgttttattaaaactgaatatattttgatagttttgttttatgttaaaactattactatatttttctataaacatgatcaaaataaagaagtttgacttgaaaaagattaaagtgatttatagtatgaatcagaggtagcacttaacattagacattatcactcaaaatctttgatcaaatatttctaacggatggcaccacccttatgattattgtatgaacagtgtgtgcacacgaagtgttgctgtcgagatgtacgctccccgatccaacgtcatggatattttactacattatgacgtctctgttattttctgtgttgaaacaccatctcaatcccttaattatcgttgtcgacatatatacttgccccaacacatttttctcgccctgaactaccgccattgacagattagacacaccctggtcatcgtccgttggccacaaattcataactctcgcctcgccatttcaatttgtcgatagagggtgtgtttggatcccagccattgaatgccaacactcctgtggcgagccacgccatggcgtggcattccaaccgccaaccaagcagccctagaatatttgtggtgtgcgactgatcgactaatgggccttgcttgtcgttaatcgaacatgtggatatattcagtagactgttaacggaaacggatcctctgcagtcgaaccaatcatatctacttccttcgtttcacaatgtaagtcaatttagcatttccacattcatattaatgttaattaatatctatctagatttattaacatcaatataaatgtggaaaatgttagaatgacttgcattgtgaaacggaggtatattctttttggaataattctattttgcctccctcaagtcttgcctctgattgattagtatccctcaactgcaataccagatgtaaggcctcctccatcttcaaaaaccggagcaaatcgaatccctcgactgtttggatagcggttttatcctatgtggcactcatgggacccatatgtcagtactaatctctttttttttctttttactcacatccctcttttcctattctctctcctcgccgacgagcagcaacgcaatgacgacgacgacaaggaccagcattgccaccgccacaacatcgatgactgcgacgacgacgagtgcatgcgtcatctcaccggaggcatgagtgcatagccatggtccgctgttattcccagcggtccctagcgtcagctctcgaggtcccagcatcggcggctcccgtcagaccaaggtcccctcctctcccccaccccgtggctggtcggcgtggagaagggtggcgagttgtggctgtccatccgatgctgtgaaagagaaggagcaaataaaggacagaagtggaagaaaaacaatgaaggtgggacccactgcttttttattttccatcgggcactcaatgacacgtgggtcccacggtttttcataacttaagtgccacgtagatgccatgtcagccgaaaccaccgtccaaaaccgccttgggattttatttgcactggttgcaaattcgatgacaaattaagagacctaaaatgaacttattccttttatttttggctgacgtgtgtgcagtatgtgcacacgaagtgttgctgtcgagaagtatgctctccgatccaacgtcatggatattttactacattacggcgtttctgttattttctgtgttgaaacaccatctcaatcccttaactatcattgtcgacatatatacatgcgccaacacatctttctcgccctgaactatcaccattgaccgattagacttgtcatcgtccgttggccacaaattcagaactctcgccaattcaatttgtcgatagaatatttgtggagtaccgtgcgactgagcgactaatggggcttgctagtcgttaatcgaacgtgtggttatattcagtagactgttaacggaaacggatcctctgcagtcgaaccaatcctatctatatcttttatgagtcttttgcgttgctactgaaagcaatcgtctaagacttcctcaccatcattcccggccccgaaagatttagatgaagatttgaaagcaaatacacatcgggcgcccgatccgggggtgggaaaatcgggcgcccacagtcatgctgatgtcatacccacgtcatgcatgtaaaactactttaaactattttttttcttaaattatttatctaaatcataatccgattgcaccattaaattcgttgcaattaaatctttaaaacaaaatcacacgcgtatatattccgatgaaaaaatattagcttattattgaattatttttaaatgttgcacgttgttccaccaagtatatcggaattgtttcactaagtagatcgaaaatgtttcgatcgtttaaatcgggcgcagtttcaccttatataaaaaaaatattttagcaaatagtgaaaaaaagttttagttcactacaacatttaatccatacatagtgaaacattataagtacactaggtgaagcatttttggtgaaaaaaaatggaacgaattcccttaatagagggtttccataagatgtgggtgatttcttgcaaaagaatgtttcaattcactgcaaattagatctatacgtaatgaaacattgtgaatacactaggtgaaacatttttttgtgtacaaaaaatgaaacgaatttacttaatagaggttttccaaaatatgtgggtgatttgtttttttactagaaatactgccaggactttgccttgcagtgtgattttataaaaggaataaataggttatttacaaattacgagagaccgagaaggaaacaaaatgattacactgttcgtaaccaatcaaaaactgtgtgttttaggggatccttttttctacacatatgcagaagaaaatcggccttgaataaaggcctccaagaactgaatgagggaagctcatttcgaaagattttcccattcctttgcttccaaatgtgccaagcagcaataaataaaatttccaaaaaaaacccttccggttgaactgaatgcgggccgaaaccaccacctgaaagaaattaagactagagttccacacaattcccaaatgctgccagcactgctgactgaaggggcagaagaaaaaaagatgctctcttgtctctctgatattattcaggcataactcacaagtgagatcatcattctcctttgcatagtgacgtcgatcaagcatatcccttgtgttaagtctatctctaaacaaaagccaagcaaaaacttttatcctcattacatatcttgttttccagatccaaacaaaaaggtcttggcacttgctcattcgagaaagtgagcttataaaacctcttagttgtgtacttgtcagagttccagatgaaagaccaatcatcacccttgtcattatgcaaagagagagaggacaattcttcctctagaatgatgaattctccataggcttgggtgttcagaggcagcaagaaacaatcctcaagaggaatagagcacatttgattaacagagagggatctatccaaagcaaccatacacaaagctgggaatgcagtgcacctaatcttgtcattccaaaaatcatcctagaaaagagctgaggatcctgtcctgatgaagcattttgaaattcccctgaagatatcagatagagccactatatctttccaccaaaaagagcctttattccaaactaaatggggcaccttggagtcataataagaattccagatcagttgaacccatggcagatcctgcccttcgtaaaatttgaccaggtatttaagcagaagtgatgtgttttgaattcttaagttaatgactcctaggccacctttttcctttggtctacacatctaatcctaagaagcaagagatcttcaagttgagtttgggttgtttcccctccagaggcagtttttccttgcagtatcaatagctttaaccactgaaacaggcaactgcaaagaacagatgtaatatgttgggattgaggaaagcacagagttgatcaaagtgagtctccctccctgtggcaaaaattgtgagctagctgtcaatcttctctcaaccctgtctaccaatggtgcaaagtccactacccttggtctagttgtccccataggcaaacgcaggtaagtaaaaggcattgtacctatggtgcacccaagcagactagcaaaaagctcagcattctcatgagacagattgattgggtagagacaagacatatggtaatttactttgaggccagtagaaggtgcaaaagagttcaacgaagccttgaaacaaaacacctctctctatgatgttttgagaagaattaaagtgtcatctgcatactagattactgggaaacccctttcatcaagttcattaattggcttggacaacaaaccaagggagcaagcttagttaactattctctatagtaattcagcaccaagaacaaagagaaagggtgaaagtggatctccttgcctaacccctctcatgcatttaaaagaatttccaggtaccccattgagaagaactgaagaatgtgccgaagaaaaaaccatttgtacccactgcagccacttatcatgaaaacccatacttttcataatggatatcaaggcagagtgctgtatagaatcaaaagccttctcaaagtcaagttttaacaaaattatttctctctttgactattgacattgatggatatactcaaaagaccatgctaaacagtcttaaattgttttacccttaatgaagccgtattgattctcatgaaccagcttaggcattacactctacaaactatctaccatcaatttggttaatacctttaaactaatacccatcagagagattggcctataatcattaactgtttctggagaggacttttttggcactaaagttatgaaggatttgtttatcggctgcagatcagtataacaggcatggaagtgtgctgctaaccagtaaaattcctgtgatatgatgggccaacatttcttaagaaaatacccattaatcccatcagggctaggtgccttatctggttgaattaccttaattagattgtccacctcttgagtatagaactgatccaccaagcaatccaggttcaccggattgggaaaaagatccatcagattaaagtccatttgaggcaaaagaaaaatccccattctgtttttgaaactatggaataacatatcagctttctgattgtgtaaagtgactacctatccattctgatccagcacctgtgcgatagaattcgatctgaacctttaagtcgcaatggctttgaaaaaattagtgttctcttcacccagcagcatccacctattcgtgcaccttttttcgcaataaagctttttaaactcaaggagcttaaaagtttgcgacttgacaatttctctgaaattccattcaaacatggtcaagggcctatgctcttctattaggtctaggaaattaatcacagcattacaattgaccaagagagcagttaactgagacaagtttttactcaattgcagcaaactttttctcaaaaattttagcttgaaactgatgcatcttgccggatcttcataactagtgtccattgaccaaactctgctgacaagctcgaagaagccttccatttcaacccaataattctcaaatctaaaaattggagactttgggatatattgtgggccaggggatgaacagtggtgtttggaaaagccaaagtccaagatggacttgtaaaaacccaatcaagccgctccaagaggggactgctctgcatattactccaagtaaatcttctttcttttaaagggatttctagcagaccgagagaactaattatatcattaaaaatgaatatatcattcatatcagctcccggcttgtttctgtcctcaactaatctgtagaaattaaagtctcctaggagaatcatgttatcaactgacccaaaagaaaaattctttagccaagcaacaaaatctgaacgttctgggccactacatgggccataaatacaagttagggtccaagcttctgaagactgccttgaaacaaagttaactgtgacagaaaaactgtttatttcccctggagttcccaaaaaaacatttgaaacccataccactaggattccacctgaagcgcctcttgaaggcgagaatgcaaaagcatcaaaacgtttaggagcaaaagtctttatatcaggaatagtgaaattttgtttcttggtctcttggacatagaaaacatgacaaccactttcctctatcttttgcctcaaagataacaacttcgtgtcagcattcatgcctcttatattccagcacagcacattccaagatttaaaaacattacgcatgataaaaaaaacatatgggagtgcacaaagaagaagagctaaataaattagcctgaagaggcccacataacataaatccagaacaattgtaaagtccactcacactgtccaaagtccaacagcactgaaagacaaaagacatagttctgaacaaattaacactattcattcttaatcatccatgtctgcccggggaagcgtctttcttttctctcccgctaaactcgattcagccacgtcctcaggatgtaggccacataggtccacccccaacttttacaataaagacaaagaacaatcagaaggggatgaatctaaatttatatcatcatccagagcagagaaatcagattcattaatcttgctgccaggaataagaattttcgatatacctaccaactcgttcaactttttagcagatatcccccttggtttgccaattcccattcgatgatcaatcttaagctcttggctggcattaagaatcctggaattgtgccttctggtagggttgtataaagtagtcttctcatcccttttcttcacatgagccttaggaatcagaatcactgcaggggtgacttctggacttgatgactgggcttgcaaagtcatggcatctaaaatctcttgatgagtaagtccatcatcaggagaggaaggcaatagggcccagctggaatgtgctcttttaactacaggaggggcatgatcaagttcatgaaagggcttccatagggcagagctgaagggccagaattcaaagttgtatgcatgatttctagctttgcacaaatgatcaatcttttccaatagaccttccataggataaaaggatggatgctttggcccttccctgtcagctatctcctttgagcctagccaggaaaagctgcacctgttgatccttatccatcagattatgttcttctaacacttgattaggcaacacaatcagttgcctagggttttcctcaatctggcccattgggtgatccttaccccaagcatcctctatttttgcttctgcagcctactgttgctgcacaaagttatcccaatcaccacccccctgattaccagggtgtcctaactgccaaatatttccatcatctgggtcattagcatcatcatcattaggccctggctgcggcccagcagtaggtaaatcctcttcaggtggaatatcaacaaaatctccatccaggacaaaaaccgaaatagtccaagattcacctccaccgccattacccaaaggatcctgcaacactatctttcggggcacagagtcaagatccctaaattttgctcgcacaaacactctctatctagccagaaagtgagctaaccaaaagaggcaaccgctagatttatatggtgatgatcaacgaaatccagcagcaaatccaaaagaaggaaccagccttcccggttaaaatggcaagtacgccagtttggcccttggtcatgtttaacaaactcaacagtcgtcgtaagcagcaggggtgaattcaccaaggcatctctatgcatgaccgaatgaagctggaacataccaaacggggcggccgaacgcacaaacggcaaaatcctagaagcactaaagaaaaggcttgagggggcatcgaagggcaaatggccagaggaaatgctgtctgttctctgggccctgcgaacgacccccacaagaccaaccaagttcagcccgttcatgctactttatggtgacgaagcaatgaccccaacagagctaggggctaactcaccaagggtgacgttctccggggacgaagggggggcgcgaggtgtcgctcgaactcttggaaggggtaagagtcgaagcactcgaacacatgcaaaagtatgccacaggcacttcggcaacttacaacaaaaaagttcgaccaacggagctattgcctggtcatcttgtcctaaggaaaaaggcgaacccgatagccgttggcaaacttgaatcgaaatgggaaggaccgtacctcatcaagcacaaatccaggacgggatcctttcgactggcgacactggaaggcgaagagttcgaccattcctggaacgctgcctctctcaagcgtttctatgtttagaacgggtggcacccaaatcgccaacttgtaaaaatgtatatatcgttatgtaagcccttcggcactatgtaagcctttcggcatgaaaaaaaaagaaaaaaaaaagaggaaaatgaaaaaagacaaaaaaaactggatgtagggctattatccacaacggaggcccgaaccagtataaaatctttgtgtcctctgcctcatttttatttgtttgtgcgattgacaatttgcggaaaaaccccaagacaaacgcctgatcagcgaaaaaggccacggggcgaaacgaatcagccgaagcatcgctcgccgaacgattgaaaccgcaacagcttgtttcggaaaacaattagccgaacaccgtcacactcgatcgaaaggaaagcacgagtgcttcctgcaacatagaacaaaacggatcgaaaacggaagccgaaagctgaatagtcaaaacctatttcgctaagatatgaaaaggggccgacatgttcggacccaacgaaaagcacgtgaagtgacaatgcaaaaatagcgaaaaggaaataaaacgcacctttattgattttaaataaaaatgtatcatcacaatggtgcaaatgaagagaaaggagcaatggcgttacagcctggcttacagataaattacatcttcgccccagcgctctctctctctctaaggagcgatcgggcgaactaggttcgtcatcactactaatatcatacacaaccctaagaggagaagggagcgaaatagagactagactgtaacgacgctgggagatcgcctcctgccgatcagtcttctgatggtttcgccaaaagcgagccatgtcttccaaacgtcttgaatgaacaaaatcgtagtcttccaaggttcgcccagggtgcgcccgaagccacccggcaaccttaaaaaccttatagctgcgtccgtttatcaccatttcacgataaacaggccgaaatgggcatcgcacctttggcaaatcctttaatgccacaaatttctcgttttggtttcgccaactcccagaagggggccgaatgcacaacttttggcgaacaccctggtagacagtgcaaaaagggcaaaagacgaattgcatagtaagaataggcaaagaaagaaaaaagtaatgcataatgagaaatgggcgtaatcataaatacgccaaagattttgaccatcaaaaagtggctaagagtgagtcatatatatttaaaatgaccaagggcccctttttcagctacaataaggaggattggcggcagcccgccaaatacacttcgttcgccacatctggcgaacacaaaacgaaaaagaaaaactacaaaaatctaaggaaagggcggagggcatcacacctctaggtgatcctgggcatcgcctccacccccttcagccaccgcgtcctcttcttcgcaaaggtctgccgcctctgccttcgctagttgctccaaaaggcgcgccttggcggtagaacgaccgtccttctgccagaactgcttccgccatgcacgaagtgcgggcgaaatgtcctgtgcgccaatctcccaatcccccttcgcatagttagggaactcggcgacgtgctcgtagctgaactgttgcaggagacccatagtaaaggccgctgatacacgcgcacagcaatcgccgtacgtagtggcgcagtccgaaaccgaaccactaacctgttgggtccactcgaagaagttgaaggccgaggcatcttcggcagggacccctcgcacttttgcacccatgtcagtaagggcgaggcgaagcgtttggcacgccgttcttgcggattcggtagttttcgccatctcccgcgaaaaccgccgcgacttcttcatagcgctcgcttcggccttgctgacctccaggcgaagagcctccatcttcggctcagtaaggttataataatccgtcagcacggcggaatgggccttttctttctttaattcggtctggaggcgatcaacctcagctatggcttctctccctttctccagttcggccttgaggcgatcgacctcggccgtagcctcacttcctttctccaactcggattggagccgcttgttttcggctttcgcctctttcagggtgttggcgagggcctccatctccaagttcttacggcctatttcgtcatccttgacccgaagacggttcttaaatccatcaagacgagcccgcacggttcgctctgtcgaacagtgagctgcaagaatctggatgcaaaaaaaagaaaggaacggcgaagagagcaaatgttaattatgggacatgtaaaaaagcagaggaaaaccaagaatagagaaaaagcatactcgaactgccaagcttttaatagcagaacacacctcatcgaactcattcagttcggtgaacaagctcggggtgctggcaggtaagacaagattacttactccctccacaaagggaataaggtctgctcgggtctcaaaatcgccaggggcgaaacggggcgccgcaagagaatactccgaaacagatgtctcgatggccgcccccttccccttcgccttgactagcggcgaaataacccgctgacgcatagggctgccgaagaccctcgccgcagctgtcacgatccgttccgcggaggctgaagccccggcggcggcgctaccgcctgctccatcggcgccaagtgaaagaacgggggcggtcgaaaagtctaggctgcggccagcaggcgaagtcggagtctcgtcagaagactcgtcgtcgctgaagacgcgagcgacatcgacaagtccttttttcttggaaatccttttgaccgaacctcccttcgccgccatgcctgccgaaaacgcaattagcgccttcgccccatccaactcttttcagcgaaggggggagctgttcgactccaccccggtctcattgtgacccgggcttggagtaggagtatagccaggggtgtcgacgcggttttcgaccgcctcatccacggccttttggacctcaacctcctcctcttcctccccttcctcttggacgtcgtcctcgtcgtcggcgtcggaatcggacgaaacaggaacccttcgtttcctgggcgcaagctttacttgtccgcgcgttcgctttcacgaaggtcctgcatcgtcgttggccttgtgggggttcgcccgaggaggcagttcgccgtcgtaaacccggttcgctcggccagccgcttgtcgcgttagcagctggctatactcgacgaccgacacgtcgccgatcatcctacaggcttcggcgtcagcctggtcaagggtcaacactataaaaataaagggagtagccacattaagcgtcgaacaaagcaaaataacaaagcacagaagtgcattgcgaaagggcagtcttaccgttcgtcccttcagggagaaccaacttcggcaacccatcaacctcttcgccttgctcaactgcgatttgctacgactgggagaggggaaagatgcgaagcatgcagaattcctccaccaagtcgcggcagctaaggcgggagcagaccttacgcagtagagtgaaccgcgcctccatagcgccgtccacggcgatcttgggctttcggtttggcgcaatcgccctacgccagctccgaagggcttttgcggagtcagaactagcctcgaaggggatggtgtggtaaaaccacctcaacatccaatggcgatcccacttcgacatagcggcgttcaccggccagagatcggaccactcggggtgaacattaaagtttacgctcccgaacactgtcttcatcgttccagcttcggtaatcaccgtcttcgaattcacggtggcgaagaatatggcgccgaagagttcggcacttggctcaaacccggaagtccggcacgcccagtcgaagatagcgtccggaccagcgccgacgggctcaactgcgggagctcaacctggaaaaggcgaagaatctccggcaacaacgtgttgcacggaaaccagagccccgcctcaaaaaatacggcgaacaccactgtccggttgtcgatgggtttcggtacaacggctttccccgaggcgaaagcctgtccctcgactaaagccccagagctgaccaactttgcctgctcgccatcgtctatgagagaaatccctaaacaggcggtggtgtcgttgtcaatccggccggggtcgggccctttcgccgaagaggggttaggcttgcggggagccatgacgaaggatgtatgaagtggcgaaaggtgtgtgcagtggcgaacaaggggagtgagcgagaagtctaaggggccaaggggtgccgtgagagtaagaacggaggaagagagcgcgagcggtgaaagtggcaagtctggcagtgaaaaggtaacggggaagcatatatagcccaacaaggcgacgtttcgcctacccaccagtaataaagcgccacgtgtcgcgagggtaggcaaaacggtaaattcccatcgaccgagctgcacagtaaaaagcccacaaagggaagacccatcactgttcctttcggcccgataaaaaatatatatcacagacaacgaactttatttgcaggaacaatgtaggtttcggcaggagcatcggtcgaaggggggcgccacatatcataccacataccacatggtttgaatggtctcggccgaagctccaatctcacccttgcccgtgagaggcttgttggcggtatggcatgaggcccttcgaccaaaatctgccgaaggctatgtgaggagtggggagccaagcccgagacgtcaaaattagtcggggagaagccccccccatggcgaagactatggaacaaggacggcgcgagaggcgaaggatcgtgcgggtactctgctaagccggaggcctcttgggcaaaggatgcagggcgaagagtacatgccgaagggagacgacttcgccaaagcaagcgcgcccccgcgagggccagagaagccttttccggcccatcaagcctagaggccattgggccggcgatcgcctaacggcccatcaggagtccataaacctctattacactatatacccatgtaaatgtccctttcataagggtaaccatgtaaattcccctgtataaccaaaaccctagtagtaagaacctataataggggctataaatagtccttatagggccatgtaatggggggatcccaagtaaaaattctcaaattaatacactttacttctgtttcaaccactgttgagtaaccacgtctttcgacgtatgcggttgtcgttttaacaaaactttgatatgacatcactcgcggtggatgaagtggcagaggtcccgctgcacatttgtaatgcatgtatcgtcaaagcttgttcgatgttctattctaggcaactgcatgcatgaaagataatatattagtatctgaacgcgctgatgaagcctagagggggggtgaataggttgtccctgaaaacttaaaaacaaatcgcagcggtaaaattgaaatagactcgaaacttcctggtaaggaactccggaacttccggcctcccaggcccggaacttccggtgttctaagacaggaacttccgggtaacagaacagagatgaaattcaaatttcgaaacaagagactaagccaaacttcacaagatggtgcacaggtattctaagcagaggatatatcacagaatcatccacagaaacatcacagaaagagacaagagcgattttttcccgaagttcggatcttgcaatcctactctccgttgaggagctccaaagagctgggtctcaattaaccccttgcctcacttgtgcaaaaatcccagaggaaatccgcagccttcaaccccaaacacccctaggcaaatttctagaattgagtgaccaccaagatccaactcaacctactaatagaaatccaccacaagtgtgggttgctctacttggaagacctctagaatctcagcacaagaacttcactaacttacctcgttccctttcggaggaaaggaaatccttcacaaacttacccgggacatccacaatatgcaacggattctcgcgggtgatacctaaccgtctaggagataataagcaccgagatgacagcccacgagatattcaagtgctcacacaagttcctagtcttcacaccactccaaatcttcttctctccctctcaatctctctatctcacaagaattaggctctagattgagtggagaaggcaagaaacacttgggagaggctagcaacagctctaggttcgaaaagtgaaagtggaatggccaaagaacgagctggaaacgagctgtatatgtataatgactaggtgacgtcatctagccgttactcacaattttgaactggaaactagacaggaagttccggacctggaagccaggaacttccggataacactttggaaaaattctttcatcagaccggaacttccggacctagaagacaggaagttccggacctgcacttttggacagatgcagtataagcagaaatgactcctagggaatcttgacacttggttcacactaagagcacttgacatatctcagagcatcacctggaacccctcttaatagtacggtttttcctaaaaactcgatttcaaaagataaactatcctatgcacttctcgagttccagtccgctttgattttgtacttttggggggtctccaagcatccatcttccacacctttggactaatgcacttgaaagtcactcaatgaactcattagtcccttacccacatttgtcattaatcaccaaaacccactagggggattaatgcactttcagtatcatctagctgtgcagttcttcaatgcacttatacgttgactcgagagacttacatcctctacgttaaccttgtacctcccattaaccgtgaggaattcgcatgcgtaacacccgtataggatagtgcctctaggttgcttgtgacacttaatgacaaatcataggagaaaagagttaaattttgtaattagtaaaacaattggaatacattaagtgtgtggagtattaccgccaatatgtatgtactagcagcttctgctttgtttgaatttgatcaacacccttcttcttgtagcagttgtacgcactgtatggattttttactatttcgtattaaggaggagatttcattataatacattaatagtagacatgcaagagtatcagtatcacttactattgtaagattgttagaaattgtttgttcgtcttgtgatgataatcaagggggtccaagatgtcacggtgccgtacttcggttagataatgaaacatatgtaatgatcgctacatgataacaacggtgcagttagtcacggatgaaataacatagatatttacaaaaaaaaatctactggacttacttaaagttgtacgtggctaggatgactcttttattttgaaagtgtaagaagtctcgtccaatgtactatgcgacagtaatcagcttctgcttgtacaagccattcttatattccgctatctctttaggcgtcttgtccttgagctgcttggaatttggtgatagcgtcatggtatgctgtttttgacagatccttgttggatccagatatccgatagattgctttgccttcgcagcatccatatattgtatcctataaaagcagcttgttaataataataacatgtttatgtattatatcaattttttgtatgataaatgtgcactcatactcataggcaccatgcaccgagaaagtttacatccatcttttcccgacgattgatggcatgcagatcagcgaaatttagccagaagaaacctttgctggcgacagcatcaggtggtgatcgaattgttaaattagttaggccttcaatgctggtgtcgatgtaccatttatgtaaccatgtcatctcccatggaccctcatcaattgcataatccggccttttctttccttggcacgttttttactcccactgaagtcggttaccctccacttctccttttgatcatccttagacttggagttgaggcttttgagcactctaggcacttcagacttctcggtcggtttccttgttatcaaccggggtttggtccatgacatcttttgcaagatttgggtcctcatagacgtctggttctgcatcgtcccattccaaacccgatacgacttcgatgtctactccaactgatgacagaaattgcacatcttcttgtggcacatcccggttcttgcaccactggttcatttttcggtgcaatttgcacctccttttatttttctgggccttcagtggccctaggtggctaatgttcttccaccttatcattaaaccgtttcttcataggaggtcttgttggtttccgtggagcatcggtgcccgtgcccaagattatatcctttttgtgccatagaatatgataa

SEQ ID NO: 24670 - DNA, 728 bp, Oryza sativa
  unsure (1)..(728): unsure at all n locations
accccttgcgattgcactttcgcatatcaagaatcaataaatctgtcatggtacgttctaccagggatagcaatttcggtcgtagcctcaagtctcttaccagctcgtccactcggtacatgcaacgtacagggtgtagtctcctccaagtcatcaaagggataatttggttccggttgttgggtctcttcttctgtcttaggcagtagaaaatgtcttatgcaaaaccccatcatttgtttttcaaatttcttacccccttcgtccctcaagctttccttataggcgtcacgtctcttatacgaggaggcgtcctgtttgaacccttctttccaactcagcttagaggacactcctcgaacccgacccccgtgctcccgatttcccaacgcctggctaagcacatctttctccctctgtgggataaattctcctttcttttccttgctagataaatcttctatcttgtcggcaactccctgcagctcggggtcttcaaataacactttcccttccgatgtgatcttcggggtcctttcttttacccaatgcttggattgtatgttccattcttccattggcacaattcgatcaccacctgatgctgtcgccagcaaaggtttcttctggctaaatttcgctgatctgcatgccatcaatnnnnnnnnnnnnnnnnnnnnnnnnnnnnnnnnnnnnnnnnnnnnnngcagtatctcaattnnaacact

SEQ ID NO: 24671 - DNA, 825 bp, Oryza sativa
  unsure (1)..(825): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgttgaggacgaacaaggaacaatctggatgggagaaagaatgtgtgtacccgaaaacaaggaattaaaagacctgatactaaccgaggctcatcaaactcagtattccattcatcccagcagtaccaaaatgtaccaagacctcaaagaaaagttctggtgggtcagcatgagaaaggaaatagctgaattcgtagcactctgtgacgtctgtcagcgagtaaaggcagaacaccaaaggccagcaggtttgctacagccacttcagattccagaatggaagtgggaagaaatcggaatggatttcatcaccggtttgcccaggacatcatcggggcatgattctatttgggtagtcgttgaccgactcaccaaagtggctcacttcattccggtgcacactacctactcagggaagaaattagcagaactctatctagcaagaatcatgtgtttacatggtgtacctaagaagatcgtgtctgatcgaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24672 - DNA, 1093 bp, Oryza sativa
  unsure (1)..(1093): unsure at all n locations
gttcggaaagcataatttggggacaaacanaccgggtggcatgtggtatttagcgtattgaacaaaattatatctttaaaaaatactattgggttcatctgttgtttgtcaagctaactgtttttttttctaatggatatatcacttacatgtcacaatttttgttaaggtgaaataaacagtgttctaactattttcaataagaaattaatatactttagtgcaaatcttagtaatacataaacacaccaaattataagctaggaagatgcaacatctggattaataaaataaaatcgaaaagttacactaaattatacaagagttgtgatctttcggattaagggtttaataagctatttaatgtgctacgttttagtcgatggcaattaagaagaaaatatcagatgactgtaaagctaaacaccatttgaccatccaagtacattaagaattgaaaagttttcctacatttaatgtgagaattccaacctaattttgctatatgtcagatgagactaaagtggaaattgtaagagaaagaacataaataattaaatactatttacgaaagtttgtaactaggacatagtactacttattatgaaaaagtttatagctatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacactcacgtacaaagcacactcatattcgctttcactttttgagggatcatgttgagaagnnnnnnnnnnnnnnnnnnnnnnnnnnnnnnnnnnnnnnnnnnnnnggnnncgtcgaggggttcttaantcaagggcgc

SEQ ID NO: 24673 - DNA, 721 bp, Oryza sativa
  unsure (1)..(721): unsure at all n locations
aatggctnnatgatgataatacatgccnctgacaacnnacnnnnnnnnnnnnnnnnnnnnnnnnnnnnnnnatcgtggagtactcacagctgatagtcgagccttcacaacctaccggggagccgtcatgcattatgccgcgctgatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagaccagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattggttttaaaagtcacactagttgctaccccttacttctggcatatccttctttgtttgcttgctcgaactaccactggttttatttat

SEQ ID NO: 24674 - DNA, 6640 bp, Oryza sativa
  unsure (1)..(6640): unsure at all n locations
aaagcagtcctatatgcccaaaggtgcatcagatagcttgtttttccatgccttccccatctcattgacagtcttctgtagaatattcttgatttgtttgttactcgtttctgcctgtccacttgtctggggatgatatggagtggcaatattgtgctgagcccaaagttcttgcaataagttttggaaggtcttatcgatgaaatgagaccctccgtcacttatcaccatatacggagttccaaaacgagggaaaatagtctcgtggaacatccggcgagcgtgcttagcgtctgcggtcctgcatggcattgcctctacccacttggacacatcatcaacggccactaggatatactcgcagtcataggactttgggaaaggtcccatgaagtcgatgccccatacatcaaatagctagacttgaaggttaaaattcagaataaagataagtaatattgaaaaaatagtccatgtataacataatacgagattaattagaactcaaaataaaaataaaataaattttgaaaatagaaaaagaaaaataaacacaattttgaagtaactaaaattcttactactccctccgtttcatattataagactttctagcattgcccacattcacgtgtgtgtttagattcattaacatctatatgaatgtgggcaatgctagaaagtcttataatatgaaactgaggaagtacttttttttttattccaccttcagccgaccgctcctctccttgacccacaaacccaaacattgccgaccctctagatatgtctccacatgcgtttcgtcttcttatgaactgcaaaaataggtttcatctttgatgggcatcaatgcccaccgaattccccttcaattggtgcattaattgtctcaatctgcctaatcttttaactctggccaaactgccaccattgatgaccagccgagctccccctagaagttccccttccttctctgacctataaaggggcggtaacatcctccctaccctcccctttgccttttccgggctctcatgccccgcattcactctcattctctccaacggacacctctccccgtcaactagagcagcgtagcacctcaccactgtctccattagcatcgctccaacctcctctaccggggccacacctttgttccggctggcagaagcaagacctcgttggcgaccagtggtaacgtcgtcatcttgctccttcagcagctggcctcgcctcatcggagtgccataccgctatgtcgttgtcactgtcggcctcacctcatcatctttcccccagctacccctatgcttcaacccaagaccccaggaatgttgtccctaggatcgacaaaaagaacgccttcgtcttctccatctatcgttggttcctgctgttgaccgaggatgtaaaagccaccatcaccatatcaaactctgtcgtacgtcggctgcaaggatcctgaatatcgaacaacccgttgctgaactgttgcctctgccaaagcaacaacggcgcgctgcactgttcccttcgagcggaatcatcgactcgactagcacgaagaactccccatcctgatgcggcaccccaccgccgttgtccatcatcaatggcatggtgttggattcggagtcaagagggcttgccggcaacccccgcttgggcaagcttctatctcaagttcttcatgtcggacttgtggctatagattttcttttttctgtcacttacatgtgcgccccacatctattttttaatttttaaatgcttaggctgccaggtcagccaaaaccacctcgcaaaccaatgagctcggtaaaatgcttagtattaattaatagttgagtgagtcaatgtactcgatttttactattaagatacttgagggagtcaagatggagtttttccttccgaagcacttgctccctgcagctgggcctggtcgcttctttacagcagactgggctctctctggcccaatcatgtctgcccgagctgctaggcctattaattggacattttagaccaacacaatattgtttagatagtaacatttctagcgcacactaaaatatactatttttcacgcaatgttttatgaatatacctaaataaattataaaaatacaacatactcaatctaaagctcaacatgcaagtagaaataattacttatgcaagaattaaatattatctataatttattgaattatacaaatcaacatgtaaacatatccaatcatctcctctcacattatttaaacatatctatctattatttttataatacttagcatatatctatccatatattccgtgttagtggaatattgtttagtttgtttcatgaaaaaccctacttttcatttgtttcccatctttcacttcttgcgaagcaaatcttggtcaacaatataatatttaatctgcaatcttctaaagagtctattaaattcatctttcaacaaaaatgttttgacaaacagtttcatttgatgctaatatcatgtttattccttacttgattgttgaaaaaacatattaaagattatttagtaattttcacatattaaagattatttttgtacatcctgctgccaggcaaatcaggtaatttctgtatatattttttttcaaattttgtatatttatgcaaattcacaacaaatatattttcatttttttctggtatagcagaatgtaatatatcagtttggctatttccaccgggggcaaccgatgtgaccgaaataatcttggatattttggaatataacggtccaaaataatttagaatttgcacaaaattaggtcatatttgaactaattttgcgaaattcgaaagaaaaacaggcgaaacagcttcctattttgatgcggtctgaaattttggaaattctattcggcaatttttgaacctggttattagtagtagatgaaaactagatattacaacatttaatgatcttctcaataccatccgcatttaaagaggctacaagtattagtcgaagacatgactacgttatatctgtgcagataatcaacattttccaaaagataatatcgaatctactaagttacgtagaccggtgtctgatgatcctcctttactaacacatttttcagcttctatcctcagatttctcattctctgtttcacattttgaccttcctccccattcactaatttctcaacagcagtttgaacttttgccctctgcagaacactccctacctccatctccacacccaacctccaaacagcacaaacatacctcgcatttcccatctgatctccaaaacatggcctacatatcatcggcacgccttcagatatactctctatcgtcgagttccatccattatgcgtcatgaatgcgcggacagaagggtgacctagtaccttttcttgcggtgcccaagagactatcctgcctcgaccattgatctcttcctgcaaatcactagggagctcactggaatgcagccgtaacccacggacaaggcttggccgaaccacccatagaaatggtagcttggtgccagccaagccccatgccacctccagaaactcctgagcatcaatggtggccatggtgccgaagctcacgaacaacacagagctaggggcttgtgtgtcaagccacctcaggcaatcacaatctgggggaagaaagctgcttcttccgacgagtggtatgagtttgttgagtggaccaatggcaaacacagggatggagagctcgtcgcggatcctgcaaatgttgtcaccctcgatgaagtcgaaggtgttgagtatgagccctgatgacagccgcgctgcggcgactacattggcaagcacgttggcgaagctgtagaggtttgtcgtgtcaatgcgctgtagatccttcactcggaaaggggggagaatgtcgactagagtgtccttttgggcatctaaaataaggagaaatggatgaacagatagatggagtagaaccatttatatgaaggggttatatttagtatcagtaaagattttgcacataagggaaaataactctgtttgaattttgattgaaatgattgaatcagtgaaacaaccaatacgaaaaaacatattaggataagttctataagtaatttagaagataaatacatatttgtagttaattattttaaatatacatcatgtccaataaaagtagttctgtaccagttgtcagattttgatagaaaaacagagtataattataataatctactttcagaatcaacctattcggttttgcttttgattctcgggcaaaatccacatcaaacgaaaagcaaacggggctaacactgtccatatctcaaggaagattaaaactagaactgcagagacggttgaatctgttcattcttacagaagacccaccgatcccagaatcatgcaagccacttgctagctaataaggcttgctttgagtctgttttcgatttttggctcggtgattctcgtaattttatttctcagactgtctgtgctgacgccttagntgagtaatagatcattactttttccccggaaaaaaaaactgttctttcttttctgctggattgccaagtcttgactgttagggtgtgtttggataatgagaaatgggagtgggattgggattgggaaatgaatgaaagattatgattaaatgaaagagggagaataaatggttaggatttaaagatgtcttttaatagatgggaaatcatttccctatatcattagccaaacaggaccttaaatctatatactctctatatctcgttatctagaaaatctacctaatatgttgaaaatatttctaataacttgatgatcttcataatttccgcaaaataagtagggagaaaaacacagagctccaagcgatggacacatggagtaaactcaccgtcgacaggcaagaagcccctctcaagcagaagagggtactccatgaacgtccggaagctcgacgcgctgctcgtcatcagcagcatcagcggcacgccgagctctggcgccgccgccgccggcgcgtaccacatcacgtcggcgattacgcacaggacgccgccctcctcggcgagcagcgcggccagccggtccgcgaacggcgcggcgcaggtctcgttgagcgaagtcaggaccgccgcggcgtcctcggacaccacgagctcgggcggggtgccgtcggccacggccacgaagcggtactccggcggatgcgccgccgggtccggcgctctgagctcggtgtggaggacggtgatggagaagccacgggagcggagcacggcggcgaggtggaacatggggatggtgtggcccgggtgcggcatcgggaaaaggatcacgcgcccgcgcgggggcgccatcttcgcctgtttcatttagtgagataaatatatatatatatatatatatatatatatatatatgcagaaattttgagggaatcagcggcggtcaagaaataactcagttctaaaaaatacctgacaacacgaagtccaatttatgcgtttttgttatttatttatcggaggggactaccgatcgggcatgacgtcagcgccacacatgcgtacaaaactactttaaactattttttttcttaaattatttattcaaatcatgatccgattgcaccattaaattcgttgcaattaaatcttcaaaacaaaaccacacatggatatattccgacgaaattttctttagcttattattgaattatttttaaaagttacacgatgttccaccatatatatcggaattgtttcactaagtatatcgaaaatgtttcaatcgtttaaatcgggcattgttttaccttatataaaaataatgtttcagcaaatagcgaaagaatgtttcagtccactgcaatattagatctatacatagtgaaatattctgagtacactgggtgaaacatttttggtggaactatcgtttaaatcgggcattgttttaccttatataaaaataatgtttcagcaaatagcgaaagaatgtttcagtccactgcaatattagatctatacatagtgaaatattctgagtacactgggtgaaacatttttggtggaacaaaaaataaaacgaattctcttaatagagggtttccaaaatatgtgggtgatttgttgtaaaagaatgtttcgttcactgcaacattagatctatacatagtgaaacattgtgagtacactaggtgaaacatatttggtggaacaaaaaatgaaacgaatttcattaatagagggtttccaaaatatgtgggtgatttgttgcaaaagaatatttcaatatactacaacattatatatatacatagtgaaacattgtgaatacctttggtgaaacatgtttgataggggcacgtggcaggtggaggcaagataaatggtggggcccactggcatgcgtgtcgcatgggggaagagtgcccgatttcgctcccccacgccggtcgtccgaggcgaagaattttcgttatctcaggtaataccggtgtgggattcctagctcagacaggaagttagctaattagtttgggnnnnnnnnnnnnnnnnnnnnnnnnnnnnnnnnnnnnnnnnnnnnnnnnnnnnnnnnnnn

SEQ ID NO: 24675 - DNA, 1404 bp, Oryza sativa
  unsure (1)..(1404): unsure at all n locations
nnnnnnnnnnnnnnnnnnnnnnnnnnnnnnnnnnnnnnnnnnnnnnnnnnnnnnnnnnnnnnnnnnnnnnnctttgccgtcccaagggcaagctcggccaccgctcatcctccgtgaatcatcgccgaaaccccatccctatcactcaaggtgagctccacctagtactgtcgctaccggccattgttttagctgcaccgctccggtcctcccctccttaatccctcattccccttccgcaggtcgcggccaccctcgtccgtttcttcctaagcgccgcccgtcgccgaagcaacgccacctcccttcgccagagctccgccggcgcccctcggtgaggaacccctccatctcctctccctttcccctttttccgccgcctcccgcgtgtgtcaccacgccagtggtcatcgccggcgaccatcaagccgtgcatcgtcgctccccggccggccagccggtgagccggctcctgctcgcccgtggccgcccgatccccctacaggggcgatttgggccgtccacgtggccctccccgtgccgcctggtgtcgctgccctgtggtgccacatcggcgccacctcgtcctccccgtccgccgtggccacctcgtggctgccatgtggtgcgcccgcgggcagtgcgcacgtagaccgagtccaccgtgtgccgaccttctttgagccaccgacaggtggggcccgcttgtcggcgccacctattccccttggtgacgtcataaaccattattaattgcgcaataaatcattaataattctagaaatccattaaaatggttcaaaacttctaaaattcatatctaattcatccgaactccgaattgagccattcaacttgcaaaactcatctaaaattgagctctacatgtttgtttacttttatgtactatttccttggtatttattagagattttccttgttttgcgtgccagcgtgtagtatccgtcgtttcgaaagtccgcggtcgcgaagaaaagagttcggaagattgtttgaaagaacaaggcaagtcacacattccccttgtgcatgttgatcccaatttataaatgttttatcgtttgcaaataaatatgcatgttttgctaattacatgggaatagggtttacctatctgctcgcttgtgccatgtttacttgatatctgttctttgcaaccctggatgataaatcgactagctcatgttacttatgtgacatagctagaactatatgctnagcccatgctaattacactagctcagtnatgggataatgcagtttagacctttagatctgatgagctgctgctcagacatccggcatgttattgccatatttatcactaaatgcgactattgtgggctggggtgcatgttttgctgccacacaatgcatgaagac

SEQ ID NO: 24676 - DNA, 1411 bp, Oryza sativa
ttggttcgggtgttggtctcttcttctgtcttagcaagtaaaaaatgtcttatgcaaaaccccatcatttgttttcaaatttcttaacccccttcgtcctcaagcttttcctaataggcgtcacgtctcttatacgagaaggcgtcttgtttgaaccctcttttccaactcagcttaaaggacactcctcgaacccgacccccgtgctcccgatttcccaacgcctggctaagcacatctttctccctctgtgggataaattctcctttcttttccttgctagataaatcttctatcttgtcggcaactccctgcagctcggggtcttcaaataacactttcccttccgatgtgatcttcggggtcctttcttttacccaatgcttggattgtatgttccattcttccattggcaccggaacccccgccttcttcatttcctcatcctctttattccacagtgcaatcttacgtgcgtacccaccggagcccagtcgatggtgccatttttttcgcttggccaagtcagacaaccttttactcttggccatttcttccggcgaggtcttgaactttacaaatttgtcccattggttcagcgttattttcccatatttcttaaatggtgccttccccttctgcacgaattgtgtgttcagagtgtttttctatccgcgccacgccttgtccattgtttgcaatgcgcaattccttgtcattgcttctgatccctcagggaactagaaccttttcttcatctcatcccaaagagttttcttgtcccctgctgacacactatatatcccagtccttgatcatgactgcgatcttatcgcttactattgcgctacactgaaagctgaactttgcgcgtgcagtggagggcgcgagcggctcaccatttggacttatgtgggtgacaacgtacaacccatcgtctattctattcacgctcctcttgccctttctctttttggtaagctctttggactttgctttcttcttggagttggaggtcgtagttgggacttcatcgagttgggcggcttttttcggatgccatctagatctttgtggccccatttcctacgatattaattaaaaaatggttgagttagtacgaactactatttatcactcgtacagttgcaactcaaatgacattatagaaacctaccactttcttgcgaaggacgtagtcttcgtcgtcttcttcaccatcatctttcgtccgccatttcgggcttggaccaatatgaatctccctcgtcagcttcatcactgtcggacccatcggctggcggcacggtaggttgcgaagcaaccacaattgcttgtgacggctccacgataggctatgacggctccacggtaggttgagaaggctcgactatcagctgtgagtacttca

SEQ ID NO: 24677 - DNA, 1005 bp, Oryza sativa
  unsure (1)..(1005): unsure at all n locations
agtgtgattgttgcctgnagaatctctggcnnnnnnnnnnnnnnnnnnnnnnnnnnnnnnnnnnnnnnnnnnnnnnnnnnnnnnctgggcgagctggatcgggccgacggcccaagaaagaaaaagaggaaaagaaaagggaaaaaggaaaaaaaaaggaaaaaggatttttcctgggattaaaatattgcgcttgctcatttttaattggttaaaattatttccaaggctctgaaaattccactaaaaatcttgttaatgcattggagcatggggaactcaagaaaaattccaccatgcatttccgattattaattgcatttattaattagagaattagctctaggttaattaagataatttcttcggacgatttatttagccaatttttaaagcaaggagagggggaaacttcagggcgtgacacgcggcgacgacaatggcggcgggcggcagcggctaggtcaggcgaggcgaatccggtgcggtggcgagcggcgtccacgagctcgggcgccggctggtagggttttttttttggacttttatttttttcgcgattttttctttttgtatgcggttgacttaagtgcccgcatgcggattttcgcatgcgttcggcctagccgcatgcaaagatcgccatctttgcagacgatttggcacatgcggttggcgctaccgcatgcgaaaatcgctcccgcccgtatgcaaaaaccgattttgtagtagtggcggcggccggcaggagaggatcagcggttcacggcggccggagggcgggagggagaggagcggccgtgcccccgtgctggcgaagggggcggccgacgggagcaccgcgagggaggaggcgagctcgtcaaggcggccgacaggagaggagcgacggcgcgtggggaccaaccggagatgaggcagtgcgcgccaatccaccggagggagggagaggagcggtggcccacccgccggaaaagagcaatggttccccgccctctccacctg

SEQ ID NO: 24678 - DNA, 1118 bp, Oryza sativa
gctcatttatattgtcccatttatttattccatttgatgggtgtcgtcgcgtcttcttttcatctacttttgtttcattctatggcatttggactttgtgtcacaaattatattataagtgaggcactaataaaaaatgtgtttttcttggcaccttctttcttttttttcctctagtggataaaattcgaaacacttgtgaaaatataactgaacgcccttgtttaatgatcactagttgtcgtcttaaaacaattgcctgtaaaaatatccccattttcacaagctatcttcctagccaactacttttgaaaatattttgtcaccatcggttctgctacgcaattgcgtgataaataaaacgcttcacggtattaaaaagggttaattggatccatgtcactgcaaatatgacatactaaaaaaataccactactattcttgaaatttgttgcgtgccgctagaatttttaaaaaattagaaccatgtcactctgtagatggatgccaagctgtctcgccagtgacctcgagcctccgccccgatatcaaagacgtcaccgctcgtggatgctgctattgctattcatgcggcccaaagcagagccaccccttgaggcccatgccgcagatgccatggacactaacttcctccttagggttgcggcagctttggcggcgacgaggaagagaagtagaggaaggaccagaaactcttcatccccgggctctcagccgtcacggaagatggcggagggttggccactggcacagcagagggaccgtggtgtgacgtcacagacctttctccgctctagcccaccgccgaggagtagagcgggggggcaccgctgcacggtggaagcatggcgactaggtagagggcggatgttttggaccccgagagggaagaagaggctggagtgctagacttggacgagaacacgagcctgcccagcttctcccgtaggcagtaggcacatattcctccgctagccatcgccaccaccgcttgtagggatgctcgctagcttcgctgcagtactgaattcattcaggcatgcttgcactaccgagccatcatcctcattctcattatccactcctttctccggtta

SEQ ID NO: 24679 - DNA, 3800 bp, Oryza sativa
  unsure (1)..(3800): unsure at all n locations
aagaatgaaattgaatcggtgatatagcaccaactgggcatctatctctatgacagaaatcatgacgaagtggcatggttcaaatttccaaaaatttcaatggcacgcactatgtttcacgaataatactggcattttttttatatatgacatgtttgcaatggcatttaatccaattaatcctattaaaaacacgacatataaaaactgccatctctctccaccttatccttatcgcttcactctccccaccgctcatcccttcactccccaccgttcccatctttctgggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccaattaaagttctcccaataaaggtgcagtgttaggggtaccccaagacgatgaaaagatggatggaatatttgagagtgatatcatatatggattattagaactctataaccttgaaagttatgtggaaaatagtgaccggaaacaacaccctagtggtgtgaacatggatcaagaatggttttacttaatttaaggcaacagttatagcttccagaaatcatttcaatgcctctcggaagttgactaagaaatcattccatacatgggtcagaaagatacaagggtcaggtccggaaaggtttagccagcagagtgtacgacagagaatccttctcgataaatcatcccaactcaaggtttgaaagtggagttattatgatcaaagagaaagagcagaaactcttgatagcgccaaagtcagtttccaacagtcatacagattgcagtatttgttggaaagcaactttagagcttatagtctatcaacccagaggagtcaataaaggataagcaaagaagtgaaatgttatatcgaggaaataatcttttgagcttgatctattaagtgatcagtgcttatttcaagatatcaactaagcagcccgttcaaccagttgacaccgaagtcagggcagaacagaacagtcatgcagatggaaaggtcaatcaagagtctgtatgttcggaaactgaatgagagtcacttttgtggaacttcctgtcaacaactgatcagtgttatgttccaagccctcttggaatgaaagtgcaccggcatcaccttatttgaactgattgatgaagcgatgagttctccaagtcagggttccaggaaaataaccgaagtttggttattttcaaggatagcagtttaattgatcacggtcaggcaaatgctcaaccacttgttttaagggtaagtctcgaagatgatttttgtcatgccccgtaaccgtttcaattggatgttcagataagcagggaaagaacagttatagctcaaagaagcctattgccaagttaacagatttaaatctaacgtgtacacccgggctgccgtgtcaacagttcagcctacagaagaacagggagaaatcgtaatccaggtgaaatgccgatcaagcaacttcttcaaatacttgtttccgggtcaagagtagttcaaagcaaagtaagcatatgaggattcacgaaagtcagtgcaaaagatgcaccaattccttgtcagcaaagtgagttatcagtttatcaagtatgtcagcactaacagttcagtccaagatcgaaattaaatggcacaagaaactgcattatgccgctctcatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagacgagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattgtttttaaaagtcacactagttgctaccccttacttctgtcatatccttctttgtttgcttgctcgatctaccactgtttctattcattctccttgcaacctttaaaagttggatcttatagtttttaaagtttattgtcctgttggatttcatttttataatttctagaagcctcgtcaaacactaccattatactcctctacggccgtccactgcatcttctccatttttactttctagaagttccgccaaaacgcccgggactttgtcactatactcctccacggctcgcctgctgccgctcttctttattgtcattgagattttaaattcaaacataattattattggtttttttttactttttagaagcccgaacctttaaaaagggatcttatagtttttagagtttattgtctcgttgggttatgaacagtgtatttaacggcgcgggatggacagaaccctaacggcgatgttatttttagacaaaatcatttgtacgatggtatttcttggaattcacgcttatcgatagtatttcttagatttggacacttgtcaatggtatttattggattatctctaatttaaattagcagcttgatttatatgttataattttttttaggttttccgttttttacataatcaatatagaaagggcggacaccgggtgtggaacaggagggagctagggagtacgtatgtacgtttgtacgtatgtgtataggacggtgatttagtgatttagtgagagatcatatagcatgaaaatagaaactaatatagcatggaaataagagagatcatatagcatggaaataggtgagaattaaagggatagaggggagggagggcgtgtatctctgatctcccgtacgcacggaccaagcgggatgtggatttttttttaccaaaaaatagaactaattccatgtattattgggtccaccaaataagtgtaaatctaataactaaaaatctgaaatagtgggtccaccggtttattagattaccacgtggcggcttaattaggagcgtttgtaggagtccaatgtggcggcatgagaacgtttgtaggaagtttaatggacttttaatatataataataatagatagatagataaataaattgcctacgtatctatccaggcttccttcctagttttgttaattggagggaagaaatttgccaatcgactaggttgtgtagatacgtgtagaaaaatggggttttgatatttgcatgtcgcgctttgtttattaatttcgggtcatggatgtaaatgtccctttcataagggtaaccatgtaaattcccctgtataaccaaaaccctagtagtaagaannnnnnnnnnnnnnnnnnnnnnnnnnnnnnnnnnnnnnnnnnnnnnnnnnnnnnnnnataggttaacaataaacatcct

SEQ ID NO: 24680 - DNA, 1795 bp, Oryza sativa
  unsure (1)..(1795): unsure at all n locations
cgcgctcatgatgatacaacnnnnnnnnnnnnnnnnnnnnnnnnnnnnnnnnnnnnnnnnnnnnnnnnnnnnnnnnnnnnnncgagaaaaattgtcaacaataaccaacacataccactttcctccaacagattgcactctagctggaccaacagtgtccatatgtaatagctgtcccggtgcatccgtcaacacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtgcaagtctacgatgccaaaacatcacatctttatcaaacttagcaaccaaacatgttatcacaggtgaaacaggattttcaaaatcagctttaaacactcttctataacgagaaatattcagcacaaaatcaccacgagaatcaaaaactttactttcagttttcttaaagtgaacttcaaactcttcattaacaatttgtaaaaccgaaagcaaattgtacttcaagtcctcaaccaaaggtacattcttcaattcaaatttttcatttaccttaaccatacctgtagcgagaacatcacttgtagcagcatcaccaaagataattgattcagtcttagatgccttctttagggagaagaaccaatttttatcaccggtcatgtgccgcgaataaccggaatccacgatccacacgttctccttccttggcaccaaagcctacacataagcagaagtcgaagccttagtactggggttacatgataataaaaatataggaatccagtactgagacacatgaccagaagatcaaataggcatatatctacatgcaaaatcaattttagaattttcagaaaaattcctccaaggccggtctgaccgagggtgtgtagttggtctgaccgaggcttcaccgccggtctgaccggtggtcggtttgaccgaggctgttcagcccgtctgaccggtcgccggtctgaccgcgggacccactacggtctgaccggtttcctcgagggaaaactcgatttttgccactttgattttgcaaaagcaatctctctctcctttttctttttatgagctaatctaaacaaaaatcaacaatatgtccatcttttccacaaaaagaacaagtatatttttcacgatgattagacatattggtagcactagaagatttagcaacacaagcaacaacaggagattttgcatgcataacattggattttgaaaaagatgcactcatagtagacatgataccagcagatttaaacacagttttgttagtatcaggtttaaccaaaatctcaccacttctagcaccaacacctaacacaacaggaggatgtctagaattatgatcataaggattaaaacctaaaccacggttatgtgtgctaacctttgattgatctaaaatcatgttgaggttctttttaccatcagaaaatcttagcaaagaatttttcaaatgagaaacctctttttccaaattagcacaattttcacaatctaccatgacacctttgcttttacgacatttggggcaagaaagcagttcattgtttttcacaacatcttccatgtactcaacacgacctaaagcatcttttagtttcatcttattcaaattacatggtgagcaatccaaaacatcatgaggttgttttaactttttagcagaaatcatgttaaacataaactagcatgaaaggcatttgatattttg

SEQ ID NO: 24681 - DNA, 2615 bp, Oryza sativa
  unsure (1)..(2615): unsure at all n locations
ncattattcatagctcgagcanttcntgttagcaaccnaaacccaaatcctccctcctcgatttgttcaagttgatcatcggatgtggcattaaaaacagcaagaaaagatgacttagatgaagaagcatcaacatctgttaacaaccagatttggtaacatcagcatcaggaaagaagattagatcgaagcaaagttggaggcggagatcgagttcggaaatagagcaggaatcggctggagtccggatcggctacgattaggatcagctgggtctgagtcggactaggaaagtcgatacagccgattccgataatacaacttgacgtgtgatgtcgggttggattgaggtgcttcaaggagattgccgcacatggatagagtcctgaggaggcaattgtatctattaattaggatgctttatgtaatttctttagagatacgattgggcaaaagtctgccgcaaagacttatagtatcttagagtttgttagagatggtaatcgtgtccattatggacatatcttgtaattctcgggtataaatagaaccgagccctatgtaacttaaaaacacacgttcaatataattccggcgcatcaccacccttttttactttagttttgtttcgacgagttcttgcttttgggttgagctgcatcggtttcgatcttcaacaagaggtaaaacttgttatgacggcttgcgttcttgagattagcgcttccatctctatgatattctaatcttgtttatgtgatttgtcgagttatcatatatcttacataatctctggcaatatcgctatctaacctacaatcggctaacatctatcgaggaaggcagccgattaggttagattctgacgttgactcagattatataagatatctaccactctatgaaacttccagcggcttgattgtctagatattgttcttcttttcatacttaatgctgcatcagttgagtttgatctattaagtcatgattagaatatcaatctctagcctgtcttctggttgtcgattagggtagcatcggagtgtcagccgatcttatctgatttaattatatttgctctatatgcttcattgacatgttaaatctgccctttatgtcaagatattatttttttaagtatattaggcttctgtttgatatattttacctgttttaatatcctaatatagagtagtatcggagtattagccgatacatgctcgatctatctgatggggctatgctataaacatatatagtcctgttattaatatatattttgatctaagtgatttatacagtctcggcatggcgaccgatctatcccaatcacttgatttaagtatatatcgatataagaataatatattgaaaatatctacagccgatcgaatagatttagtcctttattgtttatttgcaactgccgatagattcacatatgacatcggctcaaagataaatgatatgtcatcggcacctagccgatcggctatcatttatagatttaaccactgtttctttgcttctatttcttgttgattacaggatcaaatcaactggcacgctagcgcacccgaaggcgagctttggacctgcactagagttaagcagatctcccaggcctcgtgttttatgtcaacacgcttttggcacgttcggtgggtccactaagaagtcagccaacaatccttcctcatggccaaaaaacaaccaccaccactatctagcaaaggctgtgttaaggaaaagatgctgaagttgggattgactgacgtcaatgaaggaaacgtcgtgccggtcgatccagaaaaattcacacctgagcagaagaaagagtttgaagcaatgttgtagcaagcacgggatcagttcgtgaactcattcatgtagacccgcaaggggacacttgttcagaagtacaaaataaaagtcgttgctgatgatcctgggactagttcttctaaggatggagatgggaaacaagctctagacggctcggctcagccgagtatcaagggtgctaccgacggctctctaggaaatcaaggtgacaattctcaaggagtacatggagtacaaggtgacggggtgcatggagttcaaggtgacggtgctcaggggatgcagggaggaaattttaatagtgaagtggcacaggactttttcaataacttccaagatcgggttgattacgctgtgcatcatgctttgatcaatcagtctggggtgttagtcaataccctatcaaacatgatgaagtcgatagctgatggttcaatagctgaacatcaggctgcaggcccggtttatttgcaaggaggtgtcttcccaaattatcagtctttgatcaccgatgttcagccatctattcaggcgattccctccgttgcacccacaactcagccggcggcgccggcatcaattcccctatctgctacatcagctatggcgccaggccagctagtgaaccctcggttgttaatgagggaacagccatagcatggcgggcaggctgccaatcggctgacccaagatcaggttgctgccatgttnnnnnnnnnnnnnnnnnnnnnnnnnnnnnnnnnnnnnnnnnnnnngacataccccct

SEQ ID NO: 24682 - DNA, 2192 bp, Oryza sativa
  unsure (1)..(2192): unsure at all n locations
nnnnnnnnnnnnnnnnnnnnnnnnnnnnnnnnnnnnnnnnnnnnnnnnnnnnnnnnnnngatttagcaccaggggtcaataagtgcatcggccgggtttgcaacgcctggtggtcagcctgtacaacaatttgtaaaccaagttgtcccagaacatttgtttcaccacgtacagccggacggcacagtaatgcctcaggttgttcctgagcacttggtgcgcaatatccagccgaaccttcataattaccaagggggtaacttgagttatcaatatcagcctccttccccgcaagcccagtatcagccagggggattggctgaacctcggtttgcatctcaatatggttagttcgagcccatgcagcaacagccacaaggagcagctcagcaacgaccgtgggctgatgtgattgctgatgtgatgagggaacagtttgggcttaaaccaaaagagactggaagcttgtatcggcagccttaccctgagtggtttgagacagttcctcttcccaatcagttcaaagttccggacttctccaaattttcaagacaagatgatgtgtcgacttatgagcacattagccgattcctggctcagtgtggtgaagcatcggctatagacgctctgaaagttaggttattctggttatctctgtctggatcggcttttacttggttttcctctttgccatatggttcgatcaatagttgggccgatttggagaagcaattccacagctatttctatagtggggttcatgagatgaaatgatctgacttgacggcgattaagcagcgcatgatgaacctgtgcacgagtatattcagagattcagggagatgaggaacaaatgcttcagcttgagtttaactgatgcccagttagccgatctggcctttcagggtatgattgctctgattagggagaagttctcatctgaagactttgatagcttgtcacatctgatacagaaagtaaccctgcatgagcataggtctgcggaagttaggaagaactctaagagagttaatcatgtttgtccatacatgtataggtaggatgataatgaggatgattctgaaatagctgcggccgaatgggtaaggagtaaaaaggtcataccatgccaatgggtgaaaagttctggaaaagaagagaaatacgattttgatattactaaagctgacaagatctttgatctgctactccgagagaagcaaattcaacttcctgctggaaatacaatcccatcggccgaggagttaggcaaaaagaggtattgcaaatggcataattttgggtctcattctactaacgattgcaaggtttttagacatcagatccaggtggccattgaggggggcaagattaagtttgatgattccaaaaaaccgatgaaggtcgatggtaatccttttcctgttaatatggtgcatacagctggccagacagccgataggacccgcgcaaggggttttcaagtgaattcggctaagattatcaacaaatatcagaggaaatatgacaagcagcaagagaagcattatgaagaatacgatgatggttttgatcctcattggggttgtgaattttttagattctgctggaatgaaggcatgaggttgccatctattgaaaactgccctgggtgcagtgatattgtcgagagctcaagccgatcatataataggggtaatcggctaaggcagacaagggtttttgttcatcaaagattaggtcctgtgaatcaagaacatggccaagaagacggtgtggttaggaagaatcaatggtgtccttctggtattttcacgaagaatcagaagagaagggttcaaagattgaggaacagagaacgccttcaggaggttgaacaagaaattaatcatcggctgaggaaagcaaaaccgaggcaggagtggcgtgttaagaatcaggttcctctagccgatgatgttgcagccgatgaggcaaaaaggttggcaaaagggaagagtgttgtgacggcacccattaacatggtctttaccttgccagccgaattcgggatcgatcaagtcgatgtcgacgaggtggaagaggaatcggctaagttggttctttcaccggaaccagcaattgttcgagaaaccctgaggggacagataattcgcatctttaaccattggttataaaccgctatgtcaatg

SEQ ID NO: 24683 - DNA, 1008 bp, Oryza sativa
  unsure (1)..(1008): unsure at all n locations
ccgctcccccttagaatctacgtctnnnnnnnnnnnnnnnnnnnnnnnnnnnnnnnnnnnnnnnnnnnnnnnnnnnnnnaagggttcttacaccttgttgcttggaagagattggattcacgccaattgttgcattccttcgacaatgcatcaatgtttgattcaatggcaaggcgacaagatagagatcgtgccagccgacaggtcagttaatgttgccagtgctaatttagccctttgggatatggatggccttgattgtttatctggaaaagtctgggatggagattttctaaaagtatccgattctgatatacagccaattaaagatggagaacccaagctattattttgagggtgtcgtggagggtttagatgtctacactaagcatacagtagatgatctcgatgacaagcaaggtcaaggtttcatgtcagccgatgatttggaagaaatagacataggtccaggcgatcggccaaggccgacatttattagtaaaaacttatctctggagtttagaaccaagctgatagagctcttaaaagagtttagagattgcttcgctctggagtattatgagatgcctggactcagccgatcaattgttgaacatcggctacctatcaaaccaggggttaggccacgccagcaacctccgaggagatgtaaagccgatatgcttgaacctgcaaagctgagattaaacgattgtatgatgctggttttattcgtccttgctgatacgctgaatgggtttctagtatagttccagttattaagaagaatggcaaggtcagggtttgcattgattttcgagatctgaataaggccactccgaaagatgagtacccaatgccagtagccgatcaattagttgatgctgcttcgggacataagattttgagttttatggatggaaacgnnnnnnnnnnnnnnnnnnnnnnnnnnnnnnnnnnnnnnnnnnnnnnnnnnnnnggccaaaggggtaatcagtccgcgcccnn

SEQ ID NO: 24684 - DNA, 1134 bp, Oryza sativa
  unsure (1)..(1134): unsure at all n locations
ttaaggtctacatcgatgatgtgatggttaagtctaaagaaataagggcccccatagccgatttaggaaaggttttttaaaagaacaagaaaatatggcctaaagatgaatctgacgaaatgtgctttgggtgtatcggctggcccagtttttggnatttcttgttcttgaaagggggattgaggtaactcaaaggagtgttaatgcgatcaagaagattcagcctccggagaataagacagaattataggagatgatcggcaaggtaaattttgttaggaggtttatttctaatttgtttggaaggttagaaccttttacaccattgttgagattgaaagccgatcagcaatttactttgggggcagagcagcaaaaggctttggatgatattaaggatatcttagctctactcctggtttgattcctccacagaaaggaataccgtttaggttatatttatcggccggtgagaagtcaatcgtctcagtcttcattccggagttggaagggaaggaacgagtcgtattttatcttagtcgtcggctcttggatgctaaaactcggtactcccctgttgagaagttatgcttgtgtctgtatttttcgtgtacaaggttgaggcattatctactatctaacgagtgtactgttatatgtaaagccgacgtagtcagatacatactatcggctccaatattgaaaggaagagttgggaagtggatattttccttaaccgaatttgatcttcggtatgagtctccaaaggcaatttagggacaagctatagccaattttattgtggaacatcgtgatgattcaatcggctcggttgaaatagtaccgtggactttattctttgatggatcggtgtgtactcatggctgtggtatcggcttagtaataatctcccctaggggggcatgtttatagtttgcttatactattaaaccgtatgcgactaataatcaagctgagtatgaggcagtgctcaaggggttgcaactactcagggaagttgaagccgataccattgaaatcatgggggattctctgttagtaatcagtcaattggnnnnnnnnnnnnnnnnnnnnnnnnnnnnnnnnnnnnnnncgagggcgntatagtcgcgt

SEQ ID NO: 24685 - DNA, 726 bp, Oryza sativa
  unsure (1)..(726): unsure at all n locations
naaagagtttgaagcgtttgcctggggtgaaaccaatggtgttcgttctgtatcgctacttcgggctgcagcctcatcaacgtcatcttcaattatttcttcatccagagcttgttcactggatggatctagagcaggtagatcatcagctggtgtagtcttctttgtcttagctgtcttagccggggctgaaatatttacagtcgatgatttgttgtttcttttcttgccagcatcggctggttctctgataagcccttgaagaagagctgaagtcttgggggcattatagccgatgatggggggagatggcccacctccgttggggatcagtcctggggcatactcgatatccctgacgttgttgctttggtgagggggcgaagattctgttgtctgcaaatcaggagaaaggttagctaaggactaatcgaccaagtagttgttcaaataaaatcaagtgagttaggacttacttgagggacaatatttggaaagagatctgtcataaacatggaagccgattggtggaataagtgtagcttccattcaccccaccatctgtcaaatgttttgctcctaaaggttgccagctttatggtgtcaatgctacctagaggaggtccttggagattgagcagccgatccatcattaaagannnnnnnnnnnnnnnnnnnnnnnnnnnnnnnnnnnnnnnnnnnnngcagtctctatttnngacgcct

SEQ ID NO: 24686 - DNA, 732 bp, Oryza sativa
  unsure (1)..(732): unsure at all n locations
cacgcggttgtcatctgcctccacctccnnnnnnnnnnnnnnnnnnnnnnnnnnnnnnnnnntaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaagattagattttgtttaacttttaaatttccaacgtaccattagtttatattattagaataaggttgtaaaatttaacagaaatttatggtatgatggtatagtttgaggcaaatacatgtataccgtataggatgatatttattacattctaaatgtatcgcgtggaaacggtataaatccaactccatctatctagtttattttgtgagagccgtttacccaactcaacttccactanaggtggatc

SEQ ID NO: 24687 - DNA, 818 bp, Oryza sativa
tgtagacgcccaacaacggtggtgtgaccaaccaaccatataggcgaagacaccactcggcggcgacggaggcaggccggcggtgaagtcgtagacgcccaacagcggcggcataataggccagccgtgtaggcggaggcaccaatcggcggcgacgaaggcaggccggcggtgaagtcgtagacgcccaacagcggcggcataacaggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcgtaaacaccagtcggcggcggacgagacggccggtcggtgaagacgtagacgcccaacaacggtggtgtgaccaaccaaccatataggcgaagacaccagtcggcggcgacggaggcaggccggcggtgaagtcgtagacgcccaacagcggcggcataataagccagccgtgcaggcggaaacaccagtcggcggcggacgagacggccggtcggtgaagatgtaaacgcccaacaacggtggtgtgaccaaccaaccatataggcgaagacaccactcggcggcgaccgaggcaggcccgcggtgaagtcgtaaacgcccaacagcggcggcataataggccaagcgtgtatgcggaggcaccaaatcgcggcgaccaaggcaggcccgccgtgaagttctatacgcccaacagc

SEQ ID NO: 24688 - DNA, 63529 bp, Oryza sativa
  unsure (1)..(63529): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccatgaatcccttttatgcatatctggatctggatcctgcagaacaaacatatcggatgagtagtatctgatataaatataatactcgagaaaaaatcaagtattttaaaatatttataaatatgtatttctcctcttatcaattgtgatttccccgagcagatgactctgtacatttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaaaaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgcaggcgtaaacaccagtcggcggcggacgagacggccggtcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcgtaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatgttggttggatcgtgcatgtatgttgatcagttgaatcaactcatgcagtgttttctcctggtaaactgtgcccagcgatggccaccacatgtccgccggcaaagcacgaagaaagtctcgatgcgtgagggcgtcgtcgacagcttcggcttgatctccgccgaccgacacaagatcgacacaggaaaatataccagaagattgatctatgatagaaaaaaaattaatctaataaaaaatagattggaacgacaaacccggtccaaagttcgagccatcgaattcggtgagattgatctcgccgtttcttctgaagtggattccatctcacttttcgacgggtaattcgacgcatcccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacagatatatttactagtaactttctgacaacaaagtccatggaaatgaacgtctatatatacttccatagattcaccgttcaattgagctcagtttggaagcacaaccttttgggactaatattgggcctttttcactaacaacagagaagcaaatcaggcccatatctgggcttgcaccgatcgtgggtgtgacggatcagagcgacccagtgatgggcctttttagtacccagggcccagtgttcgtctcaagaagagagctgaggcccatatttgagtttgagcttttagtaccacctcggagacgcagagctgaggcgcgcaaggcgctctgtatataagcaggcagggttgcacggagcaactcatacctttctcggccttttggctaagatcaagtgtagtatctgttcttatcagtttaatatctgatatatgggctatgtgcccacttcgatattaaatttattttttgtgggggagggtccactacagtggcttgccgctggggccctcacgcgtcgcccaggtgttgcactgctgcccgggcctggcgcaccccaaccaaaccaacgattaatttttaagtatgcagttgcgctgatagctagacggagtatcgatgcctgatgtgttcgtttgtgtgagatagggtgagaaaatacctcgttttccgcgcgcacgttttccaaactactatgcgtttttttaaaaattttctataggaaagttgctttaaaaaatcatattaatccatttttaaaatttaaaatagtttatactcaattaatcatgcgctaatggctcatctcgttttacatatcttctcaatcctctatatctcaaactcacccttagtgttcttgtatatagatgatatccaatttgatgttgatgtgtttaaagtttgatttcttcttggctaggctctgaattatgatcctctgcgccttttacattcacatcttcctgcaggaagagttgtcactgatgttcggtgtcgctaatttgctactacctccgtctcaaaataagtgcagccgtggatatccgtactcaacgtttgaccgttcgtcttatttgaaaaatttatgaaaaaaattaaaaatatataatcacacataaagcattatttatgttttatcatctaatagtaataaaaatactaatcataaaaaattttcaaataagacgaacggtcaaatgttgaacatgaatagtgcaaaactgcactaattttgggacggagggagtatgaaattggtgatccatgaatgttcggtgtcgctaatttgctatgaaattggtggtccatgaacacaaactctgcaagagttcggatagctctcgtcgtaaattcgctattatgaaattggtcacggacctgttgatctgtgaacaaaaactctgcaagagtgtcagaattcggatactatccaactctcatgattgatcagaatgtcagcgctcgctctacggttcagataccatcgatgacatcgtcagagttcagatacctgtccaaactatgaaaagtgtcgtcagactttagtgctctggagttcagataactctccaatttctgccgaaacactgtaaactcgacgtgatctgcacacacatttaacacttcaactccatgcgatctgcagggagagacatttaggttcggtactgcactgtatactaggaaattgcctcgcaaaataggaataaatacagtgccattcaaatttacatcctgaaacccagaatataaatggaatccatatttgcatttacaattccctccatgggaccttattgttcattacagaagggttttacatgtgtaacaacaaaatacaaatgcctactacacttactcaaataaacaatttcatactgaattctcagagcccttgtattttcttgttttttttttctccctgttgctctctgtttcccatcacaacagacaaatccgagtatttgtatctcgattataggtaagcacgttttggaacgggataaatcagaggcaggtgactcttctgctgcatgcataagaccgcctcatgcaaactcttcctcagtggagtgaattccaaccccaaatccttgagcctctggttcgagaacttgtacggcttcgccatcggcttcccgtcatcttcacacctgaaaaatccaagaaacacacgcatgaaaaatttgagatcgatcgattacatctcagaagactatttcagcaacgcacacaagcaaatcaatgtctaatagttgcgtactttgcagtggcagggtactgggggaagaggtccctgagcatccggaggagctcggcgcggtggagcacggtgccgatgcagaggtagcggccgcgtgcgtcggggcgctcgtagacgaggacgtgcgcgcgggcgacgtcgcggacgtcgacgtaggcggcgacggcgttggggtacgacttcttggtgcccatgaggtagcgggcgacgtggttgctgctgaagttgagcgtctgctgcagcatgggacccatcgtcatcgacggcaccaccaccgccagctccagccccctcttcgccgcctcctccgtcgccgtcatctctgccatcatcttggcgcagcagtacaggttctgcacgtacgacgagaaaattttgccgagatgatcaatttactgttcatgcaagcaacgcggttggagttggtagaaacgcagcagagtaatgtgcttacgtcggtttggcggcagaattcgtagtcgctccagcaggtctcgtcgaggacggcgtcggggctcctgctggggttcatgtgcacggcgccgtaggacgacgtgaacaccacgcgccgcacgcccatgtccgccgccgcgttgatcacgttcctcgtcccctccactgcaaccggaaccaggtcctgcagcacggagcagcgttagtaaaagttggaggaggttaaaggcgccattgtcgtctcttttgggctcaagaaccaggctagtgaacttacagggtcgttggacaccggggaggcgacatggaagacgccgtggcacccgctgaaggcggcgcggaggctggcggcgtcgaggacgtcggcacggcagagggagagcctctggtcggctccctccagctcaagcaggtgagcattcttgctgtcagctacagatacgcgcgtgcaagaaccgatcaataaatcaagcacaaaatgcagcaaattaatggtaacaccgtgaactactagttagtaacttaccaggatctctggctgttcccctgacgtggtagccacggatgaggagctccttcaccacccacgacccaatgaagccacctgctccggtcacacagaccagctgcttctcgccattgttgttgttggcctcaaaattggacgacatggtgagagacactgaccagttactgtcactagccaaatgctactctgaacttgtgagagaactttcactcgaactctgaatgttggttgtgtgagtctgccgtgtatggacatggccgctatttatacgcgagctgcgagcacctgcgccgccatgccacggagcacgaggaggacgacgacaagaggaagattgctagcgtagggtggtcatcgggtgaggggtgggggaggcgcaactgcgaccacgcgaaacggaatgccgtcgccttgtcgtccatttttgaggattcagcggcgcgcgcgcaaaaactgggcagcacaaggccgaattgccgatgggttgggcgtgcgcgtgggctcatctcacgggcgcgtacgagcagtagagtatattccattgcctttctggacgagaggatcacgaagccaactctggcacgtaaaccgtgcgaggttttcgctgaacctggcgaatcttctactgtactaggatgcaacttgtactaaacaattgcatctgctgctggaacgaccgacgattcgagtcagactggtacgatcgactaatgtctttttgaaaccttgacggaaatagtactatagtagtacgttcgagtgaatttgacgattttttacgctaagtcttatttagttcctaatttttttctttaaactttcaactttttcatcacatcaaaacttacctacacacaaactttcaacttttccatcacatcgtttcaattttaactaaacttttaattttagcgtgagctacacatgctaattatgattgtcttagagatacgagagaaaaccaatgaacaatggcaaattcggtatattgtggttacaagttccgcgattacaatttccaaaggtaagtaaaataccgacgtagtgcaaaatacgatactactaactgaaataggagaaaactggcacaaatcaacaacagtttatgacataattaatggaacgtgaaaatagcatataagaccgtaaaacaaacatatttatattaagatgctttgtttacttagaacacttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaacttcactccagagttggagctgtgacaaacaggcccttaagctgaatccgccgtgctcaagtatcaaaactggagtacttaagtggactaaaccaaccgaagaattcagtcgggcgttgaaactaagatccggcgcgtgttggctgcacgactcgcggcttttgaaaccgaacggcacggcacggtcggagttaacagaacccacctggtatctgtttacgggaagccccatgtttgagactccaagggaggaggtgagcttggcaacgccaacctttttgacggctcgtgtcggctgctgcctgcttgcgtcacccggtgggcgagcgccagccgatcgggagcaactctaagagcaagtttaacagtatagcccactacaagctccaatttatctatagtcaatttaatagccaattcatataatagttgcttactatactattaatatatggtcccatctgtcatacacacaccgtctcttggagtctatgctgcagctacctacagatttgtagcccgctgcttttctctttcatcttttatatcattaaaatatgtttatagctagctaatagtctgctattgtacctgctctaatcccaacttcacccccaataccggctgaaccgacgggggcttatattcattctcttttcttttttttttaacttttaactcagatttacaaatttttaagttaagatttgaaaatttttaagttaaaaaatttaaaactttcaactcatatttaaaaactttcaagtgaaatcattaatatttaactcaaagacttaaaatttttaactaagatttaaaagctttcaactcagatttgaaaaaaaatccaagtgaaaatttgaaaacagtcaactcaggtttacaaactttcatctcaaaattcaaaacatttaactcaaatttaaaactttcaaccgaaattaaagatgaaagattcatttctttttttaaaaaaaaggtgaaagaaaaagtcccacgagggcgcagacccacgggtcacacaggtgtgtgcgccagcaagcgagttggcgtgtctccgccagttagtttttgtgttgtaccggtgcttgtattcacgctactcggttaagttatgcacttacgcgtacataagaaggaagtcgctgacacgtggttctcatttgttaacgagacaaccatggttaactggccacgtcaacaaaaaaatcattttcaaaaacaccgaagtagtttatttgtatcagtttttaaagatggaggagacgtgctatatcccgttctgtagccaagggagatattcattcaggatcaagaggacgagggagatcaaatagacttattcaaagagtgtggagtacataatacgtggggatttcattccagcccaattcgttgcaaacgtcctttgtacctatccggcccaactcaccaccgtcggctacggagacgacccggttctcctccgatgctactgctgccggagccggactcccaaaaccctcgccccatctccgcttggctttgagaccgctcatcgcggctgcagcagcgtcggcaggatccaccgccttgccgtcttcgatctacccggacgctcggcctccggcgacgactttaggcatgtccagcgccgtcacgggcctcgtccattaccatggtacgtcgtcgattcctcgtccactttgaccttctcactccctcccctttgccgctcgtccggctcaactaggccgcggtggcttccaatgttaggtagttgggaggaactgtgttgcagcctggcttgatgcagactaactgcttgctgtcttccgcatttcttgttgtttggagcataagtctcaaattattttcggtgatgatgtgatgaacaatccacaaacgtacatgccacctcttttggagcataagtaagcaagttatgggcttctaaactaatcatagtggtgttgaacttttgatggtcttccagccaattgatggatgttgagcaatcgtcgacaatggaattttgtgcttctataggtgtttgttttttttttttaaagaaacgcttccataggtgttgaggatgaagttttcacataaaaaaacaaactcaccgtagttaggcctgaccaactctaaaatttctcgggtctgctactattccagcccatgccattcaattgaaggcctaacactgaattttatccctgtttagcaccatcgtttaaatttgagaaccaattgattgctaattaaatggatcagagtttcataaactactctactcgaatatgtacacaataaatgtcatgcctacttcacctgcagtacaattgtactgcattttttcggagttactacctccgtttcacaatgtaagtcattctagcatttcccatatttatatgtaagtcattctagcatttcccatatttatattgatgttaatgaatatatatatatatatatatatatatatatatatatatatatatatatatatatatatatatgaatatgggaaatactagaatgacttacattgtaaaacggaggaagtagtcatcttgtcttattattgtaatctgtgatgccaatgccctcaatgcaaatttttagaagatgatatcgcatttataaaatctgaggcctctcagcttaatgttttattctaaaccaaagctggcgtgtgcaaaatggaacttgccgctaacttaagccttttatatccctagattcatgcagaggtgctagtgggaggagatagatattttacctgcttaatttacctgaagaactcaaggccaagatcaagacactgaaggatgctgacaaaaggtgttggttgaaagatttattggtttatcactatggccttgttaacagtgaaatttggtaagtccggagtagtcatcggtttagagtcagcatcggcttcgaagtcctgagattagccgatgagagttgtcaagtcatcagttgtcggattcttgctatattcggttaaggaaattgatctactaaataaaacttatccagaagagaccgagtttaaagagaatgcggcatgacaagttatctattaattaggaatagtttgttagtttccttttatctttaggaaattgtgtttagtgtctgacggagcgtggggctccttaccgggagaccgcgctggcccccctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcgctggggacttaccctaccttttcataaatggacggagatttgcatggttgccgtccgagtcaccttctgatgggacggcccacaactacctccactttcgccggaagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccaacgtcccccgagggtgccaggccacgttggcgattatgtctgcctcaaacctctagtcatgatactcccgatcccatgtcaccgacagtagccctcggcgttatgccagggcgttcgccctccttaagggaagcggtcgggcgtgacgccactcctaaggcccggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggttggcgagcgtaattaacgcgcgcacgatatgatctacctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagggtataaaggcactgaggaagggatttgtttccttcctttcgccattattccccttgtcttcgccgcttgcgccctaactccttctttcctgcgccctaccctcgccacacgcgctcgctcttaatcttctcttcctccggcgtcatggcacggggctccgctctgctcgatggtagcgtgctgccgccttcccgcatcgtgagcgagaggcaggctgggctgccgcgccgcttcatgccggaatctgccaccggccgggagatagttacgctgggcgagggacgcccggcgccagactacccggggcggtccgtcttctttctcccctttgcaatggcagggctagttccgccattttcttctttcttcatggatgttctggagttctacgatctccagatggcgcacctcacccccaacgcggtgatgacattggccatcttcgcgcatctgtgcgagatgtttattggggtgcgcccatctcttcggctgttccggtggttcttcactgtgcagtcggtgtcgccgccatcggtagttggtggctgctacttccagccacgggggccggtgctgaaccgctacatcccctgcgccctccgcaagaagtgggacgactggaagagcgactggttctacactcccctcgccgacgaagcgcgcctcctacttccgagccagcccccggtgcaggcctccagctggcgggcgccggtagatctgggggatggctatgacgccgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagacttcatgaggacccaccagggagtgtgatgggactgggctcctgaggacttcaagatattggtccaacgggtgctgaatctcaactccgtggaggcggccctcattccccaaggaatcctccccctctgcagcgatccagaccgcgcctccatcctgaccattatgatggcggtcggggcctcagaggagcgagctccaaagggccacgacggcgcaggcgggagccgccggggggaacaatctaccccgagagggggtcgtgcttctgggtcccgcgacaggggtccggggagcagccgccctgccaacacccgggggaagaggaagcagggaggaacacctcccccatctcctccccgagggggcggggcggcgcgtgccagcagcaggcgcccggagggggccgcgccaacatcgcagcccgagggggagcgcatgaagaagcggccccgcaagatgggggagacggaaccatctcggggaaacctcatttcccctccaaagtggtcgtttaaccgaccccctcgcaggttcgtctctcacccatcgtggctgtattcattctctcaacgcgagtttttactcacccatcttgttcgtcttctggtcttttcttttgttttagcgagatcccgtcgcgtccctcccgccattccaagtccggccagtctgaggccgaggatccggcggccgcagaggcccggaggcgggaatctgaccggcgagaggccgcagatcgcctacgggaagccgaggaggccgcccaggaggccgcccgggctcgccaggccgaggaaactgcttgggagggagccgcccgggcccgccaggccgaggaagctgctcgggaggaggccgcccgagcccaccaggccgaggaagccgctcgggaggaggctgtccgagcccacaaggccaaggaagccgctcgggaggaagccggatttcgccaggacgaggcgatggcgacttccgaggcagctcgcgacgaggccgcgggcgcgtcgctcgggcccactccctcgggcgacgctcaggcgacaacttccggggcagctggcgacgaggctgcgggcgtgtcgcttgggcccactccctcgggcgacgctcaggcgacaacttccggggcagctggcgacgaggctgcgggcgcgtcgcttgggcccactccctcgggcgacgctcaggaccaaacgggtccgggagacatccccgagtccggcacttccatcggcggcccgagccgcgtggcatcctttccaaggcggctcttccccacgccttctatcgccccactgaacacagagccccttctgcaggctttgaccgccgcaaacaccacgatgttggatgggttaagtgcctaggtggaggccctgcaggcagagcgggcggagctcgacgccgcgtgggcgcgtgtcgaagaggggcgacgctcggtggaggccatggtggaggtgggccgtaaggctcaccgccggcatgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaagtggagctagggaagaagctcgacgccgcccagggggtgcttgacgctgccgctgcccgagaacagcgggcggcagagaccgaagcggcgtcatggcggcgcgaagaggcccttgaggcgcgcgccatggcgctggaagagcacgcctgcgtcgtggagagggatctggcggaccgcgaggccgctgtcaccatccgggaagcaacgctggcggcgcacgaggctgcctgcgccgaagaagagatcgcgctccgcctccgcgaggacgcgctcaccgagcgggagcgagctctcgagggggccgaggccgcggcgcaacagctggcggacagcctgtccctccgcgaggcagcgcaggaggagcaggcgcgccgcaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagatgccgaacacaccatcgccgatctgcagggcgcgctggactcgtccgccggggaggtcgaagccctccgcttggcaggcgaggtcgggcccggcatgctttgggacgccgtctcccgcctagatcgcgccggtcggcaagtgggcctctggagagggcggaccgtaaagtacgccgacaaccagggaggcctcgcccagcacctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaagtccgggatgccgccgactatatcgtcgacagcttcgagggctcggcccctcggcttgcgtttgcccccaactccgacgaggagggcaatgccggaggtgcagacgacaatgacgtcgaggccggctatccgggcgcatcggattgagcccccagacccccgccatccttctgttttttcttcttttctttcttctaaggccttcgggctttgtatagatcaacttaatctgtaatcaaaaatgaagaaatttttgtgttaatttcatcttgctgtaagtatgagatgaggatgatctgtgccgtggtccttttgtgtcttagcttgaataagggctcgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcgcgagtgacctatttcaagtcaagattcttcaaaaggaaaaaacagcacagatacaacctttaggaaattgaaactgcttttattgaaattctgaaataagagaaataagaaagtgcatgtgtggcagcccccggccaaccctgctcgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacactgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcagatgggagaaccacttccgcgccgtagacgaggaagaaaggtgtttccccggttgctcggcttggtgtagttcggtttgcccagagcaccgctggcaactcctcgatccatgaatcgccgtgcttcttgagtatgttaaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttatcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggcggaccaggtcgaccgcatcattgagagctgtcggccaatagaaaccttggcgaaaagctttaccaaccaaggtgcgcgaggcggagtgggccccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccctcgcggtcctcgggtagagtcttatttctgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggatgcgagccgtgagagttcgtcggccatgacgttatcccgtctgggcacgtgccgaagctcaatcccgtcaaaatggcgctccatacgccgtacttggcgcacgtaggcgtccatttgcgggtcagagcaccggtactccttaccgacttggttaacgaccagctgggagtcgcctaacaccaggaggcggcggatccccagtccagctgccactctgagtccggcaaggagtccctcgtactctgccatattattggtcgctcgaaagtcgaggcgaaccaagtatctgaggacgtctccactcggagaggtcaacgtgacccctgcaccggcgcccagaatgaccgacgtgactggtctgactccggtcatgtcgtcagcaggcggccacaattccacgacgcgtctgctcctggcgaaagtggaggtagttgtgggccgtcccatcagaaggtgactcggacggcaaccatgcaaatctccgtccatttatgaaaaggtagggtaagtccccagtgagaaggggggatggtgcatgtggtatccccttaagatataaaaggaggaccttgcccactgagagagggggagagctttttcttggactggacctttccagattaggaacccagaacaagggagaggctggctgatactttgtagctctttcatacacagatctcccaaaacacaggagtagggtattacgcttctcagcggcattccgttcggctcgggggcctcttctccctgctctctcctgggtcgaatcggcacagggttagcctcggggtcagagggcgataggtgcggccttcccgcagtggcctcggggctgtcctgggagtcgggggcacctgacaccgtctgacaagcggggagagggcctgctccggtcgtcgggggccttaggccaccgtccggctcgggggcctcttctccctgctctctcccgggccaagtctgcacaaggtgggggtgcgcggaatgaggattgtcctcatcgcgctccacgaccaacgccgcactaaccacttgcggggtcgccgctaagtagagtagcaagggttcatttggctccggggcgaccagaactggggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatacaaccggtgacgcattgcacatccctaagcttgctgggggggcgcatccgctctatagctcgtatcttctcggggttggcctcgatgcctcgggcagagaccaagaacccgagaagcttgcccgcaggtacaccgaacacgcacttatctgggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgaattctttaacccgaagggcatcgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgtgaagacgtcagcgtttgcccgcaggaaagagacgagcgcgccttcctatttgccgtccagaagaccaccaatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctctccaggaccgcgttgtagggcagactgaggtccgccacatcgaagttcacccgctccgtgcggaaattggcgggtccaccgaaggtgaccgggaggtcgatatgacctagcggccaagtgtgccccggcgtcactccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtcggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttcttcctcctcctgtcacgccgccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgagccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccccgcgtccgtgttgaggtgacactctagacgaggaagcgccctccgttgcgtgggcagcacgtcggtcattacgccggcgctcgatgctggcgcgggcgtccggccccccacgcagatcttcccgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagtatctaggcgctgccgtgcagtcatgaccaatttggccacatcgtccagccaacgttgggctggagactccgggtcatgggcgacaggcgggtgacacaggagcgcacccgcagcttggagcgcgccctggggcgtgctgccgtcgccgtagacgaggaggcgacggtccccatctcgccgcccctttccacctcctgtggatgtcgaagtcgcggatccttcggccctctcgagcgcctccccctgcttaggactttggcgtggagggggcggtggagtacgagctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcattggggacttaccctaccttttcataaatggacggagatttgcatggttgccgtccgagtcaccttctgatgggacggcccacaactacctccactttcgccgggagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccgacgtcccccgagggtgccaggccacgtgggcgattgtatctgcctcaaacctctagtcatgatactcccgatcccatgtcaccgacagtgtcctataaggactttatcttttccttttatctttaggaaagtttctttcttgtccgacaaggacttgtatcaacccataggtataaatatgtacacccagggtctatgtaatctatcttcacgatcaatacaattcggcgcatcgccaccttttaccttttctactttattttatcgtccgacgggacttggcacctgacgtagggctgcatcggtgttcgatctccggcgaaggggtaagtccaatgttccgtcggcccaggcaattgtatcgtttacgtcggtgtcgttcaaggctgcatcagtgcattcgacctcttggattgctctggtttggatgatatatttgcctacctatttatcatatgtttatgttaatctagtcttagcatatcaatttagctctatcggctgcttctcgttttagggtttctgccggtatcggctaaatcgtgttgctaggttagattagcttagatatctaccaccctgaaaactcagtcaacggcttgattgtctagatattatgtttcttttcatacttagtgctgcatcagttgagtttgatctactaagtcgtgcttagaaccataatccctagcctgcttcttgattgccaataagggtttcatcggggtttcagccggtgagttatctggacgttgcatcggcttataaggatagcgtatacatataagttggatttagccgatgacaacaaaggtttcactgttcaatctaatcttgtggatttcatgacatcggacctccagctgatgtgtgctttaaccttcggatcgatgcttatttatcatataattatttgccgattggtttatattggattatattgttattttattacaccatcatcagccgattgcctttatatcattggacatatagccgattgctaaaaccctatcgctatcggctggtatcggcatcggctgagattgctccatcagcttgtcagccaatcggctattttgatatactatttgcatatcttatcagttgcaggatcaaactgactggcacgcccgcatctcaacaacctttggacctgcactggagctaagcagatctcccaggccggtgtgttcgattttttcgtcaacaggcccatgatgggaggcttgaattaggcatctgtcaaggaagttcattgcacacctctccaatttaaaggtacgtaaagaaatatttgtggaatatacgtgtgtgttttatgtttaatgcgccatgaatgcacaacttaccttcttatttagtcatatttaacttgactatctcattaaatatgtttattctagtggctgataaatctgaaatacatagagatggttttcaaatcccttatgttcttatttaaatgtatctattctagccttctacaaatggtcaggatttgtctttataccatgtctctttcaccttttttcttcaagaaagaatgtacatgtgccatttaacgttacacagttacatatcgtttgttggaatcacacaaggatcgttggaacacacacgaacgcgagagcaagtggcagagcttgaaatgcttgacaatggcaacaaatgccgccttttttgtatttaactcggtggccaacaatacgatgaacatgtgcttttataggcccagcgcgacgcacaacggagcacgaactccatccccgacctttgctcgcactacccgcacgacccggctccatgcgacgaacgcgttaacaacaaacacacacacacgacgcacgcgcggactgacctgacacacaaggtcaggtttatttcctaacatcgttggtctatatcattttgtgatttcctgcaatcttattacatcccacatgaatttctacatggttctttcattgcaatttattatgcatgggagctatattaattgtccaagaaagatttacatgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcggggtccaagtacccgcaagttccctgcaccaacgttgcaatctcggcctcatcagttggtgctagctttgatgccccaaaatcagaaactttggcgttaaacttgtcatcaagcaagatgtttgccgtcttgacatctccatggaggattgggggtgaagccgatgagtgcatgtaggagagtgcctcggctgactctgccgctatccgaagacgagtatcaagtggtatgtcagctttgggttccttgccatggatgtagtggtagagggtgccatttgagacgaattcatagaccaacatgggcacttcaacttcgaggcagcaaccaagcagcttgacgacattccgatggttgatttgggagaggatgaacatttctctcgcaaactccttggtctcggcctcctccatcatcttcgacttcttgatggccactactgtcttgtcttcgaggacgcccttatagacaacaccgtgaccaccacgacccagaacacggtcagaggcgaagttgtgggtcgccctcttgagttcttctgtcgagaatatcctgaacccatgggtgcctccgccggagtgcatctgctgccggaggatcactccaccgttatgctcgaagaacttctgcttcgttctgatgagcttcctcttctggagccccaagtagagccagaagcacatgaacactgacaagaagacaccgacgctaacccctgaacacgacgccattgtatacccaatattactccgttagatttccatttttgagactgaatgtaatttttcatgatggacgacagttataattttttttacctgtaactactttaagagctaaagggaagttgtcctttgggcggcaaccgttcctgtcggtccaatttccactagtcccaggagggcacacgcaagtgtgacttcctaacatgtttgtgcagtctccgtagcatccgtacttttccggacgtaagcactcgttgatatcttccattcacaaagcaattaatttcgtcatatttgatcatcagccaaattaatctatggaaattaattgacagagttaattaagatgactgctacctgtgcatccaccgtcgaggtaggggttgccctcgtagccctggcagcagttgcaccggtagccctggccgtcgatggtgtcgaagcactcactgttcgtgctccggcacgcgtagtccgtcgcgttgcgcttggcggcgctgcagttgtagacgttccggattgcccagtcgagcacgacgggcacggcctcgaagtcgctccggttgaaatccttcgtgtcgttgtacacggtgttgatccaggtgtgctccaccaggaacacgtacctgcacggcgtcgtgccgccgcggagctcgttgtccaccgccgccgtcccgttctcgaagttgaacatccgcggcacgtagaagttgagggtaggtggtatgatgctctggcagcaccgctcgccggtgcaccgccccggcaaccgcggcactgtatcattgcccagcgacgggcggcggcacgcggacatgcagccgctgacgtagttgccggagccgtcgacgatgtagccgaggttggggcagccgagcgcgacgaggcggttcttctccggcgagtagcggtaggtggtgctgccgttgatggacgtgtacgagaaggtggggacgtcggaggacctctcttctggaggagggtagcacttgctttccggtttgaggaggacccgggcctcgccatcggccagggacaggctgacgagctgcgggtgttgctcgaactgaagcgtgagtaggcgcggtggcgacgcgctgtcgtcgcagttgagctggaagccttcatcgcgggcgcagcgggcgccgatgccgaaggggtagggaacgttgatgtttccgcacttgtcgcggcagcctgtcagctgctgagccgacgctgctggtgtcaccggcgaaaggcgacagatgagcaagactgctgctaatgcaatcgcctgcaggtgcagggtattggtagccatttctgaaatggcttgcttaatgtccggatgctacaattttataagagttaattacattagcggtcattaaacttgcaacgaagtttcacttagatccacgaacttgcaaaacacgtatcgagattcttaaacttggtttaatgtatcatcccggtccaaagcctagtttaaccgtggtcttctctatgtgacatgccacgtggacgatgacatagctaaattttttcccttttttttcttcccatcttttttctccttcctcacctcgtgtggagaaaaatactgcggaagggagaggaaggaggcaaagtggagaaaaaaaagataagaagggggaaaaaagagggaagaaggaagaaaaaataaaaaaaattcatgtcatcgttcacgcagcatgtgtcacaccccaatccggcaccgccgtacaacggcacctgataggagcgtgtcgtaggaataacggcgcgaaccgcttcctacgaaaccgcgatctcgttaccagtcccaggacatagtgctggtacccacggtgacaaatatgaatcattgcaaatccttaaaataaatagaggacttatttaccttaacttaggttgcagcttagaacagcccgagaatgcaaccgacgtcacggacgaggaaacaccaacaacagcagcagcagcggaaccaagagcagcccgagaatgcaaccgacgtcacggatgaggaaacaccaacagcagcagcagtggaaccaacggactaacacccaacgccacaggcgacggctgggaaccaggacgaaaccctaatcttcacttcacttcatcttcacttcacgacggaggaactatatatacatatatagagcaagggtgagtactttcgtactcaacaagccacgggaatttaggtgtttaatgcaagcttggaagagaggcaaggttgttttgcaaatcttttatttgaaatccattttgaaaccactaagtgatttatttcttttcaggtttgggtcgaaaagagacttgcgtctcgattcaactttaagagatgtttttcaacaactcaattgataatgaccgacctcccgggtcagatcattacttctcggctcccagagccatttcacttgattaagcggctcccagagccttattcattttctcggactcccagagtccagctgcccagcagcacaacattccgcttccactcgggaagcctagtctatgatgcccgtagacatcccgaatcacacagattcgtttctgaccactcaggccatccatctgccacataggctgattctggttacgattcctatcccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttagttttcacaaatcaaactccaaccacctcgatcggtaattcagcaagcttctctttcttgcttaccaggaacccggtttggctccaatcgaccccgccccggcgttcccaactattggcatgcgaggtttccctgaaccgactagttacttagccagggtgtcccattccaccttgtggttgcactttgttatgcttgatgagtttcccacaggaattggtccttatatgcaaatacgagacagtgccacataggcacggcacccgcatcgcgaattttcacaattcattttattttcaaacacaccgacaccacatgtcgggttttcaaggcttctcaaacccatttcccaaattttcgacaatcgacggtgtatgtggaatatttggtatacgcactcagagagcacgaataccgaagtaccacaaggatggagcgacaaggaatcagggtagtacaacctacaggaattagtgcgactactgggtaggtccgtcggtttgtcacgcaaaccgaggccaagcatgttatatgtgtgtgactctaaaaatgcaagttgcaaacaaaataataatgattttccaattataggagaaattgatcaaagggtgactttccttgctcaaggtcttcacgaagcttcacgaatctacgagaaatccctgatcgacgaaaatccggtaaccgcggctatacgcaaacaatcaaaacctaaacgaaagaccaaaagaaagaccctatttagactaattaatagtgccattaaatatatctcaattttacggcagtaccggaagttgaacggagtcaatcggagctacggattgagagatatgaattttggaagctcgaatgggattttccagactaggaaatgatttatcagaattttctggaatgtaaggaatggtttatggaatttatagaaataatattctcaagaatattattgacattcactgatgtgtgggaccaaaggaattgatttatggaatttcggaataataaggaattgatttatggaaaaggaaatggacgagggatgtatattagactttttcgggcggcaagggcgcagcccgagtgttgaaggaggctcggccgagccatttgggccggcgtgggcgcggggaaggcggcccattagggcgcgcggaagagagagggagcggtccggtggaccgagtgcacctcgcgggtcccaggtggggcccgcttgtcggtgacacggcccacggtgggatgggcgcacgtgagggcggcgctagggttcggtggggatggcgcacgggcggtgcgccggatggaccgagacgcgtcgggcccacgcgcagcctcacggctcgcggtggaccgcgcgcgcgagcgggagacggagggagcggcttaccggggtcagcttgacccggtccggccgagctggcgccgacgtggcgccttcgtggcagccacgcgggccggcgggaggaggaagaaggggaggccgagatggacggcggacggcggcgcggcgagatacttgttgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtgatgttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacgacagatcagtaggcaagtggtttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgatagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccatggaagatgtatgacagggcacatcttagagggttgttccccggtaagacgtcagcgtcatcacatccctaactcctcaagttgtgtcagttccaatgcagagtcgatcagttcagttttgaggaatcaactatgcaactcgacaccgaagtcaagctagaagcaggacagtcatgccagtagttagaacttatgggaaagttagtcaagagtcaatgtgtccctgagctaaatgagagtcacttttatgtggaatctcccatcagcaactgaggattaagttccaaatcttgctgggatgaaagtgcgccgtcattactctattttgatgaatcggtgaagtttcagttttcaaagtgagggcctttgtaagcaagagaagtgttggttatttttcaaggacaatagtccaattgttcctagtcaggagaaagtaagactactccctgtaagggggtaggtctcggagatgagttttggctcacttcgtcgctgttttagttgaaggttcaacccagtgcaacaatccgggtagtacttgaagaagccagttgcaaggtgtcagcagagtcaccccaatctcaggtcgacaggttcgattctaaggtacacctgtgaagcatgtcaacagtttagcttagaaaagcaacagcgaggacagttgtagtacagacgaaaggcaggtcaagcaggttttcctggaattacttgtcatttgaattgggaccagtcgaagcggacatagggtaaatgatttacaaatgccagattcaattttcatcctcttatagccagcgtggtgaattctaccaaaattgccaacctcaacagttcagtccaagataagtaagtttcaggagcatccgcagtcctagtctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctatcctttgtcaaccttgggtaataaattgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgggctgaagacgaagttagaggaccaaggctcagaccccagttgagttttgcctgtggagtggagctgaagccccgctgctgctgcttttgtttcggtgtgaggactaagcgcctcttctgtaagtattttacgctttatttacgtttggaactgtatattacttgtcgttttgtgtaccctggctggtcctggacagggatttaatacacaaaatagtctggaaatttgggctaaatttctgggcgtgacacatattaaaccaagtttagagatctcgatgcacgttttgcaagttcgtggacctaagtgaaacttcgttacaagtttaagtaccgctagtgtaatttactcattttataaatagactatagctggcaggtgaaatatctaggattttttttctcaaaatgaaaatgacgtatctagatttgtacacgctcataattaattaattgattggagatttttctttgggaggggggaggggggttaaaaattgcatgctaggtgctttcgttgaagaggttgtttgtttgagttttgacgcacgcgcttcgtcgacaaataagatgcttagcagggtgtatactattggttgactactaaattttgagttccattgataacacagttttcgacaaatttcgaccggtttttgataaattttgactgaatttcgaccaaatttactgtttacccttcgaaattccaatcgaaaattaattccgagccatgtcaaaacgtcgaaatttcgtagaattcgaccggttttcgttggaattgtgaaccctgatgcttagttttccaataaaagttgcgtgctgggcactgtttgtatcagtcatcaacagatcgatcttatagcacaaaacaatcttatagcacacagcatacagcaacacgaacatcagaataacaaaacaagcacacatacaagacttcctataaagcatacgtacttcacaacccggtgtccacagtcaacggaagaaatcaacctttgagcctttcaaaaccaaactagtctgctctacatcagcctctacagatggacatcaacgaacaatttatatggaaaaactcggcactccccaaggtccaattttttgcttggctactgacaaaggataggctacccacatgcaagaaccttcacaagaaaacaatcatccaattgccgttgtgcgctatttgtcagtctgctgatgaaacttcaagccacctttgcttcctatgcccgtttgtggtcagcttctggaattcaatccacagatatcctggaggcgtgcacactcatgacctgcacttgattgctctaccaaacaatctgccgcaggcacatttcaaaaccttctatctgctttgcctatggagtactctctccgtccttaaaaaaaaaaaagacaaaccctggtttccgtgcccaacgtttgactgtccgtcttatttgaaaaaaatatgaaaaaaattaaaaagacaagtcacgcataaaatattaatcatgttttatcatctaacaacaataaaaatacgaattataaaaaatttcatataagacggacagtcaaagttggatacggaaacccatggtttgtcttttttttttgagacggagggagtatttggaatcaccgacaagaagttgtcttctctgaccagcaatcatccttacatcggcttcttctccgctgtaaggatgagactactctgtggacagaacgacttcttctgcgcgacgatcgcctagttgctataacctggaaatgtattttcaacatcgcaattaattctctacacatgtaatgcgtgccgctggttacgtctgaactctatacttgtaaacctcttcaaatggtaatggaaattcaggtgggaacctctccctcctgtgattattccaaaaaaattgcgtcaaatttttttttacgtaaacaaaaaaacccaaactagtactgtacaaaatcgtacacgcttcgtactagtttctctggtggaaggtcatcagggcctcggttcctttcaaaaggcttattcgtttcaaacgaattgtaaaggaaaagtgcaggactatgcaatcctttgaaatgaacactgtattgacatttgtttcaaagaaatgcaccaaagaaaaaagggaacatatcctaagcacataaaaaaattttcgtgcacaccaactagcaaatgtcacaaaaaattctagaaaaaaaaactaaagatgtactcttaatagtattacacatatctacaaactctcatatttaaatttattatattttagccgtgacaaaaaagacaaaattctgacaaattttatctcttaggccttctttatttaggtttaagttttattggcttagacttttaagtcaacttattggcttatataatttataagccggtggatttaatgtcctaaatttagtggtggagtcatacatctatctcatataagtcaaaaattaaagcttctccaatatagcttttggcttaatagtgttagagtggtttatggcttcaaaaagccaaacgaaaaagctgcttgtttgtttaggcttagattttttggcttataagcctaaactaagagggccttaaaactgtcagattttcacttatttgttacggctaaaatataatgaatttgaatatgagactttgtagatagtgtaatactattaggagtacatctctaattttttctagaattttttttatgatatttgctagttgatgtgcacggagtgtgcatataaagcttgtatgcataggatatgttcctaagaaaaaaatttttatccctccacttttagagggaaaacaaaggaaagaataatccactccaattcaatgttttcaatcctttggattgtttgctacacaaccatagggaagtttcctatgttttcaatccttaggttacacatgtattcccatactattcctccattttccctatttctacgttttgaaaatcctacaaaccaaagaagtctttgcaacaggctttcacttttcctcgctcctcgagttgaattaagcttcatccaacaacatatgtactccctccgtctctaaatatttgacaccgttgacttttttaaacatgttttaccgtttattttattttaaaaaattaagtaatcattaattcttttcctatcatttgattcattgataaatatacttttatgtatacatatagttttacatatttcataaaatttttgaataagatttatggtcaaacatatgcttaaaaaataatgttgtcaaaatatttaggggagagggagtaccatgtaaagcaacgttgctctctggatggattgacggtttcgtggttgaaagatgaaagccagaagattatacaagcgcggtcttcggttagtgcagtaatgcttgtgtccttgtaagctattgtttcgttccaatgtttcagcagcgatgaaaattcgtgttcaccccaaaaatgaaatttttttattgtcctaccgaaaacctaccttgcgtaaattgacatggcaagttgtgttgtgtattgaggactatcggacgaagacaaaatgtagagcaaaggatccgctagattaggttagagaagaccaaacacaaagctgcgttgacgatgacgaccgcacgaactcgcgctataccggccggcccgcaaatgcgggagctcggcccaactactcgcgtacgtacatacgtatacggcccaactagacgcgcacgcaatcccgtcccggcccaactcgagaactgctcggctgccagcccacgtccccgcggcgcacggcgaaattgctcccctcccatgccggaatcccaaaaccctcgccaaaatcgccgcctccgcctattcgcgcggcggcggggacgcagctgcggaagtgcgggggggtcaccgcctcggccgccggcgcgacgacctccacatcctcgtccattgccatggtacggcgtcgccagctccaccttctcccccctctccttcgctgctgtttgcggttaggaacatacaaatgcggaggggccgcggcggtgtccaattttagttaggttttcgaaatttcaatccctggtaggcgcctgtttagtagcactagtcaatagttctgtagattgtgaaattttgaagggaccctgtgttccttacttagtaagggctataattgggctttcgtagaggaagaactgtgttgcagcagcttggtctcttcttttgtgctaccatagggccataggtggttgatgacagagatttcgccgaaaaaatcactgtagttaagcttggtctacctcacaaaactattggatctgccactattccagcttgtgcctttcaactgagcagtttaatgacaatgttgcattgtagtccttaacaacagagaattgtatccccatgcgtttaacatcgtggtttgtattcaacagcaaatttgttaaatggatcagtttcgcaaactatcacatccgagtatgtatgcaattcatggcacgctaatctcatctgccataccattttactgcctctgtttttggtgagctagtccatttctcttatccttttgatgccatgtactgtttaatttccctcaatccacattttttggatctgttagaaccctgccagctttatgttttgcaatttatgtgataccaaagctggctttgcatagtggaactgtcagccattttcagtcctgattttctcatgtgaaatttaattgttgttcacccatttcttcttcttgtcagtaaatgtgttgtcttgaattgggatcatttactcgctgaatcatgaatacatgcagaactatatacgttatactgtacatatattgcagatgaacagatgggcaacattgattgtcttgtaatctttaagcccatcacatgcgtctattcaggatccaccactaccttgtcgggtggagttcatttcgtagtatgtttctttctcacttgcgacttgtctgaattgaaggtaattgagggcatgtgtggtaatttgacttgtacgagataactctatactagactttctttttccttctactatcaaatggcccagttattacattgaattatcacaagttgcttttgtgcgtgcatcaatttggtctttttttgcatgcaaaccttgacctgaacttttgaccagtttgatccaaagttttctttgtaagcatgcaattttctgttcaatttaccagtattatgtgtattttccattacccaacaagcttcatagaaagtaataactaatgtacagtgatttttctgtccaggtgtttctggctgagcaatacacaccaacatcatagatattgcaggttccctccagaagcttgtttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcactttgattttttctaagttaaatttatttagttttgactaaatttatagaaaaatatgacaatattttcaacataaaacataacaactatcaaaatatattcatttttagatttaataaaattaatttggtgctacaaatgttgctgtatttttctataaatttggttaaatttttaagaagtttgactttagaaaagtcaaagagatttataatacagaaggtagggagtattaaacttgttccaaaatgttgtgccatgctcataatcttctcccatcctaacgagcatgctctcttcttctgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacatttctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgtttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctggtttcaaaccgagtccacaccaactccgcaccattttggacatcgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaagtgttcattcttaaatgtaaatattacatttctcagctccttagcaaattcttgatatagtgtatcaaaggtcttccactaaagagcattggtggattgtcgaatcataccatatgtcttgcggttttctcgatactatctcatcaactcatcgtcattaggatttgagaacaagcgcttcatgacatctttcactggcagataccatatcaccatggtcggaatatttttctttgtatgcaccgatgaatcaaggtcgacaacctctctattagaggacccattacctgttctgtaccgactagccccacaggttaggtaactgttcaagtctacatattccttgtagtacaatacacaatgatttacacatgtatgtatcttttggacatatgagtttcttcgcttgatacgtgttagatggcaattagttaggtttaggaagcaaaacacttaagagacccaacaaaccattgaagctactatcggatcatttgtgtctggtcttcaatctgagaagttcaagcatcgaaggcaatatcgtaaaatctttctcacatcccttggattcgtcgtaaagaagatccttcgctgactaaactaacgtctcctaattatctaatcctctcgctgaacccattagcacctttggtttagcgtgacgtggcatatcccccagaccagaaagagctttaaaatcatcaatacgagtagaactgttctcgtccatctgtaaataatcatcaatatgatgaatgaattcttcgcatctcgtacatccatgtctgatccatctgtaaataatcacgacacgaataaaattaaactataggtgttttccaccaaaacatgaaaaatacacgcatctcctcgaaaataatgcaccattacattgaactagcatgaaaactagtgcttacaatagtaattttgctcatctaaatattctattatagttaaaatttgcaaaaatagctcataagagtcgtcttctaaaactgcaaaattctccgcattgcaccgatgaaatattttttaaaaaaatggcggcaaatggaggaggtaaggaagtatataaccttgtatatcaatttaaagttcaaaacctcccccaccctatttgttgcttgttttgaagagataaacttttggttgaaatggggttagctcgggttgggatcaaatatatgggcatatcatcgcgggcaggactcttaagggcccgcttgcaataaccgcattatcgcaagcggccctttaagatgccctcatgtgataatgcacccattatcgcaggcgggtctcttaaggggggccctgtgataatgtgttaccacagacgggccttaaactaccccgataaagtgatttttacatgcggaggcagttacggcctgtctgtagcctggaaagggcattgtccgcaaaaatcaaatctatagcattgtggtggtgtcacttttccactttatacaagcgaaaaaaaagttactccaacttagttttagcttaacagtataagggtgacttgtgcctttataaaagctaaacgaaaaatttgcctatttatttaggtttggacttttttcttataagttaccttgtaatatatcgtgcctgaaaaaaaagagggcagctagggacaaagctagctagtagcaagctcgagaggtggtgaacagagaagaattcaatcccctttgtaatagtttgaatcttaatggttggagttgtatgtatactatttatgtaccaaaacgcgtgtatgggtaaggtagtaagaaatataggattgagacgaacgttgcccatgcttgctctcgatcgatcactttctctttctttctagagcagctatgtgcaagttgtagtatcacattatcttgtccatctctacccatctagcttaaatattgccactctcgaattctcatcagtagccaatagccggtcgatgggaactaatgattttcctcagcgatctgcagggctttttgactgattaggacgtgtcgtcgccgtcgttgcactgcgttatcgatcgattgatcatccgagcatctcgcgctcgcgggcccctcgtgcgggcgcaacagtgccatcgattgctccctctcatggctgcataagaattgcagtgaagtacactacccatcctaaaatataaggatttctgagttttataagtaattataaaagtagataaaattaaattaattatgcttagacggttagattaagatgagagatgattacgatcgtttgtaatgaaaaggtagatggagaagttgctatatcatggaacaaattttagacaatacaaattgctattttttaggatggagggaaaagtcatttttctgtatattattgtttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcatagggcctgggaggtggcgtgcggcagtgacggacgtggtagtggtgggacgaacgttgtgctgtccgccagccgcactttgctaccggtcgccgctcgacactggccaccaagtcttccactcactttttggtagtagcggtgggtgtaggtggttgttaccgttgcagttgtgttgtctttcaagtactaatatcggtgacgcctatgggagtcacaccttcctataagcgttgccgcgatgcccttcccggtggacatccatgctatgcgatgaactgtcccggtggagatgatgttctagatgtctgaaatagcgatggtgatatttaagatgtcgcaaccttcttgaagtcatagcattggaggtttcttgttagtgtgatgtccttatgatggtgtccccgtcgattcgtatacgatggtaattgtggtggtaatctgggcggatgattgttaactactctttgatgttgacttcctctttggtttgacgttagtttgctgatagcgatgggagcgaaattcaatcaacaaatgatgttgtttttatggtttgataaagacatgaactaatacaagccgttggtagaaacaacggttatttatacttggacctttttagggtgctattgttgtttctaatcaagccataattgtaattcataattattcatcgtgtagactctataatagttggttgtaacttctatggagtaatgggaaaaaataatgctattataaaaaaaaaattacactccaccttcataacccgtattatggcatgatgtttcatagaagcatggcgatatatatgtgcatatagcagccgtaaaccctttttttttaccaaaaagcggtcctaaattttgacgattgatctgtgtaaaaggtttaacatgtagttaccgtggtttaaatgtatggtttacctgtccaacctattcaaaatctccattatatttcggacaaattagctactacacatgggtcttacagttggcaaccactaatgggcccgggtattataaatgcatatgtacattctttgaaagttcccctaaatgcttagcccctccagatgggacgagccatgcacatatgcatatgcatcatgcatagaagctaacctgaggttttgttcttgcttttttctacaaggttttgactctagaaactttatgctttgagacgtgaacgattatatggtctgcacactgcgaatgtggtgtttaaacttggagtgttatcgtttaaacgatgtgctcgaatgttgatgctatgctagtaccatttgtagtgaaacatatggcctcaaaggtcgatgcaagccaagacatgggtaggccatgaacgtcttgtgtcgtgtgccgcgctatagggccacgtacagtaaatggtgcccatttagcaagagtcgatactctgttaccacttgtaacacaccatgcgacaaccaaaaataatccacactgatcgtgtcaattgtggtacaccgcgcgacaataaaatccacacaatgtctaaacacccatgtggaacatctgtgtatgggtaaaatctcacctggattctacttatttagaagaaggagagagagagagagagagagagagtccatttttctactttaaacttttgagtctaaaaacccctcaaaatttgaaaccggatactattcaataacgtaaacaaagaaatccgtcactcccaaattcacctatattttgagtttttttgtgtcaattggcaatttaattatgtggctcaaaccgaaaaacaattttagttcaattgataacttacaagattttgcaagttttctcgtttgcaccacaaaaaacaatgtttcaaattaaacaaaataatctttagtggaataattgcaatccattcaacactatatataatttatctagcctgttgatactgctatatatatgtaacttttctttagcaatttcttgagtgcacttaataagttttataactcaaaagcattatttgaatttagaaaattaataaatggctttgaacaattctagaatttttttaaaggtggacgttgatgtatttataaaatttatcgatccacaaaatatttgtgtacttcctccgtttcatattataagactttctagcattgcccacattcatatatatgctaatgaatctagacatatatgtgtggctagattcattaatatctatataaatgttagcaatgctagaaagtcttaattataacctgaaatgaaggtagtattaaactatattttctgcattccgattgtaataaatttatccaaagttacaaatatgctgatagcagatatatttttataatttttgttaagacctctagctagggcgatcaagtagctattcttgcacggcatgaattaattagatgtttattatttctagtatttattttaagactgttcttgctagtaaatcgtgccgtactgcaattaatacatgcaatctgcaacactgattactgtcactgcatgtgatttactttccccgtcccataaaaaaccaatctaactagataaataccccgcacaatgttgcaggagaattgtgtgataatagaaggcacaaccacccttaacacaaacaccaagaaataattattatcatcttgtagtttgaatcatccgagttagagaatgtgagagtggaggatttaaaaaagtagtaatttaatggaaaatatatcatagttaatggtatgcatgcatgcatgacttatattattgaacataaaaaaaagtggttgtaccttatattatggaatggaggtagtatatatgagttctaaaattttcttccttatctactatacggcttttttcatgtgtttatctattttttatacttttatcaattattcaaatgttataaataattgggttgtatggtatgccttttgggggaaaagatgcaatttatacccttgatgaatcatccaaaggctaaaaacaattaaggtgatgtggctttatgagagaggagagaattagcattaactacacttactcgggatgaactttatagatctatataggatactggatgtgacacatcctagctagtactatgaatctagatatatctttattcagatttgtgttctagatttgttttatttgggacggagggagtaggcgccaaggtatcccaaaccactggggccggagttatcgcgccccggcggtaagcacggttaccgcgcggtaaccacggtaaccgtggcaaaccgtacgaaaccgtgtaaaatttatcaaaatttcaaattactttttaaatttatttgaatttaaggaggttaccgtggttttctttttaccgtacccccacagtaagcgtggtaaccgcggttaccggcggttttgtaaaccctggtaggcgccaatgccatatatgaattgtgtcgaattaattaattagcttgtgggtaagtagctgcatggagcattaagggggtgcttgaagaaaggattagggtttcgtaaattgcaatgagtgggatgccagatctatgatctatctcctcataggcttatatatatgtttgcaagtactagagcgccctgtactctgcgttgtgttgatttccgaaaagaaaaaaaaattaccatatgcaaactaactttcactacttgtcactgtcgtcctcctacctcagctccttctccatcgtcgctccaaacaactttaatttcaaactcttccttctgaaaaggcactgttcatgcatgctacaccccttcactctctctaaaaagttcgtgtgtttgtacatgggttgtgggcgcgtacattcatggccctactgtgccgaatcgaagagagacggtggccgttgtgaagcagccagcgacctgttcaattaatttccttgcctggtataaatttcttttatgttctgcaaccatgcacggctacacggagcctaatcattgataattcaaaatagtaatatctaatcgttcatttaaggacactgcggtaaagaaattttactatctataagagataaaaataattggtatcttatagtatctgagatacttgagagctatctatcaaaatttagatttcaaagagtgtgatacctctcagtattatccacttaacattgccacataaatgatcatccatgtcgcctcatcattgtcggttcagtgtgaaccgacagcgatagcgtatcattgtcgatccaccgtgatttatggtccaaactgatcacataatccagcagttatactgagtattattgtcggcttttatcacaaactgatagtgtttgtatcattgccagcttatgccatgaaccgatagagaaaactggttgaccaacatttgaccagagctaggagaggttaaaaatttcctaaggctccacggctgaaaacataagttgttggtagcctatcagtcgccacccaccccaccccaccccacgtcaacaaaatcccctcttcttctctcatagtttccctcttcttccttccctcctaatctgaccatggtgccaaccgcaccacgctagctctcttcctccctgtgtacctctcccttccctatatcgagccctctccccctcccccttctctccctttctctctcccaagtccaggttgaggtctatcttccctccctctcccatgtcgtaggcagctggtgtggtaagtgaggaggataggagacagctggcgaggtggggtctagatccagtgaccccgagctaggagtggccaaattcggcccacgggatggcagcggctcacgtggcatgatgacttgtaatctctgtgggatcctttgaaacaaaggttttattaaaggaattttgtagatatgaatcctttggaatattttcctatatatatgctcctttggataaatggaatggaccctttcaaattcctggaatatggccaagttcataaggattttggaggaaatctaacatgagctctaattaagctcttggaaaattaactttatgccatcctctctctaaattcatatattgtttttatatgaagtatccaaacaatacaattgagcaattccttgggatcacattggcatgccactccaattcctatattgttattattcctatgtttctcaattcctacgttttaaaggagccctcaggagctttgtacaagaccagctaccatatcgggggtccacacattttatgataactagtttcatgtcgtatatgtcctctaatagttctggatcaccccattagggattagcatgaagtacaaacccagtaacggttgcatatatcttatggaatcgttatatatcacttgatttcaaacggtttctgtgagaatcgttagagattagttgtcgaagattaattggctagctattttctagttgtgtacattctagcttagtattattgggcatgcatgtctgtactgtacatgctcaatcagtactgagcattcatatgcgcttgtctcctgcatgtatgtgctcaaagctaatttactattcgatcccccatttttttggccagatcgatgcacacaaatggactcgattctgccacaagatatgttcggctatatatctcttataaatcttttttagaataccaataagcagatctaacttatatatatgtttattggtcatatccagacaaaatataggagaaaacgtaatttttgatattggctaaactagctagtcataaattttgaaaaaaaaattgatcttttatggttaacatgcatccataacttaatttgatcactatatttttaatattatgtatcagtatactagctatcaaattataatattgagagattaattaaagcattttatgaagagtttactcctatcattttcatatagccaaacatactttctaggcaagttttggttagagcacattttgactgcacacatattgcaggcaatatataataaatttcccctgcatgtatctcatttttatttcaatacctaaacacgatatatttgcaaaaaaaagtcagatacgatatagtttctcaaataataaattttcccttgatatgtttctcattttttaatacttattaaacgctagtatttgcgggaaaaaataaaattcagatacgacatagtttcccgaattaagcagatatagataatctaggaaacaatttatacggtatatatgaaaaataattaagggcaggggcatatcatgcatgagagagagagagagagagagagagagagagagagagaggatgattcagcattcaggtggatgggaacatgcagccctgaccacaccagtcaatggtctacagcaaaacactacacctacaatacgtgtacatataagggatgcacatatataataagcatccaacaatatatttgtgcaccacataccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccatcaccaccaccaccaccaccaccatcacatgatgtcgggcggcgggcaagacccggcggcgggggacggcggcgccggcggcgccacgcaggacagcttcttcctcggcccggccgcggccgccatgttctccggcgccgggtcgtcgtcgtcgggcgcggggacgtcggcgggaggcggcggcggcgggccatcgccgtccagctcgtcgccgtcgctgagccggtacgagtcgcagaagcggcgggactggaacacgttcgggcagtacctgcggaaccaccggccgccgctgtccctgtcgcggtgcagcggcgcgcacgtgctggagttcctcaagtacatggaccagttcgggaagacgaaggtgcacacgccggtgtgccccttctacggccaccccaacccgccggcgccatgcccgtgcccgctccgccaagcctggggctccctcgacgcgctcatcggccgcctccgcgccgcctacgaggagaacggcggcacgccggagatgaaccccttcggcgcccgcgccgtccgcctctacctgcgcgaggtgcgcgagacgcaggccagggcgagggggatcagctacgagaagaagaagcgcaagaagccctcgtccgccggcgccggagccgggccctcgtccgaggggagcccgccgccacccggcggctcggccagcggcggcggcgacacgtcggcgtcgccgcagttcatcatcccgtgagttcttctcgatccccatcgccatctccgcatctccattgatcgatcgagcctcgcagcaagaaattccaatctccttggcagaaatgccatcttgctttgccagtacaaggcatcatatctcttctttcctcctgaattggtttcgatctctcccattttgcaaaaaaagatttctcctctttttaatttcatctctgtctcgctttctaagctaggacgaaggtcatgcatgagtgagtacttagtttaattcttgtttttttccttagctttgggacgtcaattaattggtagctgctgtcttcgatcgatctcgtcccgtttggtttaattattttgatgcaagaactggagtaaatttgatgagaatctcaagctagctagcctaattaggagttgtaatatttgttttagtctgggggatttgcaagaacaaaagtagcagaagctgtaggcatagcaagctagctagtgttagtatctgtagaatttgttcttgtaatagcttgtcgccaagctagccaagtgcagtggcgtcagcaatgcttccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgacaatgttttgttgtgtagtgccagttttgaatggtttacagtactggatactaccttctttcacttttacaatatgtgcaaagtggtaacagatgaagaaacaaacaaaccaaacaaaagaagaaagaaagataggagtcttttcaaaaaaggagagaaaagaaggcagccaggcaccaaaaatatataaagggttcaattgggtgtgcactagtacgattgggtgatccctatttttgcccatgctttgatgcttctgattcctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagctta

SEQ ID NO: 24689 - DNA, 625 bp, Oryza sativa
agccggtattgggggtgaagttgggattagagcaggtacaatagcagactattatctagctataaacatattttaatgatataaaagatgaaagagaaaagcagcgggctacaaatctgtaggtagctgcagcatagactccaagagacggtgtgtgtatgacagatgggaccatatattaatagtatagtaagcaactattatatgaattggctattaaattgactatagataaattggagcttgtagtgggctatactgttaaacttgctcttagagttgctcccgatcggctggcgctcgcccaccgggtgacgcaagcaggcagcagccgacacgagccgtcaaaaaggttggcgttgccaagctcacctcctcccttggagtctcaaacatggggcttcccgtaaacagataccaggtgggttctgttaactccgaccgtgccgtgccgttcggtttcaaaagccgcgagtcgtgcagccaacacgcgccggatcttagtttcaacggccgactgaattcttcggttggtttagtccacttaagtactccagttttgatacttgagcacggcggattcagcttaagggcctgtttgtcacagctccaactctggagtgga

SEQ ID NO: 24690 - DNA, 2479 bp, Oryza sativa
  unsure (1)..(2479): unsure at all n locations
ngaaggtacagatatcttaagctagttattgttttcaatttgttcccttattaatactacacttttcatatatgtaggatctgctgttgaattaggatgtgttgattaacctgcaattttgttcatagatttaatcggatgcagctattcctttgcttttatgtgtgtaatagtttttttttacattggcttttgaagttctgatactccatattcttgaacaatacatttctgatggataaaataaggtgtgtgtgtatatatatatatatatatatatatatatatatatctttgttacactgaaaaaggttatgtggccttgaccagttttgaactttacttgattcgaattattcaggagaatgatatcatatgacttgacattgctattttgaaactcttcactaggaagatgtttatggaagtaaggtgttgcctactgtaggagtaagatgtattagtgattagtggatggtatctatgtaaagtagataacacatgtaccaaccatttcaagtttttaatacttcccgtcagtccttttatttttccagggcatcccagtatttgccattggtgttggacagagtacatatgacaaagcttcggtaattgctcatatacttcttattgctttctgccctgtagttaatgaaatacagacttatgagttcctatagcttgtcagatttcatccttgaaatgtctttctagtgaattgataagtagatcgcacctcatacctttctctctaagtacattattaatgatcacgcgttcatttacaggttcattactatgtgcaatctcatattcaaatcaatgagtaccgtgaccgtattgttttggtgagtgcactactaatatttcttgctcaattaatagattgtttatatgagttttcttcacacgtatatttgctttcttatgttccatctagcctatggcatcaaagaagtttgggcggcctattagcacctgtataaaggttctagatatgactggattgaaattgtcagcactcaaccaaatgaaggtactgcatacatggacgtggcatattcaaatgtttaatttctgtataagatctgcatatcatgaacaattatccattatttgtgctgctagtgattagataccattgatggatgacagattttgactgcaatatctactgttgacgatctgaattaccctgaaaaggcagagacctattatatagttaatgctccatatatattctcggcatgttggaaggtacagtacctaatattattttccctagtttttcattagttctttattttgaaacataaaacagttcatttggtttcgctactaggttgtgaagcctctcttgcaagagaggacacggaagaaggttcacgttttgcatggttgtgggagagatgagcttctaaaggtaagattgcttgcaattactaatattcttttcaaattgctatagttatgtttactctggtaattcattgctgggcattatattatcgcattcctatttaaaagtcactcacttaggagaaccttttgttccatggaacttgatcataatattcctatcattttattcttttgcattcgcaatactatgatgatcaacgcacgcatttctgtcaaaactacgcagattatggaccactcctcccttccccatttctgtcagcgggaaggctcaggatcatctaaaaattcgtcgaacgacgtcaacaattgcttctctctcgatcatcctttccaccaagagctctaccactacattgacgagcaggcattgaaccaggagctcatcaagcagggctccctgcatgtgaatatccctgaccaagatcctgaggatgccaagatcgtcgaggtcatcgaagccgagttccataagctcggcgagcagaacggttctgtcaatggcgaacacaaagaatgaacaggtggtcgttgaagatgatcagctgccatagcttacctacaacacctttggtggtttgcttctgacgattcttttctgtgtcgctgtgttggcatggccacccctgttgttttcctgggctataggtgttacagatttacaatagcacattcctgcagttgtccatgatgcaaactgaggaaagaacttggtcacggtataccagttgaaatagtcagacataatcacctgtaaacttgcaatgcactatccaatatctctatatatgtatgctaatcttatctgataccagggaaatcatatctgaattctgaaatcatcttcagagaaaatgtagtactgagtcggtaacaaacgatacattaccagttcactatcaatctgtcacctaaattctcatatgattttgtctggttctctgctagaaacttgtggtatttatatatttttnnnnnnnnnnnnnnnnnnnnnnnnnnnnnnnnnnnnnnnnnnnnnnnnnnnnnnnnnnnnnnnnnngggagttaattccgc

SEQ ID NO: 24691 - DNA, 6363 bp, Oryza sativa
  unsure (1)..(6363): unsure at all n locations
catgctgnntttgtaaaatcanagtcatctgccacaanacnananggtgcatgtaagatccccttgaggtataaaaagatgaccttgcccacttaaaggagggattttttttgttttttattagaagggatcnacaaggatcagggagggaaagagtgagagctctgtggttctccagctattttgtatcttcttcatacatagatccaccaaaacacaggagtagggtattacgcttctcagcggcccgaacctgtatacatcgcccgtgtcttgtgtgtttccattctcgcgaaccttccacacacacctagagcttagaatctcacccagggcccccggccgaaccgacaaaggggggcctgcacggtctcccggtgaggagccccacgctccgtcagagtagtaacaaaccatgtcaatttatcgtatcctcagtttagttactagtccagctttcacatcctaggtacacggaacaatttagtcgttggtacttaccatcaatgatcagtcccactgttaatcagatgatttgatgctgcaatcataccaggatagcaataatactagcacggacgagattcccctttcttcaggcctcaagacacaagcaatgcaacgacggcgaggttgtctccaccctcatcgtctttagtccctcttttctccgacgccggcatcaccaccggcggaaaggctacaagtggatcaactcataaaccaatagccgttgacgataagattataattagatcaatccataaacctatcgacaatatgaacataagtggatcaatctataaacccatgaacagaccaaataaacggataaccctgccgccttagccggcgaacaacaccgtgtcatggcagcatcagtcaagcaattgtttggccccaatcagattcagaagcaggcagagatttctttctgcaaaactggtcgctttcatttcatgagtcagagtctactcctgcctttatcaaaccagatcatcctccctgctgcttttttggtattcaaatcagatcgtgctggcttacgtcgcaacacgcgagaaaaggcagggtttttcaaaagattagatcatcagtaccctggaccaaaaagttcagatacgaaaaacaattaacgtatggagtagatcaaattagctgatgactgaagattcacagccataagcgaaaaccacatctgaaagaaacctgtcaatgcgacaggtaaaaagttcagaatatactaataatcgcgaccaaattttcaatttgtaggtcaaatacagtgtgtcccaatggcgttgtccgcagcaatcgccaaacaaatagcaagcatgactggcttttgaatgagctgagatgcatatatcaaaagcaaactgcatctttgccagcaacatcaaaagacagctcacgcttcgtatcagacccgaatttgaaggttggggctgcttcttctgcactgtgggaactgctcggcaagtcaaaggagaaaacaagtttaccggtagtgcttgatgaaccaaaggtaaacttgggtatatctgcaccgtcagctgacgggatacttggtggctgtgacagagtcggagtaggtggtggctcaggaagagacattgaggtttttggaacaggaaatgtgaaggccaaaccattgcctgtgcttttatccaagacctgagcagctgatgtggttgccgagtcagattctgaagtatgttgtgaagagggcattgacttggtcccactattctctatctttggactagattccacagcattggagctgcttggaggagccagaaccttaacaaaagtaattagatcaaggtgattaaagaattccacatttaatgctatatgcatctgctaagtaatttgtttaatcagaaacaaacataaatatggaatcacagaagaatatataatgagaattgaaaacatgtttggcattgcactagttttccagtaattcaatcttagttcacataaccaagactttgtgttcaattaaatatatagtaaccattggcaacagtaaactaaggatctcctatttcaaactcaatatatgtattttaacaaataggacctgagcagaatatactagagaagaaagagataaatataccttatttgcatctgaaatttcctgttgagcactaccactatcgttgatgctgctatgtctatgactatcagtagcaggcccattatgctggatgttggtgacaacagaggaagtagttctctttgctgaagtccaccttagctctagtggctttgctgtaggagaaggaatagttctctctagatgctggagtattttgtgagctgttttgcttgacttgggatgaacagataaagccgcagatttggaatggggcatattgtctaccattgaaacaaacccgagcgatgaaccactttcagtggtgccttcgccatgatgtccttgaagggcggatccatcattcttcttagaagcagaacatttctttgcaaataagggagtagttgcaccaacagtatctccatatgcttctttggaatatgttgttgacggttgcgccccaagaacagcaccaagaggtgctgttttatcctcaaatattgcctacattttgaacagggggatgagggcaggagaaactgtgtattatacgattgcaggttgtgatagaaaaaaaggttcatttactgacacctcagaagtcaggtaatcaccacatgaccacaacagttgtaagatatagcaaacaattacgtatcttactctcagttgtaactagcaaatcacagttcaaatctcagttgcatgaactacaggcatgtattttatatcaaaatctacggatatttaaacctttggaaggaaggatggtgtcactaatccacattaggagataagttgaatagcaacaatcaatgtgctcacaacagtttcaacatgaaatgcagctatctgggcttcattctgctgaggctactaaatagtttggatgttcggtctgagtggaccagtatgagttcatcttaacccaactcggcagtgtgaactaaaaccttctacttcggtttgaggaatggaatgagtatgtatatcaacaccccactccatatggctacaatggaaggtttgaaacaatttcgtgtcaacaacagaaaatatagatggttggcaaaaggaagcatatgtgaggttatgcttcaaagaacactatgaaataaacatatatatcatggtgatagtgaagaaacattaacttgaatgacaataccttacttccaacagggaaaggagatgaaaattgtggctttccagatgagttattataggcatcacgggatcctgtgtactgtaaacagataataaatgaacggtaaatgtatagccctcgaatatgagatttcaatgtttctttctagttgcagtgttacagtgaagctcatgagacatgcagatatcacacacaaaataaaatacaatcataagaaagttgtgtataccttgttagatcttgggaaaactgagccaatataagttgtgcgagaggaagttggaggcagagttcttcctttattgctctgtggtgtaagataattcggatagtttcggacaacagatcctggccagcatacaggagaatctgtagctattttagggaaaacctttgaggatgaattctctacctcaactccatgactcaaagctctgaatttcctcttttgagactcttgtacagatgctgaggtctgtgcttccatataggcttttgcaagttcaattggtgatgaggcaacatcaagcacctaacatgccattaaaagaaagtgatcaaatcagccataagtctatagatcaggcaagggaggaaagaaattggtatttcttaaacattgtgaataatttttgctcatgcgtgttcttaccagtatttaattacacaattaagagtaaataacaactgcagaataattcaggaaacatggatgcgtataatcaaatttctaaaccatccaaaccataattcacatcccatagaaataacaaggaaaaatagcctccacaaatgcttgagaacattgtttgtacagaaacaaaaagatgttgaaattgcacagatatgaatgtcttacatttgatggtacaaagacttcagtcccacaaggtgatcgaacatcaatctcttttgcaggagtggaccatctgtctgaaaacggaatggcttcgaaacctttagtggaagaccttggaactctctgatattcattaaaatgatcaggagtccttgagcgcataatctctataaggcgttctgtttcatccctgtaagagcaacatgatgcacatttaactatatttcaaatttcaattatcaaaagcaaaaaaattaagtgcttccagccaataagatttaggtcaaacacaagataacaaattgtcatcttactttgcaaacgattttcaagcagttcagcaaactatgttataaattttaaataaaatcagaacaaagctttagaggtgtaaaagaacctgcctagaaaaatgtttctgtttgatgatattctcaatttcagcgagaccgctgccatcgttttgatttctacaatcaccttcctggagcaggctggctttattatccagggctgtagaattggtgttccattctatagaatgcctatgtgtctgcatttttggatcaaagagaaagatatcaaaagctgccaacagataataatttatgttgtaaacatgctaacagaaacagactaagggaggagtaaatgtagtattgcccttgcaaactaaagttccgacaatttgaacaaaagcttctggcagttctcaacaaatacactaagctcaaaagagaaatatgttcatcatcatttagccacaacagtatatggacttgaaaggattagttcactaaaccaatgagcagatgagggaagtgggaaatggactctcctcaaatggctggtgagacagcggaaatatataagagcatcatgttccttaactgtgctcttaactgaaaagcagtttaaacttaggtgtgatgttacattttctactatactactgaagtactgatactgatacagcaggtcattttgtaaatcactaatatttaacacgatctacattctccttgctgctgcagcatttcttggattatctcattatatgacaaataagctctatatgcagtacacctgtaagtttacagtacgagccagaaagcaatcaatgcgtttaagattcaagaaaaaggaactgcacttacttcattggttacttccagcgattcacgccaggccatttgattatcgtctgcagacattagaaacacacaaaagggtaatccacgtcaaaacatggacatggtttgcactttgcacagacaaaaaataacgaactggatcacaatgtggatgaaacaaacagaaatagcttcttctatatctataccaaagtagaaaaacaaacaacttggctggtgtacaggagaaacagaagtacatatgagctaacaataatacccattggcgatgattctcaaaagctactccacttgattcatgcccaactacgcaatgccaaccttgtaacagaggatctggatccccgagacaccaaccattatgcccattccatagagcaaaaacatcccaaaccacataagatgattcacacaccaacaaattagttaccgaagctgcacgtcctctcaataagttgcatcatagacttctgctgtgcctgtggcacacacggcactaaaccctagattaatgcatcggcaagaggcaatctcgagcaagttcccattcactacccaaccgcaccgatcttaaaccctaacaagccccaactcaaaaacgcgagccagtggcaatcgcatccgcctcccctccccctcacccccccacccttgattcctctctagtcctaggaatggcacggctggcccaatcgcatccgcgaaacaaccacggagcagaaggagatgtgggttgggggattaccggaggcggcggcggcctntattttgttagacctgtgaccaggaggggactattcctttattcgacaaaaagccgggtgtatcaacccgcatggagaatgccgacccggaaggggatgcggggatttaattatcgacagagagacatgacttgagggttaccttcctgatgacgacgcgcgtgtccagatcgtattattaaataacctctttctccaaaccccgtctccaaaagaaaatatatttaccacaataacctcctcccaccatgaactatttcctccttccgcgtacaatcgcgttgaaccatccgcagtgtctattt

SEQ ID NO: 24692 - DNA, 12890 bp, Oryza sativa
  unsure (1)..(12890): unsure at all n locations
ggaaggtaagctcaggcgggcatttctacaatttaaatcggtagccgcccgccgcgtcctccccctccgccgccgccgccgcggcgggcgactgccaccgcctcccgccgtccatcatcgccgatccctcctcgccggtgctcggctcgatctctccccgtcgctcgctgggcttttgggctgtgcgtgcggcgcctcgggtttgggttttgcgggggagcctgtgaatatgattggtatagttggcctaaaaggcccgcagcccgatggccctgcccacggcatagagatttggcccgacctaagcacggcacggcctacaccctccatcccaaataaagataaaccctgatgtccagattcatagccagagtttgtccttttttaggacggagggagtaactgttatcaggtccgtgctggctcagcctgactgttaggctgtgtctaggttcagtgcttagcacgacgtgctggtccggcacggtttggtccaacaattaggttggcaaaatagagttattttaaggagattatggtgggcttgtcgccggcacggcccaacgtgtcggtcgggttgtgccgacccgactaatcttactccccatctcaaaacacagaaacttaggattgaacgtatattttagtattgaatgttttctaggcttttcatattcgtattatattgtatttggctatttctttagcttgggaaaagtggagtacaaaagtattattggttcggctcagagtttactacaatggaaaactttatgcaccaacttgatttgatttgtcgatccgtatcaaactttatacacaaattacataattcgtgaagttactcgtgtgaccacagtgcatctctactaactaaaattagcctattattttgcaccctttattttcagctatgaaaattgacctctcctcattacaattcaaacttcagccaataggattgtaggaagctcttgtttgaggattcaaataaacttctactagagaattaatgtagaatctcaacggtacgtaattcctatgcttctcaagcaagaaataggaaaatgttttgtatcggcaatgtagtgctctgaggcccaaaaaaaggggggggtaaatgttgttgaagtaggaatgtgatgcctttgtgaggaccataagtggagcatggaactaaagggataggttaagaaagtgaggaaaaaatgcaaaaaaaaaacacctcttaagttatttgaactttgacatttcaccttataagttattttgttgcaaatgtttaccttctaattagtttttttttttgcaaaaaccaccataatgtgcacatgcttaaccaaatcaacatattttcatacattgtaagtcgtaatgtggtatttatcaaaattaaatacttctaggagtatagtcttccacttttcttggagatttcacaaatagaattgttgataagagtgtaaacatcatcgcactgagttttgctatatgtgaaaaaaatcaatgaaacataaaaataaatataatgcaagcacttaacaagattgacttggctaacttatcatgtggtggctctacatcagcgataatgggataatttggttaagcggcacttactcctgctagatatacctgactcccctatacaaaattattgatttccacaatctagttccttaatgtctacaataatctaagtagcctagtagagatcgaagccatgtgcactaccactctttgtcacagcctccctcacgctattgtatagtcctttcctcctcctatggctttgccaaaggtgagagaggagggccatgtttcttagtagtctctatttttagggttttcttaatgttgtctttagaggattagatgaatccgatttattttaggtttcttacatgatattcatgtagacttgtttagagttgtttgctttttttctctttctctctttgctagtagctacccttcctaaggtcattggtggaaagcctagaaaggattgtctgtcatgttgatgatcaaatcgattgtgccaactttaggatccgggttgtcaacttgtttggtgacattggttttttgttttgtctaaagaagagaaatggtggtagatacccgttcatctaattttgtgtgtgttagctgtggttgcgctcgtttgcacttatctcctttgacattcgaagatgcaaagtctctctattctacccgtagtaataggatgcatctcatccgatcttaggtttttatattttgggatagatataatatttaagataagatatgtttcttgaaaccgaaactctaaaatcatccccattagcataaagctgcttcatcatcatactcattcattcccacacatgactaaatagttgaagtcttcccttatttagctcctatcacatttgttttagttaatgtgttcttacttgtgcattacgcacgttattaatgcacttggtttgtgcctatctcatcttaacaagatgtcaccatcacggagaattagggcaagtactataagcctctgatcactaattctaatatgccatgtagactcatatgatgatatagaggggagaagagaagagagagagagagagagagaggagcagccgccactcatgcaagaggcaacctccgcacaaatttcaagaaatgagaaagaaagagagaagtggattggtagcaagtgtattgggtgtagtgtaagtagatgcaatctattgtatgtattacctataaattaatgtgtggatgatttggacaaaattagatgtgaccacttcctccattataaaacttgcccttatgctcaggaaattaattttgataggtactacatgaagtattatcaccaagaagtattaaattaaaaacatgagtataaagtccaaatgttgatagaagcacaattaaaatcactttagttgattattgccagtttcgttctagccaagaaagtcgagactttcattaaatttttaccctaaaagtctataaaattatatatatgcctactatcattcacctctttttttcaattatgaaaattgacccctcctagatctaattaaataggagtggacgttcggtcaggaccgaaagttcggtccgatttgtttaatattttaaaagttcggtctttcaaatctacaaaccgaatttatgtgaccggaggttcggttaaccaaaacttcccaatccgttgtttctatataatttaacatatatttattcatgtattccatagcaaaaggcacagtattgcggggctgtctggttcccagccattacttgccaataaaaattgccacacgttgtctaaggtgaggtgatcaaattcttagtcataacttactaagccacacttttttgagtcgttgacatgtgggacccaatttattagaagggaattttgtcacaactgtggctacaaacaaacacctattaaatttgcctaaccttaggtgtgacaagctgtggcaaagtgtggtttgcaaccaaacacaccctatctacaactcatactcattacacatgttttactcaatggaaggatggattaatgtgacatgtttcttgagctcctagacggtatgatttttgaaaaaaaaacttttgatatttgattttatttaaaaaatattttagttcattcgtttgtatcgttaaatagtcatcacgaaattattcaaaaaaaatataactttagtgattgctgacatgtgcattgcgtatgctatttatgcacttggtgagcgcctatcaactttctatccttttcttggtccttataagatgttgctatcactaagaatcatgatcaggaaattaaactacatgaatgctacatgaagaagtactagtaccaggaagttaaagaaaaaacgtgaatataaaatcaaaactcttatagatgtacaattgaaatcactttagctgattaatgccagtttctttctagccaaataaaaagtcaaaaattccattaatttttcaatctaaaagtctgtaaaacattactaaccgatgtaacccgtaggccgtatatcacgtcgtaccgtattgcccattactattaataaaaacgattatctaataatgtgatttagtaagataagtaacactccgtattaacaaaagacaaatctgacgagcagacaaatcatattgctaattgctgaatcaagagaaaaaaatataccaggtatgaaaatagtgaaaataaaccaaaagcagatacttagtttcgattttgatatatagttgtcgataaatttcctccaaaaaaattatcaaatgtaaatacaatagaattataatgtaattttattgcaactacaatgcaacttgtatgtaactttaacataattttaaaattttagatttacttcaagatttgtgcaagtttggaaaaaaatcataacgcgcacacaagtgatgagattcggtctcgcgacctccatttcacgaaaatagcgtgttattgtgattttttttaagttgtatacaaattagttatatgcaaattctagcgtagttacactctgcttgtactatatttacatctatcacattaatttgataaagaaaattatcgataaatgtatagctatttccctgtggttttgatccatggttttcgtagaagaaataaccacaaaagcttacgaattcgaaagcaaaccaccaccaccaccccggaaacttagacacacacacgctccctgtcccccctcctccccactcccttaatggccacctcctccaccgccgcgcgctcccctggcggcgaggtaaaaccagccacctttactaaccgaatcaattagagaaccgtatcaaatttcaacatcgacataattctcaacagagttgttaatagtgaaatttagtaagcccggagtaatcatcggcttagagttaacatcggcttcgaagtcctgagattagccgatgagagttatcaagtcgtcagttgtcggattcttgctatattcggttaaggaaattaatctactaaaggaagcttatccaaaaaagaccgagttcaaagagaatgcggcatggcaagttatctattaattaggaatagtttgttagtttcctttttatctttaggaaagtgtgttcagtgtcctataaggactttatgttttccttttatctttaggaaagtttctttattgtcctacaaggactagtatctacccatgggtataaatatgtacacccggggtcattgtaaactaacacacgttcaataacaatctcggcgcatcgccacccttttactttcgttttgttttgacgagttcttgctttcgggttgagcttcatcggtttcgatcttcaacaagaggtaaaacttgttatggcggcttgtgttctcgggattagtgcttccatctttatgacactctaatcttgtttatgtaattcgtcgagttatcatatatcctacataatctctgacaacatcgaaatctaacctacaatcggctaacatctgtcaatagaaggcagccgattaggttaaataccgatgttgacttagattatataggatatccaccactctatgacacatccaacagcttgattgtctagatattgtccttcttttcatacttatagctgcatcagttaagtttgatcttatgagtcgtgattagaatctcaatctctagcatgtttcttggttgccgattagggtagtatcggggtttcagccgatcttacctgatttaactactttttatcctatatacttgattgacatgttaaatctgccatttatgttaagatcttactgtatttaagtatattaggcttttgtttagtatattctacttgctttaatatcttaatatagagtggtatcggagtattagccgatacatgctagatctatctgatcagctatgctatgaacgtatatagtctcattattaatatatatttcgatctaagtgatttatactgtttcggcatggcgaccgatctaacccaatcacttgatttaagtatatatcgatataaggactacatattgttaatatctacagccgactgagtagatttagttctttcttacttattcatgactgccgatcgatgcatatatgacatcggctcaatgataaatgatatgttatcggcacctagccgatcggctatcgtttatggatttaaccacggtttcttgtatttgtttcttgttgattgcaggatcaaatcaactggcactctcatacacccgaaggcgagttttggacctgcactggagttaagcagatctcccaggcctcgtgttttacatcaacaagagtttattgcatttttaatctctaagagcaggtaaaatagcaggctataagccagctgcaaatatattttaaggagataaatgaggagagagaagagcagcgggctacatatttgtagccagctgtagcacggactccaagacgcagtgtgcgtatgacatgtgggaccatgtattaatagtgtagtatgtaaccattgtatgaatgagctattagattggctatagatgaattggagctagtagttggctatactattaaacatttaaacttgctctaagactctgtttagatgagactaaaattttaagtttctatcccatcgaatgtttggacactaattataaatattaaatatagactattaataaaacccatgcataatcatggactaattcacgaaacgaacctattgagcctaattaatccatgattagcctatatgatgctacagtaaacattttctaattatggattaattaggcttaaaaaatttgtcttgcaaattagctttcatttatatgtaattagttttgtaagtagtctatatttaatactttaaattagtgtctagataaagggaccaaagttaagtctctgggtccaaacaccacctaagtaatgctgatacgtgggccaccagtcggcagtcatagtaaaaaaaataaaaaggtggtgtatagtcgagtatctcccctcttccccctggcgtaaaagaaaaatctcccgtctcgtcgtcgcctccgctccttgcgccatctcgcggcgccgatctccttctggcgagccgagcagagcagaccagggcaggggagcggaggggatcctaggtgagcatccacatcctcttcctgattcatctctctccctcccaccgggagtacttctgtctggagtttgctcgcgttctttaatcctagcttctcttctagatctggaagaagctcttctgttaagttctgagcctttaaccttaatacaagtgacagtttgtgtttgttcagttgaatccgcccctgatacatttagtacaaaagaactgttttgcatcatgaactcattgtcttccttccttccaaccagtatgaacgattcggctagaactcactgttgtcgggatgtcaagtgcgagctgtttcctttttgcaactttatttatgtagattaggatgcgtttatgcatgcggaatcttggacatgtctaagcaatttctttactttcacgataggtgttgcagtttcttttctcgtggacggtctaaaggtggtgaagaggctgtacagatcacgatcccgcaagtgaggtttgaggatgatgaactaaagggcttgtccgagctactgcggcaggagatctgataaaaccagtcaagaggcgagtctcagaggtgctaggacgagatggatgaagttgctgagattgctgatgctatgggtacggttggcattgataatggggcaagccggaagttgttgtcgaacgagagtttagaggagcgaggagaagagcatgatgtgcaggctgatggggcgcactcgggtgagagtgaggtgatcaaccccgctgaggaggtgggtggagaagccacctcacagccagaagacgtaaagccgcgtgtttccaaggtaaagagttgacacattttgcagttgctgaggtcttctatgaaggtttttggtgacagttatggtaattttgtgttttgtagggaagccaaagtcattcccctaaggttactaccaaatctcagcgccagagcccacgaagtggagataagagtcaagctaggaaaaacagtcccggttctacttatcccaaggcacccattgcacgagtgtctgacccagatttggttgatagctcttcatgcaatgatggtgctgatattaagaaagtaaaggtcttttccattatgttgtattatatagtgctgaaatgcttagatcctgctatgtgcagtgttaggagacatctttatgcccaataatttaatataacatgaaattgcttttttgatgttttgatccagaaggctgaaaagagcagtttccgtccagttgccagggcgagtcaatcactggaggactcaaagtatgctgtttgtttgttgacagtatttttgtggcttagctgtttctgttttctcaagaaaaaataacttgtttggtgatggtctacatatccaattaagctattctgctttaacccattgattaagaaaaagcagggctttttttttgagtgaaagcgactaagcaagggggccttatgattgttgcatttctgatgttctgccccctcaaattatgccaaaagaattttcttgcttactattctcttatttttgcaaccataagcttttccatcttgtgagacctcagtcagtttaagcttgtttgaatactctttgcttataggcttattttttttgtgaaccattctaccaactaccaattgaagctcatattgatagtgtttcttgcattgacacattcctcatcaaacccagggaaaagaagaaaactcagaaaacatcaaaccaatgttctgtcaaaaatgatgaagaagagccaaactgtgaaaaagtaaagcctcaaagggttggcagcactcctgcgtacggatttgcattcaaatgtgatgagagagctgaaaaaagaagagaggtaaacttgttactagataacatttgcaccgaatttagtctcatacatatggacatcattcctttccttacacattctgcaatcaaatagttctactcaaagcttgaggagaagattcatgcacaggaattggagaaaagcaacatgcaggcgaaatcaaaggttcatacgttatgtctcttttcatggaaatgaacaatcaatcagttgtaatattcaagtcaaccagacattttcataaaatctttgcattgtttgtttctttataccatgcaggaaacagaagaagctgaactcaaaaagctaaggaagagtttgaattttagggcaaatccaatgcccagcttttataaggaaccacctcctcccaaggttgagttgaaaaaggtaattctctcgcttgagatatacatgtaaggaaaggaaaatttaagattatagaccatttacctactgattcacagtaggacctttggcagtcttcttttattttagttacacaatctatacttgctaaaaccagttcctgtgctgcctgtagttatatgtacaagtacacagcaggggcaggcctccaactccaaaatttaactccagctgggtctggagtggagttgtggagcagcctgaaccatgctccacctccctagttcattttcttatagcactccagcccactccgcttccttttggggtgcagctgaaaccagctccagctccaagagaggtagaggtggagctagagctggagctctgccaaacaggccctactttcacacattcacatatagtcatgaatggctctacattgttcaaaattttggctaacttaattactttaggtagccaatttcatggctgtttcctataagtagctagcaagctgttaacttttcatagaggtgatcagttctgttgatcagctgttcaggatattttatttacttgtattattatgtagctgttggcccatctattgctacgaatttgaactcagtcatgtttctttgatgagttaatttttagatggtttctttgatgagtttgttgcaagtttaccatctgcaatttgctgatctttgaaaaagataagtcctttcctgagaaaaagacatccataccaacttaagttaattcttggcttgctcccaccagatggttggttctttgctgagcattggaacttttgcttagcaacatgtcaaatatttatacttactagaaaaaaatgcccgtgcgttgcaacgggtgaaagctcttttaatcttattactgttatatggtttagttaaggtgaaattcactgtgacaattcgcttggatgcattttttttttaaaaaatcatgagctgcggttaggagtctgatcgtctaaaattagcatgcgagttttcttaaagagatttcttatacaactcttcttgggtttccaaaaacgaacgagctttaaaaccgacttaaatacggacatgtatttccaaaaacaaacaaacttaaaaaccggctcatatatggatgacgtaccaaagtaccggtaaaaacatcttcaattttataatagtagagagtagagatttacataatttttttaataagacaaataatcaaatttaatggttaaagtcatctgcctcaaaatatttatgacaagatggagtaatgtatatgtatattatgcaatagaggagaagtgatttaactggctagcgatcacatgtttcctgcatgattgatttgtggggtagcttttgcaagagcaaaaatatcagctagcaaaagcaggtccaattttaatcgtttaaatccaaatatgtgggaccactgcaacgctcggtttctggttgaaagtcggaaccccatccggtatctttgctgcgaccctgctttgggaccgacatgagtcggactctgcactgctcgtgcagcttcacacgtccagggctccaggctatgcttcgcagggacatgtaagaccaatagaattcgaagacagctgacggacggaagattttgaatgatttaatttttataataggtaaaaatatataggtaaagattaggataagatacatctagaaaacataaatggattcggatgacgtaccaaaatcttgacaaaaacatcttcaatttttataatagtagagatgtgcattttctgttcttctgataaatgatacttatttaccgtcattcattgcagatccctaccaccagagctagatcaccaaagcttggccgctcaaagaacacaagctcagtaagcactgaagaaagtaccgttccttcaagccgcccagctcgtctgagcctggatgaaagggcctcccagaatggtgtgaagaaggtgcctgctgcgaacacggtgaggaagccccaacggaagtctctccccaaactgccatcagagcaaacagtcactgaacaggtagaaaacaacacgtcggctacagatcccgttcgggagctgatccgtgcccaagttaccccggatgatcaatttggtggatagaaaagctaccaatttgagccgcccaaagaaacgcgcaagttatgcctcaacttcctatatttcattctctgctatttctgctgtaaaactgctggatatgccactactatgtactaaaattagtcctcatcaccaggagtttcgaagaacgcaagtagcccctgtaatgtttatcttgtcaatttttgttcttgatacaagagaggaggaacctactgttgttatttgtagttggtaacaattgcatatgaccatatcctatttcctaggctagaagaacttattatttccatatgaattaccctgcctttttctctttagcaaataagcaataaactttgtgcattctatcttgttaagttggtgtggaactttggcttaaatgatttctgttctggaagggagatgagagccttgcagttgctgatctagctagaacatacttggctgtggcttatttatttcacaagcgttgctgatacagtgatacacatgtacaagaagtaaacaagatcatcatgtaggctttgcaggctcattttacaagatcgactacaccttagctgcgtggtgctcttctccagattcatttttacaggtggccggattcagctgcgagccacggcgagggtcgccgggccggcgagccggcgacgtcgacgacggccggtgcctcgccggagagaggccgccgtgattcctcctcgggtgttcgttgcttcgtcttctttacaggcggcgagagatcaagagcatctgttcactcaagacgccgctgtgatggaaggaggctgagctgcccccatgaacggcggcggcggctgctcgccgccgtggtcgtcatcgtcttcctcggcgtcccagaggaagccggcgtaggagccgaggacgtagctgcaggagaagcgagacatcatcaagaaggaattgcctgagaaggtggcggcggcgcgtgggctcaccagtcgtcgggggcggcgtggacggcgcgggtgaagtaggcgtcggcgcggtcggcgtcgcgggtggtctcccagacgaggcccgcgtagagcgcgagggcgtcgccgtcgccggggttggcgacgatggcgcgctcgcagtactcctgcgccctcgccgcgtcgccctccacctccttgaggaacctcgcgtagttgccgagcaccagcgggttcgccgggtcggcctggatcatacgccggtagtgcgcgtcggcgtcgccccggccgctgtcgcctttccccccgctaaaacaaaagccgccgttgcacaccttcctacggcggcttcctcccccgacgccctccttgacgaccnccgcgtcgcgtgggtgcgagtgggatntacnaatcatnnncacccag

SEQ ID NO: 24693 - DNA, 7257 bp, Oryza sativa
  unsure (1)..(7257): unsure at all n locations
ntgnnnnnnnnnnnnnnnnnnnnnnnnnnnnnnnnnnnnnnnnnnnnnnnnnnnnnnnnnnnnnnnnnnnntaccaaaattaccataatattaatggtgagttagagcaatagccgagcttccataaaagctcaaaggtgtaataggcttgaataaagcttgtgtcgagctcgccttgttgacagccctagtttccaccagctcccagaaccaaaactgtcacgtgtacgaggataggagtcgcggatcgacgtacggaccatatgggccggccgctacgcgacggccgacgcggtggggccgcgcgggccgagcccgacatcacttcttttgtaccatttccactgtcccgtgttaaacgtagcagtgggtttcagttatcaacgttggaccgtcggttttgaaacaaaattataaataataattttattgttattacatgataaaacatgaatattactttatacgtgtcttaatttttaaattttttttaaataaaacagatggtcaaatgttggacacggaaacttatggctacacggagggagtactacgtatatccgtcctaaaatatactattagtacgcataccttcgtttcattttaaatgtagttatgggtatccgtgtctaacgtttgacctaaaaatttatgaaaaaattaaaaaaatagtcacacataaaatattatttatgttttgtcatctaataacaataaaaatattgatcataattttttttaaataagatggacggttaaacgttggacataatacaaactacaatttttctaggacgaatgtagaattggttgggacatttttagtattaggaaagtcgtccagaatcgtagcatataggttattactatatgattaacaagtacacatgaaacgagaaaagtttttactatatgattaattacgtattaattattacaattcttgaaaatgagtttattttatgctttagaaaacttgaatatatatattttttaaaaaataatacaccgtttagtactctggaaaacatgttaaaaacgagaaagctgtcgggcaaaaatgctcaaacaaacataccctaaaagagacatatggatgccagagacaaatctatatcctcgttaaattcctgaaaaaaaagtcaagaataatatttataggttctgaaaaacttaaattttgattaacgaagtcatgaacatacacacacacgctactgttatatatgagtatttctgcaagactgaactaacatatcttgagattgacgaagttaccacgaacgtcttgttttcgatggatctatcgcatattactgaaagaataattagccataaatacaagcacccgtatgaatgtggatgaactagtttcaccacaagaaacctaaccagttgagttagggcaagggcaataaaaaagacgactgcttactctaatatttatacacgtcatttggaggtaacttaatagataataaatataatagttgtctcttcacatttactgcagcacacatatcaataattatttaattacttctctctcactccttcccagcttttctctttcctccaagccaatcagggaagattattcatgctaatttcttgttccgtcgatggtgctgtcgataggaaggctccaagccagcgctaggtgcattggcgcccgtgcatgatcgtcgacagattaatcgacgatgtttctctctcttggtactctctctccgccacgtaggtataaaatccaacgtaagcttactattaaccggtaatttcaagttattgtacttgcccttacactcacttcgtgttgggtagtttggtttgattgcaatcggagtgagtgcaacaattcacagcttgctgggtgtaatgtgtgtacggtgtgcaatcaggggggctgtgtggagtagaaccaaagtccaagttgtgttgagagagaactgaatggaacagacaaattaagagatgggggtgcaggatcttctcgccaaactgaacattggatggtccgattttatcacggaatttgtgcaaagctattgccaattacagtgcattattttgtgaagggactgatgaagaaaatgattgtatgttgtctacacgttgaaacatttaaagagtaaaaaaggagagttcggcatgaccgtggacatgattaagaaccacaccctgcaccctgcagagaatgacaagcttgtcaacaccgtatcatgacatgaccagttgcaaaagagaaaatgatttttttttacggttgaaagacaaaatgaaaaccactcaaaacctatacgacaaaaggcattacacacaatttcctttctattgggtgaagaaaattggtataactaaaggaacaatctatatgatgtggtgtaactatagagatatataagtgggccgacccgtgagtctacttatatgtcaaataagaagtaacactcaagtttttacgtcatggtcctagcttattgcacctaaagatgtaggtgggtagatacataaatctatttataggtcaaattacccacaaatggattcgcgggttacccactaattttacatgcggattcgtgggttggtccacttgcaaccatagacgtaactagtggagttgtaagtacatgactccacacacactaattcaagttagaagaatataatgcatatatgattgcactttcaataaaacttagcgagactaaggactagcttttaatacgaatttgttgagataaaggtttaccgatggtgttcgtctcttcgaacgtattgccgtgttggtttttccctgtttgggtatgtgttggtgggcatattttacatgtatgtgctaatgtgcatgtagtatgagcacacagtacggtgcgtgcgcgcatgacagccatcgtttcacttatactgattatatacataaaggcttatcagcaaccaacatatactttgttaatagaacttctatatacatatgtatagcaatttaaagcaaatgctggaaataaaatacgataaaagccctaaaatcaactctaaaatcaaaatttaaaactaattttttattcggttcataaccgtcttaggataaacgataggtgtatgtcatgtgtaatcgaaagagaatggtgcaaaggaaatcaatgaaaatgatgatagagttatgggtgttacccatcaccaaagattaagggcccctttgaatcgtaggaatgaaaaaatggaggaataggaaaaagtaacgtaggattctaacaggaatgtaaatgaaaaacagaggattgcagaacgcaggaaaaacacaggaatgaccgtttgattgaaccgcaggaaaaacacatgaatggaatgagagagatagactcaaaggaatgtttccaagtggttggagctcttgctaaatttcctccaaaatctctataggattgcccattccataggaattttaaaggatatgataggattcaattctttatttcaaagggcttcataggaaattttcctatatgtttcaaatcctctaaaaatcttatgtttttacttcaaatcaaaggggccctaaattctgctgtccatgaatacatgttttgaatatgatttcagtagggcatgtgtagtgctttgtgcatgatgaaaaaaaaaaggaaagaagagaaagatagtgatacaaagctttcaccatctggaaaaaagagtggtacagctgggcctggccgcctccccacctcacaagtaattctgccgcggtaaagatctgtttcccccaccgcctgcgtgccgtagcgtgcgttgccgctacgaaagtccccgcgagaatgcaaagatatcgcgaggggagagagagaaagagacgagccagaagcccagaattacggcacgcatcggccgaaactacgggcgccgtcgtcaccggccggcacacaattaaagtcgtcaaaaatatccccgctaactccggtcggtcgaaccggccggccggctggccggcagcgtcgccggcgaccggccgtacgtgtgcagccgttgttgtgtcgcgtcagtctcacgtggtactacctgctcttccttccagtatcttactccgtactcccttaaaaactcaacctgggatattaggacaataaatctgaagactcgtgttgatattcgttgccaaagaatacatcacattctattttagattaagcttttgtgggacggatgaagtatgcgtaaagctgagcaagcaaaacaattgaacagattgctcgacgaggacattcgcgtgatccacggaatcgtgaagagaatgaccgcttatgtctatcacggctggcatgaaccgcgttctaacgtataacaacctactttatttgaaaaaacaaattcaattctgatgatgagtttgaggagttaaaaaagcttgaggctcgcaagcagctcaagcttgacttgtcccagctcgattcgagctcgactcgagctacaaatgagccgaaccagagcctaagcaaaaactcgcgagctttaccgaaccgagctcgaacctctactaagcaaatgtgtatagttcaaaatgtttattcgctttattgatttaataaactaatatatcatatatattagtatctatttacacagcaaattagcatgtgttagcgtaatatatttatcttagtcattttctactcttttattagtgcgatcaaatagaaataattatacttataaaaaatttatcattaatatatatattatattattaatggctgaggtcgagctcgaaccgagcttgcctaaaagctcaaaggtgtaataggcttggctaaagcttgtgtcgagctcggcttgttgacagccctagttgccaccagctgccagagccaaataactcttgttttgcacgtttcgatgtctccttcgtcttcttcggagccgtgctgctcggcgccaacaacgatttcgtcttcacgaattgttaccccgctaggtagggctccctccatggatggaatgaggtgcaccgcaactggccgaggttctaggactagctccgtggtgatggcggtgaccgctcctctctgtcgtcccctcgcctttttctatggctaccaaccgttgatctgccatcatcgccagcgcggcaagctctaggcgagtcagagtcagcgcctccccgtgcagtggctccctctccctgttgttgtcgcctatctccactaccttctcaacatggttccccccgctctccttgctggggctgggacttctccctttcctttgcaggagccgatggagccatcggaaggggaggagggagggatagaagaggggaggagagtgaggggagagaagaggaagaaggtgagatgaagaggaagtcgctgatatgtggatctcacctgttgactcaacgagtcaatcgtgatcaacctatcatgtctgcaaaacccactttctaaaatcatcggatcagtcaatttgtattggatttgaaagacgggagatgtgttatatggatgcaattcaatgaggaggagatcagagagataaaaatagaatggaataagttcatctagggttccttaacttgtcaacaaatccgattttcgtccctcaatcgaaaaactagacacaacgggtccctcaactatcaaaaccggtgcagatgaggtcccttggcggttttgagggtggttttggctgacgtggctaatttgactcgatcttcatcttacatggcactgacatgacgcttaagtggcaatttgatccgaaaaaataataaaaccagggggaactacatgtcagtttcacacacaaaataataaaaaaagagggcccacatatcattctcacccctcttcttcctcttctctccccttctccctctccatctctctcccctatcctctctctaggcgcgacggagaggcagtggcgcacggcggccggcgggagaggagggagcggcacggcggcggaggcatggctccggcggctgtgggcggaagaggaaggggatgtggagcttcttttctctctctcggtctctcccctctccacgccattgatctctccctctcctacttaccgcagccatggcggaggacgccccagcaacgtcgctgccgccgccgccgaggggagccagcacgcgtcggctgtcgcggagggaggctccgccgccgctcccgcggcactagccaccaaggccgcggaggcgctgctcccgtcgctcagcatctggccgctgtcgcagacattgatttgattccaagatttttttttttgagcaagggtcaagacccccatttcttttactagaaatgatcataccagtacaggttcagccaaaagcggcaagcgatttgattcgaagatagtatcagcttagctagcagtggctagctagccatgagtagtagtggcaaggagaagaagcagatggaccggttcatcgtgatccccttctcctccacctgccaaatgctccagcgtggacgtcgttgatgacagcggcaagagcggcaagaagccccaaggttcgtcgtttggagtcttggatgcttgttcttcacttctgctcgatcttgtcgattggtttttgcggggtgatttaggagtttggtgttagtgatgctgtgtgcgtgtctaggcggcggcagtggcgagggcggcggcacggcggaaaacaaacccaagggggagtcgctggtggcgaggcttctccaccactgccagcacatggcgcacatcggctgggacggcagcaccagcaccaccaccagcctccgttcctggaaccacgccgcgccgccgtacgtcgtcgtcctcctcctccaccaccgcgtccacctcgttagccttggcggcgccggcgacatcaagaaggagtcggcaccgacggggcctgggttgtgcagctcctgtcctgccgtctgtcgtagccagggccaactccggccgtcccttcctcttccgcccacagctgccggagccgtgcctccgccgccgggccggtaccttctatcccgtcggacgccgtgcgccgatgcctctccgtcgcgcctggagaggggataggggagagagatgaagagagggagatagagggagaggaggaagaagagggggtgacactccaatgacatgtggggcccaccaaaaaataaattaatttatgtgtgaaactgacatgtggatcccacgggtttatgggtggtcgggtatactacncggngcnggtatagcaatgcatttaatnncgccgcg

SEQ ID NO: 24694 - DNA, 3274 bp, Oryza sativa
  unsure (1)..(3274): unsure at all n locations
gggggcnatgttatgaacgctagtgtaacggcacactttttatnnnnnnnnnnnnnnnnnnnnnnnnnnnnnnnnnnnnnnnnnacacatagtcttaggtattattttttgatgaaatcataatcatgatcattttgactttgatctaccacattcttaagttttacaatcacattttaaacttatattacaaccactttgttaaattttgatataggagtgttaaattttgatataggagtaagccaaaatggttagtggtgtgatttttgttaaactttaggatcataatacccagggttatgaaccacgtgtctaaatccatatggttttgtataacttgaaccacaacagaccataatactccctccgtcccatattataagggattttaagtggatgtgactcattctggtagtgttcagattcgtagtactaggataagtcatatccacctagaatcccttataatatggtgcagatggagtaggtaggattttataaaatttaattattgttttccttgaaaatatgtagccagttgtgatatttcttcatataagcatgtatgagcttatatgggtgggcagaagatctcgagggttgtatttaagatttacactataacatttaaaaataaaggatttattttattgcactgattttgttctagttcaacaatttgccatcggttttatctccctgtataatatgtcattgagtttatcaaatttttttttacaatatgtcactggggtggatactttaaaaaataaatctcaaaatgtccttcaagttacaagaggttataattaattgacctactagaagtttcaagaaaatgaaaatttttacgtaacctccttacataatatagaaatgtgtgtatatttgaaaattttcattttgcatgtattaacttttaaaaagaatatataatttatgttttgtatgctaatacaatactcttatgttaatgttcttttatgtacatcatcattaaatgctatacattatttttctgatgcagctatatgttgtgtatttgattcctcttttatatgctacataaaaatagtttctttaaacgaaacatgaaagaaaattttacacacaaacttctatattttgtaagaaggttaagcacacaaaaactacctttttttgaaaactttttagtggttcaaacaattgtcaattcttgtatgacttgaaggacattttagtcatttcttaaaattatctaccacccaaatgtcatgttgtaaaaaaaaccaacaaagttcatgggatattacatagggagacaaaatcgatgataaatcgttgaagtaggataaattcagtggcttaaaatagattttatcttaaaaatatatattttgtgtcatttataaaaaggatgatgtatttgttgaaaatatcagaaaaaataaaatgaagcatatggaaacgaacccaacagctgttgaataggtgcaaaacctataaccagcgcaattgggcaattagtatatttttacgcttagattttggatagctacttccaaaagaaaatatggacataaaagaatggggcgttaattgattacattttagtcacatcacgctcaaagccccggcccaaacaaagaaattttccgttgattaaacatactgtactctataaaaccggatgttaggcttgattagtccctggccttccatttaatccccaaaaccttcacgtcacccttgcctgtaaaacgcttaatgaatcatatccttttgttaatcaagctgatcgagagatgggacatggaagacatgcacgcatgagctagactcctagagctattaataattttgttttggtttactacctcttgttccatattaattgatgttttaaacaagattaaggtcaaacttttataactttaaccatcaataactttaaaaatatttagtttaaaggaactagaacaacatatatatatatatatatatatatatatatatatatatatatatatatatatatatatatgtcttttaaagcatgcatttatttattatatatattataatagaaaaataatgtcaaagatatatcttgtagaccatatcattgtctaaaacgtcaattaaaatgaaaccgaagggagtaatttgtgctaattcatctcagccacacgtgcattgattgtacaagtcatcacagccgaccatgatgtcatcggatgttcggtagtattccctctctctatagtagtataaccatgttaacacggttatcatgggatataaaaacttgtcaactttttggattatgataaagacaagagatggtaagtgtagtatatgtatagttaatttagtgggaagtcaccttttataattactatattgttatatttgtcataaattttgaatttgaagtagttgttacctccgttagaataattgtatttctaatatttaaattttgtaaaaagaatatttctaatgagacaagacctaacaaattaattttatgaagatatatatgctgtcgcctagcctcccatctctctatccaaatctcctagccctcattttaatcaagttttacatataaaaagtatgcatgcggtgtggatattaaatagggttattatagtcatttgtgtgttgctaatctgtctctaatttttttaaatataattattttgagacgtatgtagtatatatattttaggacgagggaatgcattatttttgactcaagatgatcctttctgagtagggctgtgtttagattcaaactttttttcttcaaactttaaacttttctgtcacattaaatgtttggacacatgcatggagcattaaatgtggacgaaaaaaaacaattgcatagtttgcatgtaaatcgtgagacgaatcttttgagcctaattacgccatgatttgataaagtggtgctaaagtaaacatttgctaatgacaaattaattaggcttaatagattcgtctcacagtttacaggcgaaatctataatttattttgttattagtctagtttaatattttaaatgtgtgtccgtatacttaaaatttttttggcacactgcttgcccgacagcaaggtacctgtcagcttttgcaatggttggttcaggtctctcaggttcagcttttgaattgatagtggcaagnnnnnnnnnnnnnnnnnnnnnnnnnnnnnnnnnnnnnnnnnnnnnnnnnnnnnnnnnnnnnnnngagaactgcacgttcaatnntcaattggccc

SEQ ID NO: 24695 - DNA, 8652 bp, Oryza sativa
  unsure (1)..(8652): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagcatcatgcttcggtggacgttctagtgccgcatcgttttggacggcgggtgcactgtggcggatgggtcaacagcacggtgcggagggtggcatggcgccggcgaagcggtctggtggtccgaggtgacacggacaacggattcgtggcggagccagcggttactctgtcagggggagccacggtcctctcgacgttcaccttcctagacatatgtcctcttgcgacggcgactttgtcggcaaaagttggccacgtcgggcaggctagtgtgggggagagggcatccattcttctctctcaccctctccccatccaacccaactgcgtggatggagccggtgtgtgtcgaggttcgagcttccccatggcgattgactggcggcgtggcgccggtgcggtggccgtgcgtcgaaggttttcgctggtggtggctgcggagcgtgtaggagttcagttcttgggagagacaaattttgggcgaaagctctgccttcgggccggcaacaacgatgcctgtgggtgccgttttttcctcttggggtgttgccgcttttcttgtctctcccaattactttcttcatgtgaaaaccttgtcctggccctctgggacaggcgacagcggcacctttggtgtcgtacccttttcgaaggtgtcgtctcgaagaccttcagtttcgctcgtgcagtgggttttgttgtagatgcgcggtgtggttgtattttctttttctggtctgtggtcttccaggactatagattgtatttttctcctgttttatcaatatatgaaactcgcgctgtcttgtgtggttcgtttaaaaaaaatagaaaaccgctcaaaaaaaatgaagctgctataattaacttgcgatagatttttgttctaaatcattcaatttttgggccgtttgatatgctgagatttgtgtttgacataggaaaaaagtttcacgcattgtgattgctggaatcaaacccttgacccaacaattgcatgcgcacatacttcccactgagctatcttggattttgtaatttatgcttcacctggatcctagttacgtggtccgacagtttcttggagaattttctatcgattgttacagaggtagttccaaaaataatgttgactaaccgataaaaaaaatatgtgagaagaaaaaaaattaaaccacgttgatcagacatcgtcctagtgtgacgcacagtcgatgactaagtacgtactacatctattatgatgccattaattttttgataaccatattcatcttattcaatttttttttaaatatgaaagaattaagtcatgcttaaaaaatatttaacagtaaattaagtcacaataaaataaatggtaattacataattttttttaatataacgaatgattaaacatattttaaaaaatcaacggcatcgtatattaaaaacggagatatcgtataaaaatgtgtttgcctagtcatactcctcgaaagaaattaaagttctgtttcgacatgttcatatcctgaaatccataggattaatccctgccgttcgaattgcacgtcgatctccacaggacagccactcacatactccctctgtcaaaaaaaaaaaaaaacctgggtttgcgtgtccaactttgactgtccgtcttatatgaaatttttataattcgtatttttattattgttagatgataaaatatgattaatattttatgcgtgacttatctttttaatttttttcataattttttcaaataagacggacagttaaacattaagcacggaaaccagagtttgtcttttttttttattttttttggagggagggagtaggcgtgcgcactcgagttgcagagttctctcatcatctgatcccatggaagtgatcactgatcatccactggatggtgtggttgcacatcatgaacagaaacggcgacgtgatcacctgaacagaacggaggtgatggaaaacgacaattcaaggacgctctgttgattttcagctgatttctgcgccaatccgaaatggatcttgagcgctcgaggttatcccacctttacctcttattttctttaatatactttatccggcccataatatatcaatctaataccgaataaaatcttagtataacgaattttattaacagatctagataggagggtgtccagattcatcgtactattaaatgtcagtattaagttggcactcccttcgtcccatagtataagagatttttgagggataagacactttctagtactataaatatatataaagagcttgtctagatttgtagtaatatgaagtgtcccatccctctaaaatctcttatattttaagatggatggagtatattataggacggaagagtataaaaaaatataacaaacataaaagtatactaagacataaatttatatatgcggaatcggtagccaagtcttaattttgttcaactttagatgacgaaatatctatataattacctgccacgataaaaaaaatggtttctctgtttcctttttgttttttatttttgaaaattgaaaaagaactctacggaagcaaatagtgcgtgtggggccaggctgcaggcagcaagaagtggcgcatgatcgatcagcctgtccaggtgaagccttgtcgtacgtgcgtgtcggtggttggagtttctgcccattatcaggtggtaataatggcgaatttatattagttatatctaactattaactgatatatttcgccagtccctgaatatttgacgcagttggttttttaaaacatatttaaccgttcgtcttatttaaaataattaagtaattattaattctttttctatcatttaatttattgttaaatatacttttatatatacatatagttttacatatttcacaaatgtttttgaataagatgaatggttaaatatattttaaaaaatcaacgacatcaaatgtttagggacggagggagtacttattaatatcatataaattagcttaaattgtataatttactagggatcatatgacgcttgataggattaatattgtaggctagtccatatggaaaataatccgggatcaaaccaacgacttacatggattaattattatctgtcctaacatgactatgaaagcaatgccgtccaggtggtggggccagcctcaacttcaatggttaggttagtgctctccttccacggattgaatgtgaaccattgcactactgctagacatcactatgcaattgtttgctaggataactttaattaccatatttaaagtgtatcggtttagtgtaaaattttaatacctatatatatatttctcgtactttctgaaagattgaaaacttctagtactttatcatgactatgcaagcaatcgcagtacctactacctaaacatctgatcacatgccatctaaggtcttattggttatacatgtattctacctgtaattatccccatttcataaagtctctaagagaaagacaaattaatttgaagactaaagagagagaattttcatgaagagtgtaatcgttaatgagaggaacacgtatactcatagtaaatggaaaattcaagtacgcatataacttaaccacgccttatctctttcttaatttcaactggcatttaataagtgtacagtaaaaatgacctaaattaggaatggcagtgagggaaatttgcaacaattacgtccttgagctgaaaatgctagaccgtttgcaatatctcaatattaaacttagtttgatttttaggcacaatgacggctttactagtatcctttggcttaatatatgtgccaaatttctcattaccaattacttaaacttactttttaggcacaatgacggtttacttctacctttgtcttattgataatatatatgtgccaaaattcccattatcacttgtagagaaaccatctttggtcggtcgacccaaatccacagtagtcccggttccattaaaaaccggaattaaaaataatttttagtcccggtttataagaggaagatctttagtcccggttgttgttaccaaccgggactaaaaatcatctttagtcctgattggtaactccaaccgggactaaagttcatctttagtcccggttgattccatgtcagaccgtatcagggctcgaggatctttagtcccggttataacactacaccatgacactagattaccaacagacatctgtcggtaaagataaacaattattgatagactatttgttggtaaaggcttttggtaaattatatgtcagcaatactatgtaataagacatgttatatgttagcaattccaaatatttattgggtcaaaataactgtcagcaatattattaagagtggaaaccaattatatgtcaggaaaacttaatgataacctatctgtcagcaatgtttcgtccgttggatgttgatcccacggttaggatagagcgaggtgatcggtgcgcagtaaaataaaaaaagaagcgcaaaaaaatccgcgcaaaaaaaaaaaccacgccgaaaagaaaatccaccccaaaaaggaaaaccctaggctcgcaccgcgcgccgccatttctcccccttccaccgcgcaccgcctcctccgccaaatccaccgccgcggcgcgcggcctcctcctccgccgcggcgtgccgccacctcgctcctctctccccatccaccgcgctgccggagtcgacctcgcgcccgcccaggtttgtacgggctagggtttggggggcgcccgtccagatctgggggattgacttgggtgttggggttggtgttggttgcaggtggtggtgtgtgccgggtagaggaggaggaggaagcgagggcgtcggacttgtgcgtgcgcaggtccaggggcaggacgacattcgacgcggtcgccgacgaggtctcctagttcactctgcttgttgttgctgaatgggtagtgattatcaatactgatggactgcatttctcttgcagtttttccccttttgcctttgatttcttcggccctttcctttcaagttttgatacaaagaattcagaaactcatactatatgatgggtagtttcctctgtttagtcctgtatcttggaactcatactttatgatcaaagaattcagaaaaggatcatgtaactatccagtctagtatggactgtagttgtttctaactgctttccatagaaacttttgcaccctttgtggtataaagaattagaacaaatcataagattcttaagctgctaaggttaagtatcatgaccttcactagtaaatcataagattcctcctagttcactctgcttgatgttcaacagacctcatgatgcatgtgccccggaaatatattgctctcatatttgtaggattagatattcagtaaagttccagagtttcgctctgttttttatagtacaatgggtgcttttttgtctaaactgtgtgctggtaaatataaacgataaaaccatccagaactgagaaaacctagcagccgctggtgttgtgtttaattacatattgcagatgtatacacctctgcatttctaagtttgtattcctgcagttataaactcataatccgcttatactctgcaaacacatatatgaggtaagttcagtctggctgcagttaattaagattaaggttgaaaatacggtgaactcattttggtattgatctgtgaccatgagttcatgttgaatcctatatatgcttaatttagcacatctgttgttgtctgcatagtggtcttcatggcatatgctaattctggaagtgccaccgataaggtgtggccttgctctgttcatttgtcgaaattaagaactttgattctaaatgcatgctatttgttagaggctgtgtgtggctacaagtttctatatgtcctttgggcctaacagaggcattaatatctgttttgctttttggatcacttctcattccctgaattttgtcttctgacttttcagaagcctgagttctgaaaagggcatactagaaaacatctgttgctgctctttctgctagatggagtacataattttttttatgttatgttagcttgaatattgacctggcctcaagttgctatgttagctctgaattttcctagcttaacactgctaagtcacaagtgcggcattacaaacatttcagtaactgatatttataggattagatgttcaattaagtttcaggattttgctttgtttttaatgaagcatgatctgattttttttaccaattcatataattagatggctgagatttgttgtttcatgtaatgcatgcaaaatgtttgacttagaatttttcttgtagacaactcagggacagatggagtagtagttggaggtccaatattatagcctaggacacgaacaaatgcagaaaatggaggtgttgatgctaatgatcctcgaaatatgcccttagctggtgaaggtatttcattcgacatttgcatgtatcgttaataagattaaggtatatgaatatatcaagttcttatcatctcttttcatatgtaagcagaaaatgttccaggtgttaataatgtacagctacaaaagaaggtacacaagaagacagcaaagactaaccagcgagcaggtacttaatttgtacatgatgcaacatgtttttgtgtatatattgcctctctgacttaatttgccatgccttgcatctatatccatcatcatgatatatacccaatagttagtgtgcactttataagctgaacaattggtattgttttgttagaaaggataaccaatgcttgtagcctaaaacatctttcagatttactaactccgaaggcagtatctctactagttgcaaatcagatccttaatgcatttgtgcttttttacaacatagaagttctattgtttcctttctcatatatgtactgattactgactcatcaatagggtctttgaaggtgctctcttggtagttttacaggctacaattttctttctgacagggtctttgaattagccatttgctcttcactaaatttatctgttatgctattctaattgccatggactatatatattcttctgtggttctctgtacactagatatgtttactctgtacactactgatgattattcatttcatttactctgtccattattttgcaggcaaccataaaaagggctagcagaggtgctgtaaaaaaaatcaagaacctacaagaaccataaaagagatgatttgttttgtttttgggacctcaatacacctacaagaaccttagttacatctaaattatgtaattattgctatgtacttgaactcttatgtaatagctatttgagctgatggataactgctatataggaatactgctacttgatgggtgaacaatagttacatgatgatatgtcagaatgcatttgtgaacaatagttatgaatagttgaatattgtgttatgcatgtgtgtaacttactgaaaggtgataatccgtgttgcaaaatttggagtgatattcatccatatatatgctgcaaatttaatttgaggtatggttcataaaatggatgattggtaattagtatattttttgtgtggattactgactgattgcttgttagttcttgtgcttgccatcaatacattaattgtcggtaaatctataacacagtgacatgctatctgttgggaatcttcttaagtgtcggtaaaagtctgtctgttggtaaaactatctgtcggtaaatatgtagcaacactatcggtctatctgtcggcacagatttatctgtcgggaaagacttttgccggcagcacttggcctgacagaccttatctgtcgggaaacgttttgctgacaaataatttggcagcatatagggcctttcctgacagatatgtagtaagcaaacttggggcatggtgtagtgttagtaacaccaaccgggactaaaaacctatttttagttccggttgatgttactaaccgggaaaaaaaaaattaaaaacacactatataatccctattaccgatcctctttttccgtccacacaacaaactcatccctctatctctttctccctctccaactttttatctcttccttatctctaactcctaccttctctttcctttttttttccttccattcgcgacattgtagcacacggctgccgacaaggctgaacaggggtccgcgcggaggcggcctaccctgaatttctgggggatgccccggggctgacttcacggttttgcgggtgtaatgcccgatgtcatgcgaagggcccatcttgagcagcagacctggttcacggggcccctctgattcggaaacccgccgcccttagggcaagcgggaagccactttggcctgcctgcccgcttttcttttttgaattttttaccaacaaaaattattctggaagcatttgatttgggagggatgg

SEQ ID NO: 24696 - DNA, 8724 bp, Oryza sativa
  unsure (1)..(8724): unsure at all n locations
agcagcaaaagcccgcttggcagccgtcgggacagtggacacgggggcccgtacggttcggcggcccgcccggccgaaggaaagaagggaaggcggccagtgtccggccggccggcttttcttttttttcttttttttacaatttatgatttatcctgtgatgtatttgatttgtgtgtgatgggaatctgtgatgtattttttagaatttgtgatgtaattttttacaaggaagatgttaaaataaaactatctacatcctaaaaatataacaatttgtatcaaatagaaaacattctagtgctacaaatttatccagattcataatactagtatatatgttctatctgatattatgttgatgtattataagacaggggaagtacacaccatccattttcacagggaaaatgagaagggagagaaacttaggagaagaagagaatactaatagtttgatggctaaaataaaaaaaagatgaaatggtattaagagatctagtaggcgctataacctaaaaagatactcccttcgtaaaaaaaaaaatccaacttaggagttggatgtgacacaatatagtacaacgaatctagattgtgtcccatctaactcttaagttggtttttttgatagagggagtagacatctaaaagctaaaaatttaaaaaaaatgacgggggagtaatgaactaatgcatgtatcacttgtgtacttgtgtgaagttacgacaaccaaattagggtgacgtgtcaatgataagaacaatgcattatcttcatcagtcacctttcctagacgtgccaatttttctaatgttatgtgtacatagacctaattaaatacttatttatttaagttgctaaatttgtggacttttaattggcattgatttgtcgatcgtgtcactagcttccatgtacgattgaaggcttattaaaagtcacgtcaaattatatgaaaattgttgaataggaggagatggcgaaggcggcgaacacgatcgcggcgaggaaggccgagaaaggaatcgaaggtacgcataccttcttttctccatctactcttcttcttctcgcgaagagtgaagttctgataatatgttgaatagggaattgagattgtgggagcgagagaatagttgtgtactttattaatcaatgcgattatacaggaatgggtggccaccatagacgtgatggttgggaaccatcgtgcccgttgtcaaggagcgccgagaaggcgaggggtacgacacaactgttgtgcgcaaccttcggttaccgatcccatcttttatatagatgtgatcatctatttatttcataacaataataagcggtgaagctaattactaagaaactgtctggttggccattaccgtattttataacaatctgtgattagatattttgacatgcgtgtttgcgttgttgccacaaacatgacaatattacgtttctgtaatataggtcccatatatatgttagtgacttataaaatgtggcatatatcttttattttactggctcaagtgtgatcaggattttgattgcctcacttttgacaagctcgaaaaaaagtatgacaaacctacgaaaccttagttatgaattatacaacccttaaaaccttaaaaccggtaactactagctccgtttaattttttaagatgttttgatttctttccgtatacaaaattaagtttacaataacatagtaacattttttctaaaaaaatcaaaattattcgatgttagattaaaaataatcgcaatatcttataatataaaatgaagcgagtactactcatatgaaattttatgttttctaattaaaaatatgattgatctatgttttctaataaaattaattataataacaattactccatccatcccaaaaaaaaaaacaaaccctggattttcgtaccaacatttgactgtccgtcttatatgaaagttttttataattagtatttttattgttgttagatgataaaacatgattaatactttatgcgtgacttacctttttatttttttttatatttttttcaaataagacgaacggtcaaacgtggtacacggaaaccagggtttgtcttttttagacggagggagtagattgtaaaaacaaaccctgagatgaactcggttaattaacaaatatggaaccagaatccttctaagcttaaggctcaataaatataatttacataattttatttttatcttctaatttgtaaaattttatagtacaattttaatagatatcttaggtcaggagaggggctccagcttcttgtatccacgcgccccgaacagatcgatcaatttagcagctgacagaacaactctcgatttgtcaggcaagtgtttggatcaataaaaacgttagccactgacttcacacgctaaatcaggagaaagcgtgcacgacagcacgagagatatagctagaattcattttaattatattaatacatacttcctctgttttataatataaaactttttagcattacctaaatacatataatgaatttaaacacatacatatgtctagattcattatcatttaaataaatgtgtgcaatgctaaaaagtcttacattgtgaaacggaggaagtaatatactaggtatactcacgcaaacgcacgcgattaacctagctagctagcactgacaattaataaaacagttagagcaagttggcacaggcactactgtttaattgtattttatacggctaaattagttggacgaggtgtattgcgtgagtgatatctgcttccagcttcccagcaattcgccagcacgtacgtttttatataagccatggctttagaaaagattatctatatgtgcgcatctacaattattaaattaagcacattcaatttagttagagcgaaaaaattcagtggtcctgtaggcatatgctaaaatgttggaatttttttttcatatcatgatttacgcatattagatatccatccgcagaatagacgtacacgtaactgaataaataaaacttacattatatatatatacctaaaattgtttttaagtgtttttggtaaatatacatttaagttaattttattgaactagacatatgatgggatcgatctaacttcgattttaatctattcactgtggtactgcctgcatggtactgcctgcattccatattactactccataagccttttttaagtttatcccaagtcaaactttttctctaaggtataaccaagtttttttaaaaaaaaggaatatttttaatataaaataaatatactataaagacgtatttaataaaacttattaatttgatcttatagacgttactacgccttttataaaactcattctaaacgtgaagaagtttaatttaggacatacctaaaacaatttttatgatacggaatggaacaatttttagctgcactgtaggtgctctctccagtcaaagacaacagtgtttcagttgacacttgatcactggtggagaaaccatatttcgtcggtcgggctaattccacaatagtcccggttgcaacaaaaaccgggactaaagatgatctttagtcctgattaaaaagggtaacgggcatatttgatctttagtcccggttcaaatgctgtcagggcctgtcaggcccccccgggatctttagtcccgatcgtaactttagtcccggttggtaataccaaccgggactaaagatctcggcgatctttagccccggttcataacaccaaccgggcctaaagtcccacccctatatatatatatgtcttcttcctcctccagcccgagcaagcttcaaaatttctttaaaaaagaggggaggtcatgccaaaatttctagtgaatttattttggtgattatatacaaatcggaggtgcctaaaaggttagcaacttcatactaaaatgttttttttttcatattacatttggagctatgttttgcacacttttttgtctccaaaattttgttgttagttgataagagagaaaatttgtgtggagaagaaagaatatatagaaatttagtttatttgctaaagaatgttttataaaatagttgagaaggaaaatatagtgaaagttaatattgaatgatagaaaacaaagtaaaatgaaaaattaaaataagtacaacacattaatattagtttaaaactttataaatagtaaatatataattattcggtgtaatatttcataatatttgtatgaataatgatatgtcattattgtgtgagtgttgaaagagtttgtaattattttataattattgtatgactgtcattattgtacgaataattatgtgtgtatgattttttttcatatcatgtagatggatcggcaatggatgtacgctgaccggcggtccaaagagtttattgacggcgtgcattattttttgagagtggccgaagctaacaggcaaaagggttttacttgtttttcatgcaataagtgtaagaatcagaaggagtattctgcatccaggactattcatttccacttgtttgagtcggggttcatgccaaactataattgttggacatcccacggagagcaaggcgttgaaatggaagaagatgaagtggaagacgacaatattccggactttgctcagtacgctggatttgaaggaaatcaaacgggcgaggaggaaagggatgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaagaagagaattcctgctaaggtgatgtggtatttccctataataccaaggctaaggcgtttgttcaggaacaaggggaatgctagaatgatgcgatggcacgctgaagagcgtcaacaggacgggatgctgagacaccccgccgatggttcgcagtggtgaaacatcgacagaaaatttaaagactttggaaaggacgcacgaaacatacggtttggtttaagtacggatggcatgaatccttttggagagatgagcagcggccatagcacttggcccgttacgatgtgtatctacaacctccccccgtggctatgcatgaagaggaagtacataataatgccgcttataattcaaggcccaaagcaacctggtaacgacatcgatgtgtacctaagaccactggtcgaagatcttaaactgttgtggaagaaagaaggtgtccctgtgtgggatgaggacaaacaggaggagtttaacctacgagcgctgctgttcataaccatcaacgattggcctgcacttagcaacctatcggggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctcactaagaatcttgcgtaaaccttcttagcttcctaggtgtatatggaaagtcgaaagatacactggaagcacgtaatgatctgaagcatatggaacaacgcggtgaccttcacccggaaccaaaggagaaaggaagccattacttgagtccagccagctacactcttagcaaggcagagaagaaaagtatgtttgaatgcttggagagcatcaaggtaccgtctggatactccacgaatataaagcgaataataagcacgaaggagaagaagttcacaaatctaaagtctcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattaaaagccctgcagaatgatgtggtgcaatgtcttgtcagctttgagttgatatttccaccttcatttttcaatataatgacgcatctgctttgtcaccttgtcaaagagatcggtattctcggtcctttgtacctacacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctaattcgcgcaagaaacatcggtaagtctgatgcatggattactaggcatcacattgatactttctccacgtggctgcgacaacatctcatgggtaaccagacgattaaccaacaactggccttcctggcgaggagaccatctggctcgatcgcgacattccagggatattaaatcaatgggtacacattctacacgagggcccaagacatgaagagcacgaaccagaacagtgctgttcgtatcgatgccatgggacacgatggtacaactggcacgtattacagtgccatcgaggatatatgggaacttgactatggacctctcaaggtccctctgttccggtgccaatgggttaggttggctggtgaaggcgtaacgattgatgacggtgggatgacaacagttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagccccaaaagatctttagtccccccttggtgagaacaaccgggactaaagaatatctttactcccggttggtaacaacannnnnnnnnnnnnnnnnnnnnnnnnnnnnnnnnnnnnnnnnnnnnnnnnnnnnnnnnaaaacagctgtcattcattgcccacct

SEQ ID NO: 24697 - DNA, 1703 bp, Oryza sativa
  unsure (1)..(1703): unsure at all n locations
gctgcccccccccttgttgatgcgaactnctgctatgnnnnnnnnnnnnnnnnnnnnnnnnnnnnnnnnnnnnnnnnnnnnnnnnnnnnnnnnnnnnttaacgaacgcgaacgaacgtaacgaaacgtttacgaacgcgaatgaacgtggacgaaacgttaacgaacgcgaacgaacgtgaacgaaatgttaacgaacgcgaacgagcgtgaacgaaacgcttacgaacgtgaatgaaacgcttacgaatgcgaacgagagcgtgaacgaaatgattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgtagagggaagcagccagtactggaacgaaggagaggggaacgaggatccaaaccagtacttgaacgaggaggggaacgtggagagggatgcggaggggaacgaggaggggaacgatgaggaggaggctagtggaagtcatccctctgctggacagaagagggcacgcggacaacgaggtgccgcgaagaagatagagggtcagcacatcataactgaggtggacaaagacggccgacctagtgccccgacagaagcagctaaaaattttgtacgccacagcggttgggttgtgagggacaacgtgcctgtcagcatggtgtactggcgca

SEQ ID NO: 24698 - DNA, 1574 bp, Oryza sativa
  unsure (1)..(1574): unsure at all n locations
atgcgcccnttttgaatgacattcagctcggtacccctgaagggattaacaccgagctttgacgtgttcccaaagctaagggatcattgggacgagttcgttgcttacaagacagggcaacaagggcaagtgatgatggccaaaaacaaagaaaatgccgccaagaagaagtaccatcaccacttggggtcaggcggatatagcgtcgcgatgccgaagtgggaggagatggaggctagcttgcttgagaggggtatcgaaccggccaccgctaattggctggaacgatcgaagttctggtactatgctcacggtggaacgcttaacccagttgatggctcccttgtcttcagcgatcagatacgcgaggctgccagtcgactaacggacgcagtggtagccttttttcagggaacattccgacccgacagagagagattccgacccgacagagagaaggatgagctgtcactcgccctatagactcccgagcatccaagacgaacacgagggaaaggcgtgattccctggaagattggatttaaggaggacatccacacatacaggagtcggatgaggagcaagagagataccgaggcgaagattgcagatcttgagtacagggtatcgagctacgagctcagcatgcaagaggaggtggcaaggaaggtggatgaacgtatggccgcacatcggtcctaggatccccagccgtacattctgtaacaccctgaaaattcgaccaacaaaaatcaaaattccaaaaatataggccttcaaaaaactttttaaataaattgcatcatgccgattttattcgattattttattggattttgatttcggagtttataaatcgcgaataatggataattagttaggaataaaccctaaaaagtaaattgacaaagtaaataattaaagtgcaatttaaaataagatttggtgaggatagaaatgtgtaaaatattattacgaccatatttatatccatcaaatttaaaaaaaaaagcaatgggatgagaattaactctaattaaattcaagtaaattacaataaaaatatataaaacatggaataaattaatctagaatgaatccatggattggaatggcacaaaaattgagtatacttcatttatgcaaaatttgggaattaaagaatcaaatttaaataataaatgggccaaaatcgggttaattagaaaacggcactgttcattgcacctaaagtgttcgacgaggtcccctagccctaaccctgccccgctgccgcgccgatgccgccccaagccccgtgccgcccctgctgtgccgcgccaacgtcgtcgcgccatcgccatcgccgcccgtccatcgcgtcgccgctgtcgcgccgcgcgccgtcgccatcgctgcgggtcgccgtcgtcccgcgcctcgtgccgcccgccgtcgcatcgccgctgccgcccgttgcgtcatcccgagccccgtgccgccgcctcgcgccccgcgcccgtgccgtcgcgcgtcgctcgnnnnnnnnnnnnnnnnnnnnnnnnnnnnnnnnnnnnnnngattcaacatggcgg

SEQ ID NO: 24699 - DNA, 17201 bp, Oryza sativa
  unsure (1)..(17201): unsure at all n locations
gctggtatttttaattgcactncgcacccgcgaaaaagaaagagaggagaggaaaaagggagagagagagaaaaagaaaggaaaagggaaaagagaaaagaaaagaaaagaaagagggagagaaaggaaaggaaaaatttagggggaaatttaaaatatttaaaaatattagaatttaatcataggcttaatgaaaatatagctagataaattcttgctatttaaatacctaaaatactagcatttaattataggatcaattatttaagaactaaacaattagatgaattcttatagattattatagattatttttagtaaactctataagagattaattcgcggtagtgatctagatgtaattaaggactagataattagataaagtcttaggacatgactttaaatcacaaaatttcttaagaaacacaaatattttaggtagaagaataattccacttcgcgaataaagtagcctatatagaattcacctcccgcgctcgtttctcaattcggtcattatttggattttgtttgaattctaatcgaattcaaattgttcttacgcacgtaactatagagaccgagggagccgcggatccggatgaagaccaagacccacaagacctagagcaaggcaagtcatcactattccttgaacatgttgatcccaattgcaaaattgttttgtttacaaataaaattgcatgcaatgatgaacatcctacttgtgattatgccatgccttgattattgtttacccttaaatccttgtaaccatgatttacgtaaaagtccctagtcaactatgataaatgcttagaaatgctactctagatttatgcatactcatatttatcaaatgctatatgcttgggcaattatctttgggaaggtaattgagatgcggcatgtggagacatgagcgccacattgccatgatattgatgacatgatttgtgaaaggaaaatgaaactaaacaaatgatttcgactggggcggatggaggatttgggtggtatccggaaaaaggctagtgccatccctggtcaattaaggaccgagccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacgggtggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttgaactacccaggaggagacggtgagacgcatctacgagacacaagccacgccatcatactatggcgcaagcggtacatcatccttcctgggtgacaagcggcgtctcgtgcaccatctcctccggctccgccatctcctcctgcaccatctcttccggttcctccgccacgtcctcctgaaccatctcatccggctcctccgccacctcgtgctgcaccatttcctccgactcctccgcctcctccgcttccaccatgtcggcttgcacctcccaagacaaggtctcgccaagctccaccgcctgcccacacaagggcaacgaagaaggcgaaagttgacgccaccaaaaacaaggagccaccgtacgattgcagtcaagaggagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccattggtgaccggtgaagattttggcataacagaattcattgcagacaccggtctaactgtggatcagttggttcgaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcgaagggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacagagagtgagtttttattgtcgttcgaacaaatttcgttcccatacatatagcatgtacattttcgatcatatatatatatctcatctcacgcatattccagattccactgggtcctgttattcttcgacttggacgcatgcagagtcactgtgtacgactcaatgaataaagaggagaagatttttgacaaggtcttcaaactaatagacaggtaatataatgccatctattccaaagtcgcggggaatctattgctattatgttgatctcaggtaataattaatcatagcttgcaactgcatatgtagggcttgggatcggttccgttaattggtccgcgggacttggaaataaaaacttggacggaggtttcattttccagtgaatacatgcatgatccaaaattatattgaattaatctctaattacagttaatataaagagtatattaaatctctcatcgtttctcatgtagtgtgtaaagcaggaccagggaactaacttatgcggctactacgtatgcgagtatgcccactgcttatcaaaccaaatatgcacaacacgagagcttgatgtacgtatacataaaccattcaaaagttcattgcgtatcgatttgttaagttgtttattaatttcatgtattgatacgtcattatttttcgaatgatagcgtattcacatgagggataatcttccacacaaggattttatcacggctgttcaagaacagccgatgggattcttcaacgaagaagtccttaatcccgacggtgaattctactacgacgaatcgacaattcataacgtcggtccttcctcttctgacatagcgccggcgtcgaagtcgtagctatatatagctaccgagcaaaagaattgtactatatacgcatgtatatatatttatatatgtacacatttacttttgtgttaatatatattttggtaacatatatatatgcacataaaatgttaagtgctttaaattatacatatgtgtatgtaatatatgatttacacacacacacacacatatatatatatatatatatgtatatatatatatatatatgtatatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtcgtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgatttatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatggggagcctaaagagtctacaactcgtccataactttagccagtaggaacagtacaactgaatggtatttctttaattttgtcttccttttctgatattaattttatcggaatatattcagggccatatagtctttgaatagtcatgtttttttatttaccaatcactttttaatatcgagattaatatcaaacattcacatatactcttttttgggtgaaacaaatagtatttaattagagctccctttaaaacatagaaataggaaaaaaaaacataggaaccaagtgacatagattttaaattcctacaggaagataaaccatatgaaagtactttaaggtcccgttcgtttctccaactcatgagttggatgaaaaagaagatttatgtgacacatttttcaaactgctaaacaatacgtttcgtacaaaaactttctatatgaaagttgttctaaaatatcagattaatccatttttcaagtttgtaataattaaaacacaattaatcacgcgttattaccaccttgttttacgtgaaatacttaatcattatcttcatcttcatcttcatgagattcaaacaccatctaaatattggtgtttgattggaacacataagaaacataggattgcaagagacaaaagattgaaaacatgaactaggacctcttggccttgtttctctgaaatcaccatataattgtccatttcatataaatttcaaagaaagtgataggatttaatcctttgtttcaaaggctctcataggaattattttataggattaagaatcctccacttcaaagcggccttcaaattgcactttgatgaatctctaccaatgttaaaaaaatctaacggcctagagaagcacaaagcatatctagatgaattgtggaatgcagaaaaaaaaactatccctagagaattattacagtgtttgtagaatgaataattatgaattacaaaattatagtttggttaaaaacaagaaaactactgagaagcacaaccttaaaaacaaaaatctccatctaaggttgatcagaggatgcataactattgtttgtaccaacatcttacaagttgtatgttgtagttatctttctcaagccataaaaatataatcttcgaaacaagtaagtaaggaagccgtgaagacaattccaggtggtggcaatagtaaaaaaaatatagacatatgagaaacacaatcatatgatgctgaaggttcaatatcacattaaaaaactacatatttaacaaaactacagatttgaagtgttgtatcacaaaactacatatttaacaacaaatttatcatggaactacaaatttaaggtagagtttcacaaaactacatatttaatactatctctgttttttaatagatgacgccgttgactgtttgtcacacgttttaccattcgtcttattaaaaaaattacataattataatttattttattgtgagttgttttatcactcaaagtactttaagcatgatttatatatcttatacatttgcataaatttttgaataagacgaataatccaacatgtgtttaaaagtcaacaatgtcatttattaaaatacggagggggtattaaagttatcacaaaacttcatattgtaaagtttcaatcactagcactgtcgttctgttggacattgtagttttgtaattaaattgggactgaaactatagtattgggataaatttgctacttaatctactgttttgtgaaactttatcttaaagttgtagttctatgataattttttttttgttaaatctatagttttgtgatacaccactttaaagttttgtaaaattttctcatatcacaaattaagaagacaatttgaactagtgatatggttcacaccagtttttcacgaaccatttctggttcactttgtttgtgcactgtcgatggttatgacccctacaattatttctatttattctaaaatgtttcaaatttcagaatacggcgagaagcatccttgatatggcatggaattgtaggggtatgactttattcatcgggttatatatatacaaatataagtatggttttagcatatcaataaattcgtaactcagagatatcgctaatctcgacatggcgatcaacgtgttaagacgacgcacttgcagtttgtgagtgtgtatacatgttgagtcgtaatcgaaatcgaaaagaaaaaggaaagaaaacaattgacgcttactgtcatcacagccattactgaagtaccgatcatgctttctactcattcggagagatcacaaacttttatcgcatcaatcatcatcaaccgatcgagctaatcaccatcaagttaaaaagcgagaggacaataggaggcatcaacaccacaataacaacacaaaagaattaaaaagcgacctctcaaacatgagcaaaatctttttctgtccccttctttttcaggtcatgcaaaagtaaataaatagaatacttcttccgcattagtttaaacttgtatctttttttaagcgcagtaattataggcatacaaatttcttcaccataatataatcatctaaaaccaatttatggcaaaaggaaaaagctagaattaaccgtgccaattattagagaacgcaggtggaagccttaaataggcaagcagtcaggcatttagcagcgcgctgcgcgcagcagtgaagccatagcccaaagccacaagctaaaaattcgtagttgtttttttaataacatcactattaaatatgtattttacgatacggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataccaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcccggcggatgggaggggaggagggaatggcggcggggaggaagaagcgggtggggaggtacgaggttgggcggaccatcgggcaggggacgttcgccaaggtcaagttcgccgtggacgccgacaccggcgccgccgtcgccatgaaggtgctcgacaaggacaccatcctcaaccaccgcatgctccaccaggtaattcccccgcttctcctttcccgctaccctccacatccgcccccgccagtgcacgagtccaaatcaaactcctcgcactcccccctttgctttgatccgggcgattctttttacacttttttttatttgggtgctctccgctgctgctttgctgtttgccaaatggtgagcagccgcgcatcgacgagggcggatggagaatttccgaatatacctcgacagcaatgcgcaccactggttaattcgtgcgagttgcgcgcagctcttgccgtttgatgattaagaataaggaattaactggagagccttaaatttcttgttctcccaaaggggaaaataccttttttttaaaaaaaaaaaagaaaagaaagaaaaacttaattcgagcggtttgtttggtgtttcatctcgtttgggctgacagaagctcagttgcagaattgaaatggttgggtgttgaaagtgattttaccaaaatttggtctgttgtagcttaattcgatttgcggtgtttgcagaaatgctacaaatagttggttcatatggttatccaacgacatcttttgaggatgcatcttgttgcaaagtgctcaagttctctaattatagtggtgtaaatcttttcctaagcttcctgatttgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttgtttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaatatttacttgccatctgtcctatataacttttcattattaacaaaactcctatgttggctatcttaacttcctgtgtcactactttgttaccattactatgattttgtaggttctagctggaaagacgaagatatacataatcttggagcttatcactggaggcgaattgttcgataaaatagtaaggagtctattatatacactaccgaaataacgatgagctgctgttctacttgaactaaaaaaatataagaattgtgccaatctggcagtgtctccatatgtaaattctttttatcacccatatataccagaaactttctgttcagtaaattataggcccattatataatcccaataggcaatataaagaaaggaacatttttttattattgtgcattttcttaaaatatgaacctatgcgatcaaatatctgtaggctcgccaagggaagcttcgtgaaaatgaagcaaggaagtacttccagcagcttattgatgccatcaattattgccatagcaaaggagtatatcatagagatttgaaggtccgttactgataagagacacttggctatcatttgtcctattcactaggtgcaatatctcatgcttaccctttttttgggcatgttatgtagcctgaaaacctgcttcttgactcacgtggaaacttgaaagtttctgattttggacttagcactttggcccagaaagtaagctcagtaattgcttttaatgatgctgtatttctatcctagaagtgttctgattgggatttcttttttgagggatttcagggagtaggccttcttcacacaacttgtggaacaccaaattatgttgctcctgaggtatgatgctctctctctctctatctctcaatgcatggtaaattgaactgtacgaaatgttttttttttggcaaggagctaattgattagctacactacatgcaagaaatatgtctgcaaaattagacgagttactcgggatgcaattcaattttcctagattttctttatagatcatatttgtatgtatgatacaaatgtctgttagactagaaagagattacctatttctttgtttctctacctgtctcgcagttatttggttggttagttctcttcagggttctaaacctcatttttatgcatatttctgccatcatcactaaataaatatctctagctgtcttatttcaccatgttcaagctattgtgattttaattgtctgaactagttcataaaattgtgatatgggcatttcaagccatttccttagacaagattaggggcatttttttagtacatatatgatatgcgctttaccatgtgtcaatgttttaggtgcttagcaacaatggttatgatggatctgcagcagatgtttggtcatgtggtgttattctctatgttttgatggctggataccttccttttgaggaagatgatcttccaacactgtatgataaggtattggcttcattactaatgtgtgcagcataagtctttctttccctaaattgttgatgtgaacacctacataatcgttctactcagatgagattgaaacctgatatgtttactcctacattaaaagattactgcaggtcagttttcatgcccttattggttctctccaggtgctacatcgcttatccacagaatactcgacccaaatccaaaaactgtaagtacacacactaggttgtttcattgcatcttcaagaaacaaatcatcctttatagtaaagtttacctcaagcttccaaagtactcttgtcaccaatttaatacttcagtctcagtctgcatggctgcagaaattatgtgagagaatgcagaaaacaaagactaatttcttcatatcagtgctgccatatatgttacagaaatactgtatacaactatacatgaccagtgacagaatcttgctagaatcaaatctaataagtctaacgcatagatcttcaaccagcatagagtgtttgcttttgcaaattgccgtctccagtttcttaggcctttttcactattttgcagcgtatcactattgaacagataagggaagacacatggtttaagaagacttatgtagccattaaacgtggtgaagatgaaaatgttgatctggatgatgtacaggctgtttttgacaatattgaggtttgtgtatgccattggtatattgccaattgtctgtcacctatttgcttctatagttatatttatacaacttttctggcttcaggacaagtacgtttctgagcaagtgactcataatgatggtggccctcttgtgatgaatgccttcgagatgattacattatctcaaggtttggatctttcagcattatttgatagacagcaggtaatttcatagttccactcttccttttagttggtaacactcttggtatggttgaccattttgctgttggagaaccattagcgcaatgaaatttgaaacgctgatgggtttatagtgtacggagatctggcatgtcagcttatttcatttacttacaaggctgtgaggcactgggtttagtgacggttggtcgctcaggggtttctatcttgtttataataaatgacttaaacgaacatccatttcaattggcgttagtattatgtggaactatattctagccactgtatatggattaaccgactgtagatcgatcccattgtctattctcttttcttatcgcttagtgtactggttggtggcagacggcttctgttttttgccaaatttgaatggaaatggaaaccctgcataaaaggagaaaaaaacatctgattgcttgcttcttagctaatctccatggtttaaattgcacctgtttagtttgtgaagtatttgaccacaccaaccatatattcattctagttgcaatgttctcgtatagcagaaagaagaacccacttttcaatgtttgtgctcttacattagatcttcctagacatgtttagtatgtatttttttattttacgtggaccatacgtcatagtgtgccacacgtcatgaataactttggtgtttgctttatgcattaactgcagtcctcatgaataacttatgttgtctgatgcaactttcatcacatggagtgctcatgttgcaataatgatgggttttatatttgtaggagtttgtcaaacgtcaaactcgttttgtctcaaggaaaccagcaaagactatagtagctacaattgaagttgttgctgagactatgggtcttaaggtccactctcagaattacaaggtaattacaaaacattttcttcaacaagcaactcatttcttactcttgatgtaatgatacttattgctaactcttttctgcagttgcgtcttgaaggtgtatcttcaaacagaatgagcccgtttgctgttgttctacaggtagtcttacattgccctttgttggggaacaacattttgctgtttgtcattcacaaactacatttttcatgctgtcttatgctttgaaatgcatcattcgcaggttttcgaagttgctccttctctgttcatggttgatgttcgaaaggttgctggtgacacactggaataccacagggtctgtctttccacatatcgtcttgtatcctaatcgaatatagtagcatgattgcctagactagttcataaatctaaaaaaatgactgacactgcctgactgacactgataactttcacacaatgtgtcaaaatgctcattcgaaggtgcaacatccaacttttcgtccatccggaacgattgctaactcagatttacactcattgcagttctacaagaacttgtgcaacaagatggaaagcataatctggagaccgattgaagtttcagcgaaatccgcactgctgaggacagccacatgctagcctggcgctaacgcagctgcaactcctgcatcagtgggattttcaggttttcaggttgtcaactcctagcccgtccaccgaagttgctcttgcaggcgctgcatgtaccacatagctgagtcagttcttcagtagatcagtgtaccattctagtttcatgcaccagatgttttggtagtattgttaatatagaactgtagatagtccatatagcggccaattgtgcagtctgtatgtaacatggatatagataggtttcttgtgtagtagtagtaaataagctggttattttgctgccatgaaactggaatgacttgtgaacgtcgaaatgctctcgtgtatgtcggatcttcttcacttagccgttctcaaggatgagagcaattaatcttgtgatataatcctatatgtatttccagggcagaaatggaaaagaaaagggaaacctgcctaccacaacttttaagcctttgatctattgattataatctgaagttaattttgattttttttaatttgattcgtaagaataatcttaggtatatttcgcatctcctttacttgcccttttgactttcttggaaaaaagatatagcaaccaaagtgaggaagaaaacccttggtatcagtttgaaatcaaattctaaaattcaaaatcaaaatcagctttcgacgaaactagtttaactcgtttcgtccagcaacagttaaactagtactcctagcagtctagcagattagcatccatggaaaaaaaaaacccatctttgagtcccatcatgcaagccaggtacatagaatggtaagaagccttaaactaatccttccaatccataatcaaattagtggctgttaccaaattgtcatgaaatttctacctctccatgaccacatcaaccagaaactaatcccatgcatcttttatcatataaactaattgccactcaaatactgcaaccatggaaaaaaaaatcctatcttttgtgtcacatcattcaaggcgggtagccaggtacacagaacggtaaaagaagcctttaactaatccttccaatccataatcaaattagtggctgttaaattgtacttccttcgtcccaaaatataaaaactcagattcgtatactaaaaatatctcattcggtctaggatctat

SEQ ID NO: 24700 - DNA, 2475 bp, Oryza sativa
  unsure (1)..(2475): unsure at all n locations
atcagatcgtaaactaaaaattctcatcggttctaattcttatatttccgacggggaagtagtaagactcccttcattttttaataggcgatatcaataatttttaaatacatgtttgatcatttacctcataaaaaaaaatttatgtaaatatataagattcaaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaagagaggaagcctggtaataataattccaatgcagaccaaaatcagagtcctttttattattccaagagacgaaatggtggtttcgtcacgccagtgacgtagtgggttagcgttgggaatcaaaagccaagtgcatgcatttaacccaatggtgagtgcagggttggagatgtgccagcccataggtaggaagggtgagatgaactagacgaccagagttttagcaaagaccagcaaaaattttctttggaattttgagaggacgacgaatccggcagcgaaacttcatgctctggaaaagttggttcagacagagaccccctccaagattgtccggcttgaagcagctcgtttggaacaaaggatctttcgaatgatggctcctttgaaatataggaatttcacgtggaatttccaggtctttatctttcaaacattgggtcgtttggaatacacgaatttcatgtgtattttatgggggttctaatcttttgaacggctcatttaggatgcatagaatttgtaggagtttcacatgaaggctgtgttttcacgtcagaattgaaagtttggttgaaattggaacgatgtgatggaaaagttggaagtttatgtgtatagggaagttttgatgtgatgaaaaagttagaagtttgaagaaatattttggaactaaacacggtggaattttgcacggatttcattctcagaagggtttgaagagtaaggcggtcagcttcagtaaaattctcaaccaggtgccactgtaagaaaatccaggaaactaattaagcatcactggaagatcttgatctcagtgaaaccaagcagccgcttcaaatccatcaggaaaacaaagcaggcacaacaacacaggcaaaaccgtaagtttcgagctccacttcaaacagagaatcgacttgcatactgtcatactgatacagcacaattgcacaaacaagtgatgacatgattagaactcaaatcacacatcaaagtttaactgaaacaccacattttatttaatctgggaaggttacaaagattacagcattcaacaatctgccagcaaaaccagggatccggagtagaaaaacaaccacacagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggttaaaaatgccccccggaaaacaaccggctttaagacaaaggaagttcaccatgactcaaagacaggacccaagaaaccaactctgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 24701 - DNA, 854 bp, Oryza sativa
  unsure (1)..(854): unsure at all n locations
tcggctttgatnactgatatacncatcgctcgcaacnnnccaaganntatnctgtgcaactagaaccatataataatatatcaatatatacggttcttatgaaattcactttattttacctacagcaacaacgcttaaaacgggtgctgtatcatttaaggattctagttgcattcgagttttcttcagccgattgaactcatgggcttaacggcaacgatctgtaggccttgcaatgcacaagcatattgtaggcccatattttcaaagcacaagcatattctaggcccatataggcccaggacatttttaacgaataattgtatttggaataagttcgtctgaggtctcttaacttgtcaacgaatccgattttcgtccctcaaccggaaaaccagacacaacggatccctcaactatcaaaaccagtgcaaatgaggtccctcggcggttttgagggtggttttggctgacatgatgcctacgtggctaatttgactcggtcttcatctgacgtggtgcttacgtggcaattcgacccgagaaaataataaacccgtgggatccacatgtcagttcacacataagataataaaaaaaatggcgggccccacatgtaattgtcattgtcaccccctctttattctgcttttcctttaatctcctatttttaattttcttccctatcccttttccagcgccacaggtaaggcaagtgctcaacggtgttccaccggaagaggagggaaccgccacgccggccgaagcaacgctctcccatcctgggccggaaaaggaaggacccggcgtatttggtcctggtttcacaataaggtaggcaggacttcacaact

SEQ ID NO: 24702 - DNA, 723 bp, Oryza sativa
  unsure (1)..(723): unsure at all n locations
catactctggttaccatcagattcgcatggctagggaggatgaggaaaaanctgcattcattacccccatagaaacttattgttatacgacaatgcccttcgggttaaaaaatgcaggtcctacttttcaacgcattactcgaatttctttgggtagccaaataggacgtaatgttgaggcttatgtcgatgacttggttgtaaagatgcgcaaccaagagaccttactctcggatctagcggaaacttttgagagtctccgctccgcccgcataaaattgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcgnnnnnnnnnnnnnnnnnnnnnnnnnnnnnnnnnnnnnnnnnnnnnnnnnnnnnnnnnnnnnnnnnnngncgatcatccgaantcatngcca

SEQ ID NO: 24703 - DNA, 8208 bp, Oryza sativa
  unsure (1)..(8208): unsure at all n locations
atgacgccgcttgtagtcnnnnnnnnnnnnnnnnnnnnnnnnnnnnnnnnnnnnnnnnnnnnnnnnnnnnnntctgctagaaacttgtggtatttatatatttttaagctcagatggaatggatagtgtttgtacaattacacatcagtaggtagcatttaatctcgattacatcaaaaaaatgacatggtttgatgcccaaccaactgcattggccattaatggctgggcctaaaatgcaaagctactgtgacaagagagccttgtggcagctgcagcaccggctccccggcgccacggcggcgccgccgtcgacggtgttcttgccgtccaggtacctgccggcgagcatgtcgaagaggaagccggcgccgacgccgacggcgaagtcgatggtgtagtggcccctgcaggcgaacagcctgacgccctggagcaagttgagcgcgtcgtanaagcgcgccatgccgcggcgccccgcgcggcgcatgttctttgcggcgatcaccgcgccggcgacgtggccggagaagaagaggaagaaagagacgttgtcgacggggaaattcatgccggagcccaggaactcggtcggcagcggaagctgcgtggcgcagccgagcgcgccgcgggaggtgaacatcatcatcgcccccacgggggcgcgcgggcggccctcgccgaggatcgcccccaggatgtacgccgcctgcatcgccacgaacacctgcatcgcatcgcatgcatgcagacattggcggcattgtttagttccaaactttttcttcaaatttccaaattttctatcatataaaaattttcttatacacataaacttccaacttttccatcacatcatttcaattttaaccaaacttctaattttggcgtgaactaaacgcacccaggtcaggtcacgtcacgtcacattcatcccagattctgctgctactaccagtcgtggccaaggggaccaggttgccagctagagagatgcagaatcttatcacgaaatccatggatatcgtgaacgcgtgatgcagccattggaagcctttatcgcaaaaacattgggcttttctccaacgattggtttttcccctaccagatttgcctttttcttctgggaaaagtttgagattttcatcagactgtttcttcttcattcaaagattgggtttttcttctgggaaaagattgtggttttcatcaaagattgtttctttttttccttcaaagattgtgttcttctcctgggaaaagattgtggttttcatcaaagattgtttcttttctcctacaaagacttggtttttcttctgggaaaacattgtgattttcgtcaaagattgttcttttctccttcacaaagattgggtttttcttctgggaaaaggctggggttgtgctggtgtgtggattttggtggcgttggtgcagcggcgccatcagtttcgcgtgtgctcgtcgctgtccaccagcttcgtcctgctacgtgcctaactggtcctaaaaacttgtggagtacaagaactacggatatgacgagaacggtgcatagccagctttgatttcttctcaaggattggcagtttctaataaggtggtaattaacctagcaaaattcttttaaggtctattcggatttgaggaatttcacgggaattttggaggaactcaagtgtaccctatgaaaatcatataaaactctcgcgttttgaaggaacctctactgaatagaagaatgcatgatgctttggagtttgttggtacaaaccagtatcctgcttgggccaggtaaatgtatgacaaacctagctaatgtacctttctacatgacagaataattatgttaactgtaaatattactactagtcacatttgcctagtttgtgttttctgaaaccatactgctagagacaaaatttttggttggacgacaaactttgccatagccaaccaatccaagcatcgtatgccacacaaaatgcaaactaataagtgtagcaaagtttggctagaaaccgactttagcacaagtactgcataatttcaagggcctcattaaatacagcttgccaaacagtatcacccaactaactgattagcccctgtattttttttcagctccttcacctgattattatggtaggttttttcttcagctcctttaaaattatgtttttcctcaaaacctacatttgcttacatccttgttttaatctatttgtgctaagttttgtatcaaaatgattaatctgtatgtataactgtgcagattactcactatacttaacctgatcaaataataatctatttctaaccggcctaattaatcggcttaataaaccattggtactgtctaaagtttggcgtgtcaaattgaccgtagctttacggcattgcgcgtaatgacagctattagtgctggcaaggacagatccaagtgaaaaacaaaaaaaaaaagaaataaaagaaaagaaaagaaaatttactgcaatgtgcagaggagcagcaggttcattgaatctggattggtactcaccgtgttgagcgcggcgaggagcgagttgagccatgggcgggcggcgatccccgcgtggagcgcggcggtggcggcaaaaccgaggtcgaccggcggcgcggcgggcggcaccatggggatggtgtactccacggccatgaacagcagcagcccgcacccgaacgccgccgccgccgggtgccgccgaaggacccccgccacccccgccgccgagcaccactccggcctcctccacccacccacctggccgccgcggcggacgccgccgccttccctttccatcgcgccaccagctgctctgtccggcatcggcgccgggtggacgaccttgtcggcgcgccgccgcgcgccgccgttcgcgggcagcaccacgacggcctcggcgttgcccatggaggatgcggtgttgcccgtgaggctggacggcgncggcggcggcatgggcgggggtgggcgagtggctgggcgcgcagcgagcaggtggaggtggcgccggtggacgcggggggcggtcggtggtggcgcacggcttggcggggcgggtgatgcgggggatttttttttttctggtgattttgacgggttttttgtttggttttataagtgaattttttttggtggtggggacgcggcggagatctcaagggtaggaaaggagaggaaagaaaggaggcggcggtggagttaatgttgtacggaaggcggtcatctgctagggttaacggggaaaaagaatatgtgatggaaactattcatgtaaaaagtctgaaaactaccgctaaataaaaaaaataaaaaagatgtataaaatttgtccgtgttattgtaagtaaaatatttactcacagatttacttataagtaataattttactcatgatgacgtggacgaatatcaaaaatttaaatttttgatccaacggtagttttcgagttttcattatataaggtttgcattacttttttttttgctaactgttaggttggcaaataaaagtacttcctcccttcattgttttaggaggatcaaatcttatcctcagattgtaacatcttgtaatagagatagtacagtaccttggccctaaaataacttatagagtctaatcatttaaattcaaattagcatgaggaaaacaaattattcattattaacaagaaagtttgattggttggtggataaataaaagatgttaaagataatatttatataaccatcgttttacgaaagatatttgaaagatgaatccgttgctaatgccctgtttagatcccatcaaaaaaactttacaccctgtcacatggaacgtttaaacacttttataaagtattaaatataggctaaaaaataactaattgcatagattgagactaatttacgagacgaatcttttaaacctaattgctacaatatttgataatgtggtgctacagtaaactcttactaatgatagattaattaggcttaataaattcatctcgcagtttattaacggattcagtaattatttttttattagtacccgaacactccatgcgatgccttatataatacccgatgtgacacgcgcgaaactttacacccctgatctaaacaccccctaaattaataaatatgcttacagttctgactaattgtcaatcaaaatctacaaagtttgacttttcaaaatattatacatcctataatatcatttttttaagaacatagggggtactgtaattggtttatgtttgtccgggagtaactaattgaactccctaatcccattatcaatgacctgtcgattaaaagttaggagaacgaggagaagacgtcgtgaccactgaccatcaccgcggacagtagtgtgtaccgcgtgcgctggtctggcacgcacaagcgaaatctggtgtccccattgcatctctgctactatctcgcgccgaccatccaaacaccggcagtttcccacttttgctgtacaaatccaggtgaaatttccagcacaatgttaccactttcttgctcagttggccgtcggccctacagtatgcctgattctaaatttggattttttttttgtttgcagtttttcaagcttttaaacggcactaaatccagctgtatgtttcagaaaatattttactctgttcgtcctaaaacatagtattagcttttgtcgagatacatatatacctaaaattttgttatatttgagactaacagagtatataaaagttttctttagttttctaaagcaactttttattagttaatttattcacctataccctcatatagcttttttaaaaaatagataatccataaatttttcatatatctcaaacaagactatagctgagggaacaaatgcaatgtttttttttatgcactaaagagacttgtgatgatttgggtgtgttttatgttacatgttttcaactcgtaatatctcgttttccatgcgcacacttatcaaattgttaaatgatatatttatttttttaataaaatatataagaaagtttctttaaaaatcatattatttataagataatttataggtaatactcaattaataatgcgcaaatgagccactcgttttacgtgcgagagagaagttcccaaccttctctgttgaacacactctacaagtgtccgtgaaaattactaggagtgcttaatagtgtaattgctaggagtgtgtcgtttgaatcccaaggtttcatttatatatttttttctgattattatttgataaccatgttccttcttggttgtaaaataagtactaattatggccagctgctggtaggataggtcggtttgtttcagtttgaggtcgatcagggcgacgccgacgtgatatccagatggtccaagcaaatgcttggtcgcaacgggggaaaaccgaacggctgtggcactccactccactcacttgagcacgaaatggcgccacgcttggggcgtgtctctcacgcagtcacgccttctgccgcctgtcgatcaaaggaagggtgtctaacacacaaatcatgcccaagattggcaatcatcagggcagctaattagtaagtaaaagttggtgtcttctgttaattaattgattgatttgatagcataggtgaacatctaaatgttgcagttgggggtgatggcaaaggtcattgtaaaatttcagttgggagggaacaatgatgctaatatgctgggtttaaaattccagaacagtcctatcgaaccttccttccgatatgataatatttcggtcaaatttttttaaaaaatattattttgtgaatttggcatattttgtttaaatttgacctatttttgttcaaaaatcaaataatttcgcattaaaatttccgaaatttcggtatatcggtaccctccgatacaaataccgaaagcgaaagattaaaccctgctaatatgtgcaaaattttacctaaagcctagtggttgttttctgattacatgaaaaacatatacgcccgttactgatacaaatccacaggcttaagaaaatcgagactagcagtaaatccctgaccttatcagtaattcttgccacgtcaatttggtcctcgtggagaaattaatcaggtacagttgagtagttgacacgccattatgtgagaagattaaccaaattgttcgggtcactaatactctcacgatgggaagaagcagcaaatataatccaaatttatttgaggaagtttatggggatggagtgtttatcactgatgatgactccgtcagcaaacgcgcgcttgaatcgaatgaatttttaagatgactttgtgagcttagctgtagattgtagtgatagtctgagcagatagcacggcctatcaagcctgaccaggaatggatccatgttggccaattgacttggaacatctggacttctggagtagtaacattaattaattgactaataacaacttctaagaagtttatttttctactcatgtttatcccaaaaataagtttatttttaaataactattgcatcagagtttgtgaaaaaaatgtattgtgaatagataaggagagaaataattgccttggatttaaaaaaaatgagggtgttgtaatattttgttttattaatatgtgtgtgatgattgaaacataaacttattttgggatatagaggttacgcatagcaccccactgcatttctttcaatatttggacatggagcatgctagctagaccactggcaaagggtattgtccataatataataatatattttttctacttcctccctctatttttggagtttttcatgaagattaaaaaaatgtgaaattgaatgagatatgattataattattaagatgagaaagcacaaactaaataaaatatggttgtaattggttaagatgatggagtaggcaggaaagtttgctatatcctagaataaatctggaattctagaatttgttatatttcagaatagagggatgatttttatgctaagataaaataaaaaaacagtttttatcattggttatttataaaacttgtaatcttatttcccctttttatagttcctctcgttataaatatttagttaaataaacttttaatattttgaccatcaattttatatataataagtttataaaacctaatatatttttatcataacatggtattactttttaagacaagtatacacgtgccatgttttaatcttttttataaaaaaagcactgttattgatggtaaaaattttaaaagttaacagaagaaacttgggaccctttgatttataggattggcaaaggattttcatagaattcaaattcctatgtattttttcctaaatgttcctttgattcataggtaagaaaggaaactcatagtattgtatttatatgcttcacatttcatacaaaaaaaatagtgactgagttcgtttcttacagttcccaactcaccttctttgttttcggcatgcacgcttttcaaacggttaaaccatgcattttttttaaaaaaaattctataggaaagttgtttaaaaaaatcatattaatcaatttctcaagttttgtaagctaatactccctccgtcccataatataagggattttgagtttttgccngccacgccagtgggcttcttttttcccatttacagctccatgcatgcgtaaaccagttaaagtgcacccaatagttttatgtacaaagacacaaaatttgcatgtatccaactcccaaatttaactgcagctggttctggaaaaaatatgcgttccttctgctcaaatatatatcttcctagctcattagcatatagcacttcaaaccaactccgttccttttggggtgccactgataccagctttagctccatataatgtagaggcggagctagagctggagctttgccaaacaggccctactttcacacattcacatatagtcatgaatggctttgcattggccaaaactttggctaacttaattactctaggtagccagattcatggctggttcctatagttgctcccagctgttaactttcatagaaggatcacgtctggggaacagctgcttcggaatttctatttacttcgaatattacgaagcctgttgggtcatttattggctcccaatttgaactacgccattgttcctttatggagtaa

SEQ ID NO: 24704 - DNA, 3363 bp, Oryza sativa
cgcccacattgacagaagtgtcggacaccatattttggttggatatctctttaaacgcagtgatgggtgaagaatattaaaaaaaggaaagggtcttatgcatttgggttttaaaaaaaagagtcaaaatgtttagatcctgctatgtgcagtgttaaaagacaatctttatccccaataatttattataacatgaactagcttttttgatgttttgattcacaaggatggaaagaccagtttccgtccatttgaaagggggagtaattcactgagggactcaaaagtatactgttttgtttgttacagaagatttgtggataagctgtttctgttttcccaaaagaagatgacttgtttggtgatggtgaacatatcgagttaaataaaaaaactgaaaatcccttatattgtgggacggagggagtacttaatcaatcacacattaatgaactgctccggtttccgtgcatgataggagtgttcccaaccgtgacaaactaacacagccgaagaggtgtgatctctttgtgcactttccttttttttcctatgacactatcaattaaagaacttttattgtcatttatgtgtttttattcctataggatttaagaaacatactattgcattttttcctattcttttttctgtctgacgaatcaaagagacatttattttgaatatcagatattcctttcgtcctaaaatatagcatttaatactagtcctaaaatatggctacttctccacctaccttatcatctcaatcaatcacgaccatttcatattttaatttctccactcacttgcttatcgtagctaatgacaatgtttttcatttaattatacccttcttcttaattaaaaaaataaagtataacgataactagtatatttttggatgaaggggtaactattatgatcgtaagggagtattaagatgtacctccatcctagctatacaaatgcataactgaaataacatggccaccattttaatcagacaaagtctcatttatatagatttcacatgagggccaacctttcagtatcattttatttctatcacctaaaaatctaaaacccaacttcccgtgctcatggataataaagaccagtgagcgtagatcgatcaagatctacacttgcatgctcataaataagcacacagttaagtgataaatggttggaagaagtagataggcagaggcaggccggcagctgaactgatgccaaattgacaacgacccgtccttgggtacttcctccgttccgtaataaattcacttttagcttcttttattggtttcaaaacaatttatttttaataaaaataatcattgtgccgaatgttataaaaagcaaaaaaaaattatattaaaaatagataaagtaaaaaataattgcattagaatttgataaagtagggatattatattttttctattagtatgcttgggatgaaaaaaaagtaaacttacttatatttttttgttttctacggcccgttcgattcttctgtaaagagaggattaaattttggatactcgtggcacgttttttaaactgctaaacggtatgtttcatgcgaaagatttctatatgaaagttgatctaaaatatcaggttaatctatttttcaagtttgtaataattaaaactcaattaattacatgttattacaacatcgttttacgtgaaacacttaatcttcatcttcaggatattcaaacaccaccgtaggcgtagtacgtcaaaacactgaattgtacattggactattattggagtgctggttcagtgcaatatacatgtagaagtatctcactcattactccaagatgatttgacattttgtccagctgctattgtaggtgaacccaatgctacagttatgctaggctatcatcgtctgctcgttgatttttgtcagccttaactaaaatttaaagtttaaatacccctatttttaccgcacggttaatttgcacactccaattgcctccaaacattcagttttttttccctattttttgagcagatgttacaagtactagcccatgtaggccgcccttatcttcctcagcccatataggctgcccttctgattctcaaatgaattaggggacaagatgtcaatatctttcagggccccatgattaatgaccatgctataccaacattatggtgcacactattaacattatgggcctaatacagtcatctgtcttggaacaatacccggcctgcaagtagaactgctgtactacttaaacaacttaattattacgataggggctgtctataactagccaaatgcttgtgcgttgcaacggattttcttaaagtatataaaaatattgaacaaaatgggttaatatttctcaacaaaacgtatatattttgtcgttgagcataaaacttcacaaagtagatttgttgaagcaagtatagaagtccgttgccttgtcaacgattatagtggttcaatcatatatacgtgtgtattttgattgcctcaaggtgatgaaaaaatgtgattagtaattattcactccaaaagaaactgatgttgaataggtagttgaatttgagagacatacaggttacaaatcaaacacccataacaagagcccgtgcccataaattagtgatggaggtggtgatgacaaaaccaccacaccactatcaacatttaaaatagtatagatatagtacaagtggattttatatttcttttatgctactaattactcattgtatccattatatgaaaacgcaatgggacccgcatatcaatgaaacatcggttcttctttcgtccttttagctatgcatctggacaagcaaacatataactagtattgtagaaacaagagaaatagaaggcgtaaaatatacgagtggaaaaatacgagaagctagaatctactctcaaacacacgatgggattttgtgagaattctaggaggaccaaattaattcctatgaaaaatcctattaaactcctccatgttctaaagtatcatattatttccttaggattagctctgcccctgtcccattggttatctttttccctgtacctctatgatcatataatcatagtggacgccatcaactcattaagctaatccatccatcctaatatgtagcaacctcatcttagattgctagatattgagacggtgggagtacgtggctccacacatcatgttcccagttgacacacgtagcatctgttattcattcattcatactggagtactcctagtatatcctaaacaaattactaacatatttctaaggtggacaaaataaataattaaatattctctaatagacaattgagagactcag

SEQ ID NO: 24705 - DNA, 4343 bp, Oryza sativa
  unsure (1)..(4343): unsure at all n locations
cgtgatatgaatcgatagaacctcgcacacnaacacacgaaacattgctgacagataggttagtataaaggtttcccgcaaatagaagggaatccttgggtttaataacctattaacctcacctcagatcacatgataatgcagtgggatcctatgctcgtaaacacataatactactacataagagtacttaacaagcaagagaaagtatcagagattccattgggggagagaaaaatgtgatctgaaaagttgggatatcctgaaaattcaacctctccttttttttttcctacctgatatatactcctttccacaaagatgaaaggttgcaacaaaaaagacaggatggaattgaaggagtgaccactgcagcacatgagctggtaaaagttctttggaaaagattggcaagatatgattgcttcagcaatagtaaccggtgcttacctggtggatccaataggactcagaatgattcagtataccaatgaccatactggtgatgcattagcttttgaaagacacatatagttgcaaggacattttactttatacagatcccatcaagggattacaatcatccatccatcagcacagcttaacaaataggagatgcaatgaaactacattatggatgataacatttagccatgcactttctctagttgacatcgcaatattaatatcatatgtacatgttgatttcaaggtgttctgtagctactacattcaaggtctatggtgaggataccctagatagatgtgcacacatttctccagcactccagcttagtgacatatagagctttcagctgtggaagcagatgccttgagtgcaacgtgtgatatgtccaagatacactacttacccagtaagaaacaacaacaatatgttgatcctgtcatcctgacagtttgtatgtacagcatttcttaagttaaacaataagcataattctagccctctaacatgccaagctggagcttaaactttacggctagaaattaaatcttcagaagtttatatagtacataattgtatttcacagttactatcctggcatggcattttaactgctaaaacaaaacacatatatggtaaaaagttaatatgcttttcctaacaacagagtaatagatttccacaagtaattcacggcatgaagagaagttaagaactggtgcgaagggagctattatttcatctttcattgtaaaattcccaatcacattgttctaacacttaacctcggttgtatgttcaatacagatgtgctattctgtaatcaagtcactaaggctaagaaaatgaaaacagataaaataactgtagccgaatagtgtacaatccaacccccagcttgaattttctgcagatagaaatgacatcaagtcagattaccttttgcagtaactaatgctctggtatcagaaaccaaacataagcaagaaagagatagcactatttcatgggaataagttgaaaacacaaattagaagttttgtatcgctaccaggggtaattttattacaaattgtccaaaaccaaagtgattccaatgcaacccattgccaattattacttaagggtaaagtatatgaagccagaattgattattgaaatagaccaaagatctttgaaaagttcttcgataagggtctcaaaaaaaggcggggaaaaggctagagcattcagaatatgaacattaaagatcaccaccactctcaatagtttaatacaacaatcttactgataatttaacctagaatccggattataaaaggttatccataatgtgtgtcctagtgatctattaaaggagttaattggcccatcacaactggaagacgtattagcatttaagtaatgataaactcagacaggtatctcattattgtcaacattattctgaactggaaactccatgcaattttatttgaaaaaaccgaaaataagaacaaatatagggaagaagtgaaagcatacaaaccacaatgaatgctcacacaaggatattagtcaagcacagaagtatcatctaaaaatctagaccaacatgatccattgtgcaactttctagtttctaataccaaaattcgtttgatactttgatgaggatttaagaaaccaaaattaggattaaaacctatcatacgttttcctgcaaaataacactggatgattaaaggcccagcaaaatggttgggacatgatgttgcctggaaacatgcaataaaatcagagtattcaatagttctatgttgtatgaaatgaccgtttttaacaattgagtagacatatcctcattttaacacaaggcaagaatgatttaacaagaaaatacagaaaaggtgtagacaaaacaaaagattaaaaatgcagtccttaccctaagagacaagaagtacgagggtgcagatgaaggtaatagaccctcataaccaatatcatatgcaatccttccatcagcattaaacagcccatagtgcctctccgagctaggtccaggcttcgaattctcattaaacaacgcaaagatgtatgctttgactggtctctttggcttgagaggagttcctttcctcagaaagagcctctttcggaggttgaaattgtaagtccttgcattctcaactgaagctcctgcctcagtttgatctccactagaagcccagccagtctccgctactcggacctccatgtctctatacccagcggcctgcagagcagcataagctgcatctatctgagcatcgaacatgttatcataatgcagactagtattcgggtcaacaattccaggattgggcttgaagagagcgtaattaatgtcaatatgttctggatcacttatgtaggccaaaaagggatatgcgttgacatagaaaggtgagccaatttgttgaaagaagtccagcagtggtttcatatacaccatgacatcttccttgaaaacacatgcagaaggtggatatgaagtagcaaaaacagcttctgagtgtggtgtgaatagctcaattttgtcttgcaagtgaaatttcttgagtccattatagacattcttcacagcttgaacgaggggctcggccaagcttgtatcttgacctcccagcacctcatttcccacagtgatcccaactatgcgtgtctgaggaagatagggctgcacattctcattcagccagtcgatcgacctgctctcattcgccgcaaaatccttcacgagctcattggggatggcgataaccagattgagcccagatcccttgaatgcatcaagaacgctgtgatcggaatcgtatatcttgacattccttatctttgaagctctcaggagttgtactactttatccggagaagggatgttgtttgctattctcccgtagtttatcccatagcccccgggaaacgcttccacggctctaggaccttgtcacaacaaataccaacaatcaaatttcatatcattaataccaaatcaaggaattatttttttttctaggcatcgcaatcgaaagcatgaaaggctcaataactggtcaagaaagagaattggcaagagaattgagttgaattggatggaaagatgggaaaaaaaatttcagtaccatgtgaagggaaggcgaggaggaggcagaagagcagcagcatccagtgagcacgcccgctccgactccgactccgacaactcatcatcatcaacgtcgccttcatagcagggacaccacaatccgcttcacagccagaagtggtggtggtggtagcctcagttccagggcggggcatggcgccgcggcggcaagttccatagacggaccaccgctccgccacggccgagcacctccgagcaatcttggcccgccgccttctccacggattcaccaagaacggtaaagaatccgcaagaaccggatccctcccgccgccgaccaatcaaccaacgcaccaccaccaccaccaacaacaacaacaccaacacgaaggaatctcgattcccgctcgttatagtccacaactcctcctcctcctcctcctcccagtggtaagcacacacctagtcacaactccactcttctcgcggactactaaatataaccaaccaaccaagcgaagcagcagcagcgaagcaagcaagaagggtggggttaaggaaggattaggggggtttgcttagcggggaggagattggggggggggttctatttggatggattgaagaggaacactcgcatggcttcaaataatatcttttgtgatgatgactatgaaagccatgccattccaggtggtgaggccacctcacgatttcaatgggtttatttggggctacaactgcccg

SEQ ID NO: 24706 - DNA, 18662 bp, Oryza sativa
  unsure (1)..(18662): unsure at all n locations
cgctcccccggtcacaccggagaaagaaggggagggagggggggtttggaaattttnaaacccaacaaantnnntnnngggtggtggtggtgcgcgtgtcncggggggttgaagaggacggcgtttgcgtttcgtttctctctctctctctccgtggcggttttgcggatcgccccctccgaggacgcgtgcctctctttgttgcagtttcttctcttatttttattcccttttcctttggcagttttttttttaaagaaaaaagagggcggctacaaaacgggatcccgttgcaacaggataggcatattaactattctcttgcacgagtatcacgagtaccaggtcctaggtatcacaggtatcgggtatcatgcagctggtaccacaacaggtatcaagtactgtctcatagaagggtatcccgttccaacggaataccgttgtctaggttttctgtttttttttttgggaaacacggtataacgtattcaatctatccccgaataacccaacctgagtgtaggtgtgacataaggacacctccagcgcgcagctaaaaggaggcgcttataagaaaaaccggggttttttttattaccacataggatcaatgagacgcttagcgcaggaagccgctgcttcgtgcggcgccgacgcttgggaggtgtttgcacgggtgctacagatggaacctattatttcaggcatcagtccaactccctagcattggaccatcaggctcttgagtgaagtgcttagtttaatcatatttttaagcacctccttaagcatgtacttagcgttggaggtgccctaataacctagtataataaatccgaacaaaggatcgttcattgaggttcttttaggatagaggaagtagaaacacagacactcaccccaataatttatattcgcctgagcatcttcgagagactggattgatatattttaagattgattattatttttagttgttattatccatgttacacttactcgctatactgaccagcgtgtgaattttaactcaaatgtatgtatgctattggattatgggttaaagaagatgatgtttggaatttgggtgcagtaggtcctgtgaaactttggcttcagtaaaactggggtgactaatgactatcgaagtgtgttttttactctctcttttcaacttatattccctcgttgtagatgtgcacgctttctaaataggtgctaaatagtgtggctttagaaaatcgtatcaatacatttttaagttttgtattaaatacttaattaatcatgctccgttttgcatgttgaaggaaaatggttcccaatccttagcttcaaacacaattgttgtgtacaaaatttgcatcctctaaatcaccacaagccatatgcatgctgatctatgtatacgtgatctcatgccttgtataagacctaaaatacgtacgcacaaaatatgttttgaaaatatctttattggggctagtcgaataacttcaggagtaaaaattatcaagtttgtcactaggaaatttaaggaacatccttaaggtttatgatctcacaaataatgccaccttaaatagaatgttttaggctcattgaaggaatctcatgaaatgcgtacggaactatagtttgcagggttgctggatgaatagacaccctcttactagacggctaatgagtgggcccaatgtatcatgcgttcattagctcatcatgtacaaggttataatgaccttttaataggcgtgtgaaaccaattttataacggagaatgaatgctattgtgataaggcgattaaacagtatccacaattagtgcttaaactttaggaaaaagaatatttatcatgtaagcgtatctatgtcaaaggagtaacacgcttatggcttttcaagtaggttttgatgaaccccatggcgtgttgatccacttaaaagctcaatttgtatggtgtagtctcaactttcctgtttccttagctcttgtactatatgcttattggtaagctaaagttgttgtgctatggtgaggtgtttgctttaggcagtggtggtcatcactcccctaaagtctcctttaacaagtggctttgcaaagggaatacttgactgagaaagactcaaggcaaacggtttttacttcctttttctttctttcaggcacaaaactacacaatgagacaaacgaggaggaaaccaacaaatattctcagccttttctttttcaaggaatgaaatggcgatgaatgtgcgtgtttaccgaggttctaaacgatgtattttttttaaaaaaaaactttgtatatacaaatttcttatagaattgttttaaatctatatttttttaattatatgatacttaattgattcatttataccctcgaataatgatcacaaaccttgcattcagctattcagcataaaaattaaagaacaaaacatactcaagttctgaacttaagatgctataatacaatgttgagatctttttcgcctagttctatactacaagctagccaattcttgttcttgcttcacgaagaagggggtctactgaagtcaatgaagtatatattacattcatactactcatgaaagttgatgacaggacacacaaggatgaaaacacacaaaatacatgctgagttagcatatcatcatttcctcactctgtactgctggcagatgagtcagtgccaaaacgatggcactgggaattggatgttgtgtaggggcacatcagctttgatccctctcttttgttggaaaaaaaggcaactttaattagggtaaaacgcttggctttcttcttaactaggttagcctctatggtgctcttgctttcagcctttcaggggtgagtaatcaagcacaagaagatccacagcaattggcagcatctctgaaagattgggatcatccgagtgtcatggcatacatgcttttttagacttgccgtagttgcaccaacagtagatgataattctccttaactctttaaaagatggcaatatcaaaaagaaaaaaaaatactacgggttaccataaaaggaatcatacatgtacaatatcatttaacaaaagtaaaatctcatgactgtatttagttgtggtatctagaaagaattgtcaaaagagatacattgtcatctgatccatcctcttattcttgtcatcgaagtttgctctgtttatatatcgtgaataatacacacatcattttttccgctcgtgaatggcatagctttggagctaagaattttttgttaaagctaggatatggatatggatattttaatgacttgctaaaggtccatgtattgcaacggataagcaatataatatagttagttattaggcatataacatcaaagcaaaagcattcatgtgtggagatcttatggccccacacattagcttgtgacgttggagacggattcggacgccaccactaacatcatttaaagtagtatagattgtttctatttttaaaaaaaatacacaaaaatttaaccactgcaattcaatttataaactttgaatccaacgtaaatctaaaatcgatctaaggttgtgctaaacagaccttagacacgatttttttttctcattgcacatcaaattaaaaaaataaataggaacaaaagggataattagagggctaaaacgaaattctccaccctttcacacattcccctccccagtgatcagtcgcaaaaccctagttggcaggttgctttgactgcgaccattgcaccttaggctgactggtaccacgaagctttctgcaaaaaacggagggcccagagacgacggagacatgatcacgttggaatcagcatggggtgcacaagaatttcatacctttatgtcaatccgggacccacccaagacaaggatctaggatctgctgaagttatggtgaaagatatagtcatcatcacatgaaaacgatgcattatattagcgggaataaactcattattcctgggttattcacagtacttcactagatcacgttgttttgaagtattatattgatatagtctttatttgaagtacaactttgaccacaaaggattctttgaaatgcatgaattttacaggatttttataagcaaaggtccttaaagaatccctcattacaaagtaggcctaaatcctaattcatgcaataacatatttatatttataaattccagttaacgctgtaattacataaatatacttttcaatacaaacctaccattagccttttgtgtatctaacataaataatttaaaaaactatagcaacatttaaaattttgaaagtttgagttgtgtttgatagttttagtgtgggagaaacgaggatatcctcaaaaccatttcttgtatagtttaagtttacctttgaaacgcacaaatccaaatacacatgaatagaaaaaacataggtatcaacaagagtcctctaaattgcaggaattgttgaaacgtgtttgttttgatgctttataggaaaagtataggatttaggatatgagagagatatgaagaatgtttcccatgaggtccaacatcacattagaaatcctcccaaattttcataaattaagctattccaaattaagctattccaaaggaattttgtaggaatttcaaatggtaattcccttgttccaagggagtatcggaaaattttccatgggatttcaattctaattctaaaaagaacatgtatttttcctttgttccgaagcagccctaaacaatttaaatatcgttgttaggggcagtggaagttctggtggaaacatagaaaaaatgcgcataaagctgaaaaataaatactttacttgatatatagaagggataatgagtatagctgtataagttgtctcaatccaggtttctctgccatcctagggagcgttcgttcgagtgagttagcgtgagaaagcacatcgtagtccgcgcgcacgcttcccaaactactaaacggtgcgtttttggtaaaaaaatttctataggaaagttgctttaaaaatcatattaatccatttttgaaatttaaaatagtttatactcaattaatcatgtgctaatggctcacctcgttttgcgtatcttcccaatcttctcaatctcctatccctcaaactcacccttagtctacattatcagtctaaaagaaaaacacattatatgttgtgtacaactttataaaagtgcaacgcctagtattggaattgatttcctaaacctcccctgcttaatctcagtagttttcccgcaaaaaagaaacattaagcttaatattttgtatacctatttgtttattacttcctccgtttcataatgtaagtcattctagcattgcacacattcatatagatgttaatgaatctaaacatatatatgtgtctagattcattaatatctatataaatgtggataatgagtcttacattacgaaacggagggagtatgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggtcgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgttgcgcctgcttccggcggaagtggaggtaggtatgggccgtcccatcagaaggtcattcggacggcaaccatacaagtctccgtctgtttatgaaaagataggataagtccccccaaaaaagagagagatggtgcatgtggtatccccttgaggtataaaaggaggaccttgcccacttagaggagggattttttttggatgattttagaggggatcgagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacaccgagagcttagaatctcacccagggcccccggccgaaccggaaaaggggggcctgcacggtctcccggtgaggagccccacgctccgtcatctggcgcgccaggtagggggttctgcgtgtgttcttctaagctctcgcactctttcgtgtgcgccaagcttttcctgttcagcccaatggctgaacaagcaaaggcgcacaacctctctccgagtgttagcggtgacgaaggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcatgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggcggttgctcgccattcggccgccactccttcgtcaacgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacatgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagtggttctgtcaagtccgcaacaccataccatgcatccctgcacacgcggtgatctacgcgttcagggggggtgtgcggcacaaccgcatgctcgaaaagattgcttccaaagagccccagactaccgaggagctttttcagctcgcggaccgagtggctcgtaaggaagaggcatggacctggaacccctccggttcaggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaaaaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgctgaggacatcgatgacggcgatgatgacctaggtttccaagagcctggggccaccattgccactgtcgatgggggagcgtgtgctcacgtttctcgtcggagccccaaggccatgaagcgagagcttctggccgcggcccctactcatgaggcgacgcgccgggcacggtggtcggaggttgccctcaccttcgaccagaccgaccacccaccgtgtgttgcccggggaggacagatcgcaatggtggtttcccccactgtttgcaacgtgaagctggggcgtgtcctcattaatgggggagcagccctcaacatcctttcccccgcagcctttgacgctatcaaggccccggggatggtgctccggccgtcccagtcgattatcggtgtgacgccgggtcacacttggccgctaggtcatatcgacctcccggtcaccttcggtggatccgccaacctccgcacggaacgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccagattcatccgcgaggtcatccatccggagtggctggcgaacccagtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgcattactcgaatttctttgggtagccaaataggacgtaatgttgaggcttatgtcgatgacttggttgtaaagatgcgcaaccaagagaccttactctcggatctagcggaaacttttgagagtctccgctccgcccgcataaaattgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggaattggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggacaaagagcgccccagggatgtggcccctagcgaagaggatcggccccaccgaaaggtgcagcggcccgtctactttgttagtgaggccctccgggacgccaagacccgataccctcaagcccagaagatgctttacgctattctgatggcttcgaggaaactgcgccattatttccatacgcatcgggtcacggtggttacgtcttaccccctcggccaaatcttgcataatcgagagggtactggacgggtggtgaaatgggcaatcgaactttgtgagtttgatttgcactttgaaccacgccacgctatcaagagccaggccctcgccgattttgtggcagagtggaccccagctcccgagcccgtctcagtccccgaggccagctcgggcccctcgcagctgcctcacaccgcccattgggtgatgcagttcgacggctccctgtctcttcagggcgccggtgcgggggtcacgttgacctcgccgagcggagacgtcctcagatatttggttcgccttgactttcgggcgaccaataacatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcacctttgaagaaaggcttgcccagccgtcggcgcgacccgaccccttagaggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcaatgcagagcgtgtcaattccacgccaagcaaatccatcagccggcccaggccctgcagatcataccactttcgtggccatttgctgtctgggggctcgatatcctgggaccatttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacttgcccaccccagaagcaacggccaagtagagcgcgccaatgcggaaatcctcagaggccttaaaaccaagaccttcaacatcctcaagaagcacgacgattcgtggatcgaggagttgccagcggtgctctgggcgaaccgaaccacgccaagccgagcaaccagggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacacgtgctggattgggcaagctctcaccaatgtgggagggtccgtatcgagtgatcggcgtcccccggccgggctccgttcggctggccacgggcgacggcacagagctgcctaacccatggaacatcgaacaccttcgtcgcttctacccctaaagggtgatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccctggggcgtggtgaactccggggggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacaggcatcctcgtctcatacacacaacaaatagaattgacacaaaaaatttcctctttatttgattgcagattaaattagtctatacaagaagggggcccggaggcctcggaagaagaaaagaagaaactatttaaagattggcgggggcctgggggctcactccgatgcacccgggtcgccagcctcgtcgccactgtcgcccactccgccgtcatcatcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgtggtctagacgggagacggcgtcccgaagcatgccgggccctacctcgcctgccaagcggagggcctcgacctccccggcggacgagtctagcgcgccctgcaaatcggcgatggtgtgttcggcagctgcgaggcgggcggttaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcagcacaggcagcttcgtgcaccgccagtgtgacctcccgaatagcaacggcgacctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggacccctcgggcggcgtcgagttttttccctagctccgcctcccagctcccgtattgaaggcggagggtgtcctgcgcctcgttcatcacggtggtggcgatgaggacagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaagcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcacgagttgcctcggaagtcgtcgtcgcctcggcctggcgaagtctggcctcctcccgagcggcttcttcagcttggcgagctcggacggccacctgggcaacttcctcggcttctcgaaggcgatccacggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcagcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccacgggatggttctgtcccccccatcttgcggagccgtttcttcttccgctccccctcgggctgcgacgtcggcatggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccaaacaccatggcccctgtgagcccctgggatcgcaggcccgccaggcggtcgaggacggcgtcgtagccatctcccagatctaccggcgcccgccagttggaggcctgcgctggaggctggctcgaaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcagcagcacgctaccgtcaagcggagtggagccccgtgccatgatgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctctaggaaaaacgaaccggcttgtcccgatttttggaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggtcgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaggagggattttttttggatgattttagaggggatcgagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacaccgagagcttagaatctcacccagggcccccggccgaaccggcaaaggggggcctgcacggtctcccggtgaggagccccacgctccgtcagatggcgcgccaaaccatgtcaatttatcgtatcctcagtttagttactagtncagctttcacatcctangtacaccgaacaatttagtcngtggtacctaccatcaatgatcaggnccacttgtaatcagatgaattgatgctgcnatcataccangattagcaatatactagcacggccgagattcccttttctcangcctcagacacaaggcatgcacgacgggacgtggtttcaccccctcgntttagtcctttttttcgacgcggattnacaacgggaanggctcagtggatcactataaaccatagccgtgt

SEQ ID NO: 24707 - DNA, 794 bp, Oryza sativa
  unsure (1)..(794): unsure at all n locations
cacgcgttgtgntcaacctactatatacggcgaattcgagctcggtaccccgttgagtcaacaggtgagatccacatatcagcgacttcctcttcatctcaccttcttcctcttctctcccctcactctcctcccctcttctatccctccctcctccccttccgatggctccatcggctcctgcaaaggaaagggagaagtcccagccccagcaaggagagcggggggaaccatgttgagaaggtagtggagataggcgacaacaacagggagagggagccactgcacggggaggcgctgactctgactcgcctagagcttgccgcgctggcgatgatggcagatcaacggttggtagccatagaaaaaggcgaggggacgacagagaggagcggtcaccgccatcaccacggagctagtcctagaacctcggccagttgcggtgcacctcattccatccatggagggagccctacctagcggggtaacaattcgtgaagacgaaatcgttgttggcgccgagcagcacggctccgaagaagacgaaggagacatcgaaacgtgcaaaacaagagttatttggctctggcagctggtggcaactagggctgtcaacaagccgagctcgacacaagctttagccaagcctattacacctttgagcttttaggcaagctcggttcgagctcgacctcagccattaataatatnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24708 - DNA, 787 bp, Oryza sativa
  unsure (1)..(787): unsure at all n locations
gtggcccnnnntttgatgaacggcatnnnnnnnnnnnnnnnnnnnnnnnnnnnnnnnnnnnnnnnnnnnnnnnnnnnnnnnnnnnnnnnnntgtacacaaccttcctacagtgcttaagatacgtactttctgtttcatccatacagtgagtgcaagctttgtaccccttgttggactgcccggataggttgctaagtgcaggccaatcgttgatggttatgaacagcagcgctcgtaggttaaactcctcctgtttgtcctcatcccacacagggacaccttccttttttcacaacagtttaagatcttcgaccagtggtcttaggtacacatcgatgtcgttaccaggttgctttgggccttgaattataagcggcattattatgtacttcctcttcatgcatagccacggggggaggttgtagatacacatcgtaacgggccaagtgctatggccgctgctcatctctccaaaaggattcatgccatccgtacttaaaccaaaccgtatgtttcgtgcgtcctttccaaagtctttaaattttttgtcgatgtttcaccactgcgaaccatcggcggggtgtcttagcatcccgtcctgttgacgctcttcagcgtgccatcgcattattctagcattccccttgttcctgaacaaacgccttagccttggtattatagggaaataccacatcaccttagcaaggaattctcttcttcggtagctgcccgncaacttcttctggatcaatctcgctaaattttgtatcggaatgctttgaaaac

SEQ ID NO: 24709 - DNA, 794 bp, Oryza sativa
  unsure (1)..(794): unsure at all n locations
gcggccttgaattgnnnnnnnnnnnnnnnnnnnnnnnnnnnnnnnnnnnnnnnnnnnnnnnnnnnnnnnnnnnnnnnnnnnnnnnnnnttcctcccctgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttggttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaatatttacttgccatctgtcctatataacttttcattattaacaaaactcctatgttggctatcttaacttcctgtgtcactactttgtaccattactatgattttgtaggttctagctggaaagacgagatatacataatcttggagcttatc

SEQ ID NO: 24710 - DNA, 680 bp, Oryza sativa
cctactggtgcttgtcatcatgcatcaatagttttattttcattattcatgattgtgttctcagttttttttttttaactcccaggctcttttatggtcctcaaggaccatattccttgtttgctgggagggatgcaactcgggcccttgcattgatgtcgtttgaccctattgacctcactggagatttggatggccttggtccagacgagctagaggtcttgcaagattgggaagataagtttaaagagcggtatcctacggtgggccaccttgcttcagaaaatgcagcggatggtaaccacggtggcgcagcttgatcacgaggaaggaatgctttactccatcggcttgtcagtttctctgttcttttttactggattgcaagtgggtagatctgatcatatgatgctctggtaggctctgttgcttgtgtgctgtgtcgtgcgtgactaatgtaccagctttccccatctgcttttattttggtttgcagtggatgaggaggaaattttgagcgacttgactaaaaacttgagctgtgactctcttgagtgctcagaccatgtgtatatgctttcaagtttatgccataatttgcggcttacttctcgcaagtcgcaacaattatcttgctggcagctaaagcacgccatgatttgccaaccatacttaagctc

SEQ ID NO: 24711 - DNA, 1064 bp, Oryza sativa
catgcaaaatatggagtgaaaattaggcacattgtgtgtgagacaattacacagaaagcaatatcgattcataccgaaaacgccagtacatatagtagcgtgaatccgatcgtatccatctcgaaccggcttatagaatcacaatcgggagaggaaagcgaagggaatcagcataagaaaccatctagaatataactctaacacccccccgcagtcgcaacgtcagaacaacggacgttaagactggatcgaaattcattaaaaactggactaggcaagcctttagtgaatacgttagcgtattgtgatgtagttggtacatgtagaactcgaactgctcccacatcaactcgttcatgaacaaagtggagatcgatctcgacatgcttcgttcgttgatgctgaactggatttgttgaaagatatacagcactgacgttgtcacagtaaactaaggttgccttggagggtggagcatataattcatggagtaattgtcgaagccaagaggtttctgctactgcattggcaactgctcgatattctgcttcagcactagaacgagatacagtattctgacgcttagaggaccatgagatgagattgtcaccaagaaacacagcatatccaaaggtagatttacgtgtgtcgggacaaccagcccaattcgcatcagaatatgccatgagatcaaaggacgatgatcgttgaatatgtaaaccatactccaaagtgccacgaatataacgtaaaatccgtttgagagcagtaagatgggactcacggggatcgtgcatatgcaagcaaacttgttgaacggcatatgaaatgtcaggtctggtgaaagtcagatattgcaaagcaccagcgagactacggaaatccgttggatcagagacagacggacttccttcagtggagaacttggccgaagtgtcaacaggtgtaagacaaggtttgcaatctgacatgcctgcacgctccaagatttctagacagtattgtcgttgagtgagtaacaagccacctgaatgaggagtaacattgatgccgagaaaatgatt

SEQ ID NO: 24712 - DNA, 6878 bp, Oryza sativa
  unsure (1)..(6878): unsure at all n locations
tatagggcgaattcgagctcggtacccatccttttcaggttagtgtgaaaattctaccactatccatgtgctaacaaagtctgcacatctatctcgaactgcacctctctcatagtttagtggttttctttcacttgtttatacgccttcctatgcccatgtcaagaaatctgaagacagtatgtaacgttgcaagtggcaacttctccgaaagacgagatttatgtcctatactttgcatctgggagactgggagtatgaaacgcttgcctcattgtcctaaattgatattgctcggatatgaaacgttcagcaacagataaacttagttaaattcgaaagggtgcgtacgtttagaaaacacaaattgaggccgtgtttagttccaaaataattcttcaaacttctaactttttcatcacattaaaacttttctacacacataaacttccaacttttccgtcgcatcgttttaattttaacaaaacttccaattttagtgtgaactaaacatagtccgaaacgatctttttgtttgtatgttttctcttttttttttccgggcgtaaagtcgtacttaaggcaatagtagcactgctttgtttacccacatgcagcgcagtctgtaaactgcatgcatgcagcatgcagcagattcagacttgcagtacgtggaaagtaacaaagctccgtttgcgagctggactagtgaactgtgttctttttgacttctcagagaacgatgaactagtaggcatttgctctttgagatctgcttcaacagtggagatttcttttcatagttcgatgcccaatagtgacactgatggtttactgtttgcaaactgacggtgtttttatgcttgctacaggcacctgaaccggtagtgcagtatgtgccgcaacaggagccaaagaatcagctccggcgggttaactcggccgacttctgaatcatgttaatagtagaagtaagctgccctggaattaaaggtggttcaagctgtaactgccatgttgaaaattacttagctagtaagaacacccttttctctgcagtctccagattgttgggtgctgttgcaagagtgttgtactcctaacttgtggtttatgcagccgcagcctagctttcctcccgctggtgcaatgctttctgtagcctgtgattgcaagagtgccccagataaactgtaatgttaccgtattcaaaatgggaaaatggcaatgctagtccaaaatcatactccaactatttttcgcacaccttgggagtgtagacaaagcagacaaaattcaggatagtttgttttgctgaagaaaaataacagaaactttattcaattcaaagctgagatatgatctatacatcattcttatcttgatttataaaggaactggattaacataagtcttcactactgatacatcaactgctgtcagcatcttcttcaggcagtatcaatctaaggtcctcattgtccctgtagacttgtaccaaagcggcagccttgtatgcaaagaaacccatcattcctggaacaagctgtataaggaggagaaacagttgctcaggacatgttagggcaatttagctaacaaagttcaggataataacccttgctacataattgtcacagttaacaagggagataaatgaaatgcgtgtaattcataagatggagttgaatctgatatatgcactgcaatagctcagagctgtgcttatacctcaaaatttaaaatgctattttgaaagtgatctgacaaggttgacaatccaaaaaatatagcgggtatcacaagccttggagacgaaagagctactgaaataccacccaacaccttctctattgtattcttcaaatcctcgcttcttatgccgattctagcattgtcacatatatagggacaattaatgacaaagtgagggcaaaagattgataataaaaaatgattaacattttcaaacctaccttttcactttcttcttcataaaaatttctggaacatctttctttgacaaattatctgtgtgccgatagagaagttgaagatacaagcaactgttcaacataatgtgactggttagattattttttatcgttgatagttgcaatagaagttaacccagtctgttgagagagtagccccagcgacattatattgaaacaaggtaccacaaacttctgagttcttaagttcaataggaagcaaattgagcttacctgaaagcaactccaaaagcataactgacagcagcctgttcaattggagcgttacagattcagtcacaatcagcaaaattatagatagagttaagccatttgagctcaggagataactttgattctgtttcatatcggttggttatgaagttagtggaacaggagatggcttaatgttgactcacactaccacaataactcgaaactacttagtcgttttaacgtcggcaaagagtaatgtctaatttgatgccaattataaatttgaaaaatctatttacctccagagaaaagactaggagacagtataaactgcacgcagctccaattcctgtggtcaggagcaatagttcatccttaagctgagagagattatgattgatgaccatcagttatgggatgcaaaagcttcactgaaaataattcatcagaaaaaagaagcacaggagagctgaaacgaaaacctactgcttcatatcttagaaggttgagttccttccttctttccttctcatcctgccgatcctgtcatcgtttgcaccagcattaacatttctctacaaattgcttccacaaaaaagatggccactagccaaaacaatgaacaattgagcagcaaacccagaacaccatgacagacacaagactttggcagaaagcctcttgctgacaggaaggctgctctcaccggagacccaatctctcgtcgccgcaatcctcaacattccctcgcccatgacatcctgtacaaccggatgattctcagtgttgctctgcaaaaattacaccagacaaaacactttgaattggtactatacatcttacagcttcttcaggttgcggtggtgcgacatccgctgaattttcttgttccgccgccgcctctagcacgccgaggtcgccgccgttcctcctccagaccatgtcggagatcttggtgacgaagtcgccgtgcgcctgcctctccgcgaggaacatccgcaggacctcctccccgaggctgtccccagctgctagcatcagaagcagaactcatggaatcagcaccagccaaaccagaaaaaaaataaaccccgaatttgttccgagaacactggccgcgagctagaagtcgactgctactaccttggagggaggagtagcggagagcggaggcgcgcggggaggcgcgggcgcgggcggggccgagaagagggcgcgcggccgcggcgtcnaggccgcggcagcagcggaggccggggagccccatagccatggcgattccgagcaaagctgttcgctcggtgcggctggctataagccgattagccgaggcctctcctccgtttcttcctggtctcaaaaccaagcgatgtttggaggagccgtccctcgcaaaccgaaccggcaaaaatatcttccttttgggcctcgttttctgccttcatcttatggcccgtttacgaagtggcaaaattatgtgtcgtccggtaatctaaccgtttcacctgaaattcattctagtacacatagattttgtgtttccgaatttcagccgagaaatgttggtaagtgcaatatctaaggaaaagcagagggggaagaacagtcaggtgcttaactggtagactcaattcaatagaattagctacttatctgttaccaaaatatttaaccaagcgatgacacgaccaaatatgcatgtgaccgtattcttcgctcaagagtcaagacattgaattcgagataggtttatcaactccatctgaagatcatctttcactgcactgctcttgaaatacagacgcatcatgcagaagcaatgcaggcaacagcaagtattcaacatggaaaaaaaaagcagtaataactagtgagaacgcaatgtatcttgtccataaatcatagcaggatggtcatgtcctgtcctggtaacatccacaaacatatagcataagttcagggcaccaattgttatgccagttacaggaattattcaacggagaggcagtgtgacatccttgccatgaaggcagttcaacagacgggcactcgttagcccggcggccagttcatctgcctgcctccgaggagatgtacatgtatgtggtaaacagattggcctgcaaataaagatatcaggtgactgaagatgaatggtctaccaaatataggttctaatgtataagaagactgaaatgagacgtacatccactggggccatcattgatgacaatacggtagccatcttcaagtccctcctgctttgcaacaactttggcaacatagaggaggtaaccgagtatttctacatgcctctcttctgcctgtgaagatgggaaacatgaaatgcatttagtttcgaagatactttattcattttacttgttactcttgttaacgtttacttgtcactcaacatgagtccatgtcagttttttacgggcttggtaatttgtggcatgtgggtgcattccgaggtaagaatgcagtgagtgacaagaaagccttactcatcattcatgcttaggcaatctcccacatgcatgcaccaactcatggcgcctgcattagtgaggccaaaggcagtccataacagtaatcacattcatctacccaacatgaccaaaatgacatttatatattctctatttgggtaaggagtcagcaggttggattacacagctaattgctcctaggcccacaagggagggcaaggacaaatgagaaatgggcaaatttgaaatcacgaaagggttagtaaatttaggtaaactataaatcgactacatatgaagagaaaggttgacataaactggaacataaattgtgataatagatgagtgttaaatgctacctttgataggccagttaatccatccttcactttgggaatgatcacaatgtgggtcggagcttgaggatttatgtctctgaaagccagaacctgggaaacaaactcacagttcatgcccaaaacaaattcacattggagaattaagaaatatgaacaaaagtgtttgatccaaaacataagagtaatgaactgttgcagttctaggatttagtcatttcaatgcaataacagtagaacgacaggcatccagtttacttgggccttaggagttggaaactggagacttgtattgcagtactttagtacctagtgagagagaactatgtattcgacatttctggcacccgtgagaatgacctaggtaaggatatagctaatctctccgtacagagtgctccgtcataccgtagtgagcatatgacagattcatgtgaagggtgtggtctcctagacattattggtttgcgtcaaggaggtgactgccatgacaaaggtgtccggcctaagcagtttctggcattatggaggacaaggcgaactggtatgttaagtagagaagggatggggaaacagatcaatctgtctcttaaccagaactagtacaaagtgcatcctttatatagatgatgacttgtcttcacgaccatagactccagtagtaacgattaaaacaattataacagaccactaagttgattatgccctcaaaagttccttatcctactcatagttgcaaatataacaatggtatcaacaatttattcaactgctcctgattccaaaacaaagcacaatcaagcaattttcagtctaactgggtatagagaaaagaaactcagtgggaaatagaagaaaggttccaaaaaaagctaagtagttggaagggcaagttcttatcagtgggaggccggctagtactcatcaactcggttttgagtagccttgcgatgtacatgctttccttctttgaggttgctaaaggcatccttaagaaactggacttttttaggtctaggtttttttggcaaagtgatgagcacaaaaagaagtacagattgaccagatggagtgtgttgtgtaacccaaggagtgcgggggtttagggatacaaaatcttgagattcagaataaatgcttgttgagtaagtggttatacaagctgatcaatgaggagggggtctggcagaatttgttgagaagaaaatatctttctagtaaaaccattatgcaagtgcagaagcgaaggggggactctcacttctgggcaggactaatgggggttaaggatacctttcgttcttttggttcatttaaattgcatgatggctcacaagtgagattctgggaaagaccgttggctcgggaatcagtctttagataagaaatacccttctttgtataatcttgtaaggaataaaaatgaggtggtggccaaggtagttggaagggtacctttgaacgtttcctttaggagggccatagtgggagacaatctccatgcttggcatgagattgtagctaacgtggttgacttaagcttaaaggggcaaaaggatgtgtttttttgggaggctaacaaaaatggaactttcacggtcaattcgatgtacaaaaagctcatgtatggtaatgtaataccgaggaaatcttttatttggaagctaagacttcctttgaagataaaaattttcttgtggtatttgaaagagggagtcattttaaccaaggataacttagcaaagaggaggtggaaaggtagcccttaggtgttcttttgtagatctaatgagacaatacaacacctgttttttgat

SEQ ID NO: 24713 - DNA, 4795 bp, Oryza sativa
  unsure (1)..(4795): unsure at all n locations
nnnnnnnnnnnnnnnnnnnnnnnnnnnnnnnnnnnnnnnnnnnnnnnnnnnnnnnttctttttgcaggtgattttcagggggacatattgggcaagactttggtccttgttgcttaaggaagaggatggcactttggtgaaagaatactgcaaaatgttagagatgagagttttagagttctactccaactatggctggaacttcagaaggagaattcaagattaggttggcacctcgtgtctgtttgatgtggtgtgcctggatggtggttttctgtttttgttggttgttcttgacaccttttgtggtccaagttattttgtttttgttacccatgtaatgggtggagtttcaatgctcatgtatgaacttggttggctgtgtacatcccgttggatgtagaggccgggtttttaatccattatctaaaaaatagagaaaagaaactaagcagtagtaccttctcatcgtcaaataccacagtggaaggtatttccttcttgatgatcttgtcaaatctgcagatgcaacaaatttcagaaatcaattcaattgcacacttttctgtgcagaatgtaaaacttcaccacattctaaatcaataatttgacatcttcagaaacttaatcttgattacaaggaaaaacttacacttgactaccatcaagcaaactgcaaacagcatgctcttttggcaacaaatgaaccactgatcaatgcttaacttgactattgagttccaatgcgctgtggagatgtattatagttgtttgtcagacattttaaatttaatgaaaagggtatcagacgatttgcctactgctttaatgttcaggcattcagggctcacttcataatattaatccgttaaacgagtgtttcagtgacacaagtaggattggtatttggctattagagaaatggtcaaataaattcctcaaaatgatgtcataaacctgactggggtaagcagagacagatgccacttacttagaaggaaaaaaaaaaactgggccataacttatggagtaaaaaccaaagcaggctacagtacagattggtacgcaagctagtgaaaaatttaattaacaatcatgcttgcactattgtacagctcaatagccccatttcgtatttgcgccaagctcttatttgtggtgtgcctcatttccagtagtaataattagtaaaggaccctaatcacatgaatccagcaattccatctacacgaattacttctgcaaacgctcgctcaagttcggtttaaagagacagggaggtgttcgaatcaatgatctcccagcgtactaggccatgataaactagtgatgccgcaatctgccaatccatgagatcaagaagcacacacgagtactacactgcctacaaatcagagcgggttttgcggcaggagagagagaggtgctcacatggtggggttgtcgttgggcacggcggcgagcgccgcctccttctccgacgccatggtgagggatcgatcgaacttccccgagcacaagtggtcgccgccgcgagtgttcttatgtggataaaaggcacaccagagacgcaaaccctcgttttccacgtcaatttactattctgcccttacaattttgggtcatgcggctcatgccatgcccattttggttaaatctaaaataccgattgcagggtgcaaactctactaaatcattaggccacgtggccaaaccaaaaaccaagttcacatatcatcaaaatatgccacgtgtccagaagagcacgttcattttgaacgtgtgtgaagagtctagataaaacaaaggaaaaaatccagagcattctaaactcggttgaaaaaaatcacatgataacacgaaaagaattagtgaaaaagattgcatgccgaggaaacaatggataagaaaaaaatagtatccaaaaaactgccacaagttttttaaaggaacaacttttaaatctaactataatataattccactataactataccataacaatattgtaacttgtatataagtattaaaatactatatgcaactttatatcacttatatagagattacaatatagttaaagtagttacactattgtgtacaatgtaactatagtgtagttacattgtagttatactacaactatactatagtaacatttaaaagttttttttgccaaaaaacttgtgacaactttttagcaattcccaaaaaaatataaacagcgagccgatgttagctgtcgtaaaccggcaacgaggaagacatttaccgcaatattttccggatccacggaagctgttgccaacgagcaagatccactcactcaatggagcaagcggagggcgtcgagccgtactagctgtgatagtccgcgagtgtggacgcgccaaccagccaacgagcatcgaggtcgagcacgtcctcgccatccacggtagcaatgaccacgaccccaagctcgaccacatccaggaggaagaagagagagggatgaagaagggctcaatgaggatacccagctttggacaatcaagggacgagggcgatcttgccttcgctaccatcatcttcctcctcttctccttgttctcgcaagcgttgtcttcctcaacggctgatgcctttctcccagcaccgacgcgacaatccttgttctcgcaagcgccattttccccaacggttgtcgcctttctcctagcaccgacacggaaatccttgttctcgcaagtgtcgtcttcctcaatggccatcgcctttctctcagcaccgacgcggcaatccttgttctcgcaagtgtcgtcttccccaatggccatcgcctttctcccagcactgacacggcaagtaaagctccaatgccaggatccaacgaccaattctctaagccaccagatccagcatcctttaacccatcggacccggggccacgatctctagtgacgctgagacatggcgggccgcgatggcgatgagcggtgaaggggacgaatcatcgaagattcaaggcccttccactttctattactaggtgattctccatgctttgctacgggatcgctaaacaatttttaatatatttttttcaacaagtaaactaagagtaaaaagaatagaaaataatgaaacgtgaagttttatcagaacttatcataaaataaacaaatgatacccgtaatttaatgtggagcatattgataagtatatgttaaatattataaaaatggtatgtatatttgttaaaatattgtagaaataatgtgatgacatgtatatttgttaaaatattgtagaaataatgtgaggggtgaaacactttgttttttttaaaaaaaataccaacaccaattttataatgagttaataacttaattataattttagaaaaacaaaggaagaaacaatagcatgggtggaaaaaaagagaaaatttgatgattttctcaacaatatgatctgttatgttaaactggaacacagaaaattccattcaactatgatttttgcatgagtttcaaagaaattaaattgatttctatatttttttatgaacaatgtgctaattaataacacaaaaataatatatacggactataaatcatgcgcgccaactggcgcgctgattttctagtgacatctatattcagattgcgccgaagtttaaggcttgctttacccttttggcaaaataagacaccgcaaaaacatgacacaatcgacggcgtgctcctcaaggctcgtgcctatgcagacgaaggtcggggctacacctcagatctggctaggagagagaaaggaggttatcgtcgctatcgccgaccgagcagcagctgatgcttgccaccactagatccgatgggggagccaccagatgtgggaatcctcgtactaggcctcgcaactgtcagcgccagatctggcggtgaagccatcggttctggaagtccagtcactgtcgaggaggaggaggaggcggtggtgagggagggggatgaggagacgaagcagcgggtggtagtggtggttagttggttgctcgcccctctgcagccgcactcgtgctcatacagtggttcgcataaccccaccgcccacgataggcgcttgatctccaccgctggtggtgcgacatagctgccgcctgtggggataaatggggagagaagatgggagtgaaggagtgagtggtggggagtgaactactaagaataaggtgcggagagatggttattttatagtgcaaagtatttcttttccaggtggctatgcaggagaacatttgcgaaatttattttcagaagcagttgtccaagaagaccactaatgaaattagggctatttttaccgacggttgttttaaaaacaagtgctagtgataatagattttcataagcggtcattaaccataagccttcggttattttttacaagcgtttcaaattttatccattggagaaaaaagatgtaatgccagaaaaaacctattttgtagtagtgtttattcccttccttgaaatatgaaggcaaagtagattagatatcatggttaatctttcagtgattggaacagatcgaccagaaaatttcagataaaccacgagggactcagggcccaaagaattacgtaatgtcaaaattgatgattcttccacatggataaaatatgggtcaaataaacagaaaccgccatgaagttggtcaacaaacaaacttcagttgactcggagcggaggatgggttgggatttaaggcggcacaccatataaggtgaaccattaacatatagcatgcctaa

SEQ ID NO: 24714 - DNA, 2471 bp, Oryza sativa
agagatggttattttatagtccaaagtattttttttcaaggtggctatgcagaagaacatttgcgaaatttattttcagaagcagttgtccaagaagcccactaatgaaattagggctatttttaccgccggttgttttaaaaacaagtgctagtgataatagattttcataagcggtcattaaccataagccttcggttattttttacaagcgtttcaaattttatccattggagaaaaaagatgtaatgccagaaaaaacctattttgtagtagtgtttattcccttccttgaaatatgaaggcaaagtagattagatatcatggttaatctttcagtgattggaacagatcgaccagaaaatttcagataaaccacgagggactcagggcccaaagaattacgtaatgtcaaaattgatgattcttccacatggataaaatatgggtcaaataaacagaaaccgccatgaagttggtcaacaaacaaacttcagttgactcggagcggaggatgggttgggatttaaggcggcacaccatataaggtgaaccattaacatatagcatgcctaattgagtaattattataaaatttaaaaataaattttattttttaaaagaaaaaactttcgtatagaaaactttcatgtaaaatataccacttagttatttggaaatcacgttgataaggaaaaaaaataaagtaggcttgtttagaatgcagcctgaagtatggatatgctaatgttattagggcatctacaatgttgaaaaaaaaggcagcattaaacatttaatgctactaagttttgtacctttgccattgtagagatgcactataagcatcaccaaactaaaatgcaccaccctaagcttaaggtatggtcacaagacaataaaactaagcttaaggtatggccacaagacaataaaatataggatttgctattcatactaataaaatacaacattgcattgaattgtttatttgtaatcatttggctgccatgcgggaccttttgccattttctttcttttggtgggacccagcggggcccactttattttcttacctaggccctgtttagattccaactttttttcttcaaacttttaactttttcttcacatcgaactttcctacacacaaatttctaacttttccgtcgcatcgttctaatttatttaaactttcaattttgacgtggaactaaacacacccctagtcataagcatgatacatatggatatagttgtggctctttctagtggaccccactcctattactcacggtggcataaacgttggtcttgcccttagaaatttagaaccaacctttctttttctcgggttatttaataacttaaactgggcccggatatggtagaagtttctcacggtactactggctgctaatggtcaagtaagccattattattaattaatactcctagttttttttctttaaatttaatcaaatttataaatggtatactaatatttttaatacaaaataatgtattattaaaatatatttaatagaaataatcttttgtcgtagatgatgataatttttttataaatttgatcaacttaaggaacttgggacctgttgatattgtagccaaaataaaccttaccaaattttggtattagcaagttaataatattgtcaaaattttggcaggattttttatatatttataaatttgataacaaactagacatagaactttttttggcaactttgacgaaaaaaaatgttatggttgaaaataatatcaatctgaacagtgtcttgaactaagaaaaaatcgtatgacttataatataaaacagaggaattatccggtacaacttgcctttcttagccaccactgacaaaagcattacgcaggtggtaggctaattagcaaagcttattaagacctctcgagcccagctagcaagctatcgtgctgcctggaaggtccgaagaagcggcggcgttgaatcgagtagccgacgtgccatacgcccacgccatttccgcgcctacaaatagcgagatttttccttgcggcttcttccaaatcttcagcggtctccgccttcagatacacctttgatccgcagcgatgaacgggggaagcccggtgatgacggagagagagcggcgcgcgtaccggtacgggcaggcgtcgtcgccgacggcgcgggcggtcgggcagctggggtgcatcaggaagtcgtggtccaacgactcgctctcgagctacggcggcggcgggagggcccgcggcggcggcgcccaggcgtgcgtgtgcgcgcccaccacgcacccgggctccttccggtgcaagcaccaccgccaaaacgcctccaacctcggcgccgccgccgcggcgccggcccaggtggtcgacgttgacgcggacgccaagcaccaggaggcccaggagcaggaggagaaggcgacgtgagggcg

SEQ ID NO: 24715 - DNA, 1657 bp, Oryza sativa
aatggattatatttcaggcactacctcaagatgctttgatgcagatgtctgttgtcgtgatgactctcatggttttcatggtaataaccttgaacaagacactgatgagaagttgcttagaagagctaaagaacttgatgagtgcttcatggttcctcttgaagaaaataatgagcttaacatgctgagggataatagtttaagctcaactgacatgttgcagctgatacagactttgattgaagatagaaggcaattggcactccaattgtcttcacaaattaaggcacgtcttacagagagatttgcagccaaagagcaacataagcggtccaaggtagaattgaacaccagaactagaaggctggagaaggagaagagtgatgtgcaaagtaccttggaaatggagcttgatagaaggtcaaatgattggtcagtcaaactggcagaattccaatcagaagaacagcgattacgggaaagagtaagagagcttgcagagcagaatgtatcttttcaaagagaagttactttacttgaatcgaacagaattgatgtttctaataagataacaagtttagaactgcaaaacaaacagctcaatgacgagctacagaaagtaaagaaagagcatgatactcttttgaagtcatcggttgagttgaatgataatttaacgaaaactgcagaggaaaggaaccaaatcctggaatgcttaaaagagaagggaggtgacaataaagcattacacaaagtgattgcaaggttgcagaggatatctaatgaacaggagaaaacaataactggcctgagacagggattcaatgctgaactggaaaacaaatcccttggtactagtgaaagcatcagcaggatgcaaatggaacttatcagacttactggagtggaacaaaagctgagaagagaaattcagtcctgtaaccgtgaagttgagtctctaagggaagagaatatagctgttttaaatcgtctacaaagcagtgataacaaattaagtatttcttcagttcgtcttgaacaggagctcaacaccagagtggacaacttgcaactacagggcttatcgttgcttgatgatactagtcagctttgtgccaagttgttggactcaatgaaatctaagaggagtgagagtttcggaagtgttgatgcattagcatccattgaatacactttgagttaccagagcatacaagaaagaatcaagaatttaaaacaatgtcttcgggcaatcagatctatgttgactgaaaagcataatgaagaagaaaagattggagagagaactgaaagctgtatcttgaaacaggaccacttatccaaggtatgaagttcctagggcctttttacatttggaagtatcctatttatttttcagtcttatgggccggtggttgttggcttaagactttgttctgtagagcacaaaaaaacacttttttcaaacatatacagtgaaatttggtacagagacaatgttctcaaaatatatctggtaaactctactagtacagagacaagtctcagaagctaaatctaaacctccgctttcctttttgcccttttctatgcaggatgacattgaatttaagttgaaagaagagtctatgctctgtagagtactaaaggagaagtt

SEQ ID NO: 24716 - DNA, 11394 bp, Oryza sativa
  unsure (1)..(11394): unsure at all n locations
gggatgtcttgtggcaggaaacgaagcagctgcgaaaaactatcagcgccttgcaaaatgatgttgcttcattaaagcagaagatgaaatctcttgatgaagacatactgcttaaggagggtgaaatactgcttaaagagggtgagatttcgatactacgtgacagtatcggcaggccatctgacatcatctgcagccctcggccatcgaagctgtcgaatcggagtaaatttgcatagaagtagctgtagaatcttgcatttttcaaacagctttactttccccccattttacacaggagatcatttacttgtgaatatggaataccgaatagggcgtttgctgctttctagatttcttgtataccaatgcaatatgtgttgcattatctagtaagagacacgagtactcgacggatgacatgctcagaggcacctccgatcatagctatgtcaaatctagtcctctattatgttaattgccacctttcttttttgggaatacaaacacctcgacaatgtttatgttactggtgctgcacatacaaattttgattgatcggcagatcaggtcacctgggtactttgcacgtcattttcttgagtatccagtgcaatggttcatcatatcctcgcacattttgtaagtacccagtttaatagtgcaccatatcctcgtcatccttacgaaactagtagcaggtcagtgctaacgctacggtgatatttagtaagcatgcataaaaaatttatatatgtcaacatccatgctaatttaattattattataactatcacaaacttgggcagcttttagttgtgtagttcaattctcaatcaagtgggagcaatttctttagccataaacaaacatcacttaatgtttttctattgcttcatcaataatcgtcatttgtatcagagtatatgatgaaaaaaaattgtatttaagatatttgaataaacaaattaaatcctctaatggaataacatttggctgagaagaagaaaaatatttacaggttacaccgcagcagaagaaatcattaaagttgctagaattatgtcacaatagaccaatacataactgttgtgaaatacaacacattatttgttgcaaaaatatgtattacaaaccttatatgtaatgcaaagcgggaaactatcgtaggatcaaaaatgaacatctgagatgtatccagttcatcctgagtaaaacttttaatcctaataaaacctttgctcatggttaaaactgggagcaaaagtttactcagggtgacgtgaaccaaacattcaatttttaattctacggtagttttcaggtttacattatatatagggtttgcactacaaagtttttcttatttgttaggcagcttcaattgatgccaacattggtgaccttagctgagggcattgatatttattttccaacctgtagcattccatctattttgctctgaaatctaacatgaaaagcatgtgctgcccaaaaacctaataaatggctcataggggtttcaaaaaatgcgaaatgcaaataaagcaatatttttttactaatcaagatgtaacagtggttagctgcctgctgcaaagaataaacatattcctttacactcatctattcaaatattgcaggaacatcaaaaagctactacatatttatttgtacaaaatgattattgtgcagtaagaagaatgaatgaacagtggatatagaattatatagaataggcagattgtgaataaaatttgcagaggacattggtctgctccatttatgcggtaagaaaccaaaacgtcagtttgtctaaaaggataaaccacaaattggtgagcattatatggtttctgacacttgtattgacgataaaattaccttgtaggcttgtactgggcattgatggtgctgctttactcgtgatattatccacagcggacaaagtgatagaagcaaccttgtagctgctagccaaaagtgtgaacatatgagcccaagcagcctattatatattgattaacatgaatactgctcaacattagattatgaggcgcgtttgcgcacacccaaggaatctgacttctcaaattatcaaacaaaaagagcatacagggacaattacggattaaaatattacattcaattatggtttcaaattatatgatatagtgacatcaactcatctaaaaactatctaccccaatttttaggatcagacttcacctcactaaataactttgtgccatacatatgcataaaacgataagagaatatctataagattggctggttgcaataagacaactcttgatcagccgacctcttttgtgaatgactgagcaacagagagcagcctcttctttgtttagtcatgaatgcacattttgatcagttagtgtgaggttcaggcaagtcgtactgaaaatcaggcgttactataatgaacattttataagtttggacgatatcccttcgtattaatatttagtttgaactaagatgataatttatgtaaattctgctatacaattcaattctacagatgtagttcttgtttttaacacaatgtagcatgttaggattgtactatatattcttcgctttccagcctagatatctgcagaaccctgaacatctagagtggagagcttaaatagtgatgaagttttggcaaagcagcagagccatttcctgcttggacctggattcagcatgcaggatctccagtaccatcttatcggggttgatccaatacctttcctgcacgttcatctacatgaaatccagcagaggaaccaaagtttcagtgttcagagaaacagtaagtcagaaagcaacgatagatccgctacaaacctattaacctttctgaaataactgaaaaaaaggatatttccctgcatatatgagcctgtgctcttgtagagattatggtgcttggcagcagagctcctttgggaaggacatgcataatgtatcaggattacccggtcgctagccttccaagggttatccaccgcccacttcgccacagcctttctcgaccgtgagtgatcaagagggaggagataaacaggcgcagcgtcacaattaatgggcgaagagaagctgtggacggcccagccaggagggcagcagctaaacggtagggcccctctcatgccgtggccatcgctgcagagctctcatgccatgcaaagaggcaaggatcgccaaccgctagaacgggatgtggccctggcgctggcggcagagggacccggggccggggacgcatcctcggcgacagagcagccggatcctctcggtagcggtctacggacgcttcctcagcagtagaagacctcgcaggcgtgcgagaacgtcgaccgcgcacgagtgaagagatcaggtgatcgacgaggccgttggcaccaggtgcggaagccgactgctcgcgcttcaggattccgaaattcgaggaaggggatcgacagattgagatggtggcaggatttcgggagtgaggcgcgcgcgttgatgggaaagaaatcacgcgattacggcagcctcggctgtacactactgaggtggacgcgatgatcgttagatcgggcactgaggaatactgtcagctggatttgatgaatgagtaatgtaggtgtaagagtgagttgataaattatagggtagatgaattataggtgtaagagtgagttcatttatctagatttttctgtaatgtgactatctatatcagctagacagtatttagacaaaattcaatcaaatttagtacgggatgtgacccatcaatctggacaggttcactggtttgttttttatgggatggagggagtatacatttgttttactgtttttatttttttgttttttatgagatttctacgtaatatcactacagcaacaaaattagaaatcaatccaatacaaatatactcaccaatcaaaaccaagaggatgcgttgttcatttgtcagaaccaataaaaataaacatacgaggtgttttggagatcgatcaacaaaatggtagtgcgatatttttcagggaaaaaaaacacatggtggcattggaccatacatgcacgtatatcacaaaccatttctacagtctttctctctcttaatataaaaccagcagaagctggcttaggcttcaaaaaaaaaatcacaaaccaatgttgttttgaaagctacagttaaggcctacaacaattgcatatatggcttgaaacacaggcttgtaaactgtggaaatctcccagaatcatcaagcctgtaggatacctggctgcaaataataataacaatcacatgaacgcatgtggcagctattttaaaatacataaggctgtttagtaacagcaatgctcaactctaaatcatgtgatgggccttaaattaggatctccatccaatctatagatctgccttcctgagatcttcctcatcatgcttgtagagtaactaaagaaaccagtcactggggagctatacggacaggtctgtgaggctttggcgctaaaatgtgtgcaagcgacaaaatgtcaaatttcttcacaacgcagaggattaaaatgaatgattggaccaatgatccgaggccaatccactttattgatcccacaagatcagtaaatgattctcaatcttacactataatttgtggtaacaacggggtgactttaaaatgatatcatattgattgcacaagtattccaagcaaatatcttaagataccaactgttcttcacatgtaaatgcagtgtgaagaacagagtttttcctctggtccttaggagagaggagttattttaagtgctaattgggagatagaggtattctaactcttgattaacactttgggtgcatgtacttgcaaatatctcatggaccagaaaaaaagagagcatattctaccatagaacctacatgagaattctatgcagaagcaataattctagacaatggagaagaagaaatacagggaaaagaacataccatttggattcccttgctcgtagaaatttctaaaaagagccactgcctcctccgccatgatcccaccagtacatttgtaaccttttggcccgggaatttccttcctagcaagagacaaacagtttgaagttggagtgccataaacaactaacagagttcagaattaatgatgtaaagaactcaataaacaactaacagagttcaggattaatgatgtaaagaactcaataactatgttgtacgtgcaagaaaatgaaaatattaagcatgtgcaagtttgcaaaaatcatgatattgaattgaaatgttagggtaatgggcaactaatgaagcactaaaagcaacatgttatcatgagtaaacagctttctgctgcttgttgcattgctccctcaccctgacagttcagcagaagaactctgatgcaatgacatgattgatccacatcctccaaatttatcgttagcacaaccaaagtacacctcccttattcctgtcaaaagaatgaacatgttaaaaagcataaatccatatgctcttacatatttttaacacaataaagataaaacatctcagaccaagtatcgacaacgccattgcgcacattatgcaaggctcacatgtgacataaaggtcgcatcttgcaaacttctccgcgacctgtggctgatcaagtcccatgccctgccactccctaagcaggatatcaattgcttccatctcagcatgccttgtagccttagaatcggtacaggcacaatcaaattacagctttaatctaagagcaaaaaaaaatcttttacatgtaaatgcagttggtatcaattacaggttttcttttacacctgtacaaaatttttactcctgctctatttaatgaaattggcatgtttaatgctggttcgttcaaaagaaataataataataataataataataataataataataataataataataataataataataataataataataataataataataataataataataataataataataataataataataataataataataataataataataataataataataataataataataataatctaagagcaaaaatattcctaaccgaagatgtaagagcatgcatacattccgggtggcatttgtcttgttgctaccggatgaaatcaccttcccatcctccacaatcacacatctaccaagacagaataacaaaaaaaagtagagccagcagcagttaggagttactagcagttagcacagcaagaaccaaggatgaactcctatgtatgaaacgaagcaggggtataccctacagggacctcaaggttgtccaacgcaaacttggcctgcaaaaacgatccagaattcagcgccagaaacaccgtagcagcgtaaaacgtgttcttcccagcaaatcaagctggagatttcagccatacctgctcgagcgcgagctccataaactccgccgccgccgccgccatcgcccggtctggtaagggaacttccggcgtgcgtggtgagtgcactggggtgcagcgagcggcggcgggttcaggcgagcggcggcgcgatcgggttcaggtcgaggtgggttaggtttcttttccttctccttttcaggccgtgggccgagagacttgtggcccatttatttacctcgcaagtttagtttcgcttcatcctgtccagtctctgacggtagccggaggaggcagcccgccgccgtgtcctcttctcctcgcggctgcggaggagatgagcggcggcgcgaggagggtgctcgaggcgtggaggctcggggtggtgaggtacggcgacgccctcgggctccaggagaggctcgtcaccgaccggagggccggccgggtccccgacctcgtgctgtcgctgcagcacccgccgacctacaccctcggcaagcggcgcaccgaccacaacctgctcctgccggaggccgacctcagggcgctcggcgccgacatccaccgcacggagcgcggcggcgacgtcaccttccacgggccgcggcaggccgtgctctacccgatcctctcgctccgggccatcggcctcggcgcgcggaggtacgtggaggggctcgagtccgccatgatcgaggtggcggcgctgtacggcgtccaggcgtgcccgggtgccgccggcgagaccggcgtgtgggtcggggacaggaagattggcgccatcggggtcaggatctcgtcagggtttacttgccatggtctggccttcaacatcgatcctgatttgggtttcttcgagcacattgtgccctgcggtatcgccgacaaggaggtcacctctctgcggcgagaggcggcggtggagctccctcccgacgaggtgatccatgatcagctcgtgcagagcttagcaagaacattctgcttcagcgatgtggaattcaaggatgaatccgagtgcgccgacatggtttgcttacctgcagataagcaatcctgattgttttactatgtatactgaacttagagttcttcagaacgtcttgccgtcaagtctggaaatgacattaggaaattttcgtctggttttgttcattgcgaatgaaggtgacctccattttggagcataaatgaagaataaatgatgctgtaagctttgtctctcatttgataccttgcccctcttttggtctgttttcgtgagatcgaaggcatttggacaaagccttatttgctttggaatacttgaaggtcaaacaaagaaaagaaccatgagcgtaagtcatgtgtacgtttacacccatttcatctataaacacagacttattggcgttcgtcaacttatctgtttccgttcaaattactcgtcgttctagcatttaaaatttgtgtcgaatacttgtcattctcacattccaaagcacttttagagatgtctttccattcttactctcataaatataaccttactagtactagtactctcataagaaattcaatgtttgctttcggaaagatgattaggatgtaattaatgaaagtagcaatgtaatttgacacgtcttctagtttaatgtgagatttgctagaaggacaagtaaatcgaaacggagggagtacaatatattgtcttggaaaatcgagaaatgtagttttctcttgcatgttgaaggcagcttgtattttcgtcatgaatggagcatacatggtcttaagcctaattgggacctacacttaaaaatccaagttactccgaaaaaggcattgaatttgtcttcaaagaagctattaatattatattcttcataccataaatatcttggcaagcttatttggggccattctgcagatatctatgatggtttgagagatctgtccaatgttgtttccttcttcatcatcctagaggacatctcagtcattgcttctgaaggtacatttatgatattgtctctgtgtaaataatgagagaatttgcaggaatggactctggaatgtaaattagcactggtatttcaattcaactaagaaattcatggtgacatgcaaggaaaacctctcatactctttgagggtgtagaggaaaaaacatgtgtatcatattagctctttgaaataaaataaactgtcttccattaattcatttacaaaaaatggaagaatctgatagaaccaaatcttcctgcatctactggtctcttcaggaatcgtaccagctgaaaatgcatcctgacattcggtgctgcaagattggagctcagtgcaggacggcttttgttctacaacaccaaccccccaagaataggcttccgaatgccgtggaagaggctgattcttgttctctgaaggtgtgctacgccgtgctgcgcttgaagaaggtgagctggcattggtcattggttcttgagccccagatgattcaaagcagatggagactgccttcccagatgcagtctgcagctggaactctgaggggctaagaggaagaaaagcactattacatgtatgctcattgtagtaggtgactgagtacaatggtggatcactataatctttctgctgaatctgcttcgttgctgggcaattcatgttatctttataggtgcatctgtagtagtatctgcaatgagacaagcgagacaacagtttgagtgaaatgaacaagaaaagggttcagttttctacgactatttgttgcaacacatctctttgtggtcgatttgggtgggtagaatgagaagagcatctaagtatcatcacagaaaggtgtctaactgataaatttcttattgtttgcaggagaggacaaggttgacaagaatgaacagatgcccactctttccagaagatatacagatgcagataccagaaatgaggaaatatactgcaaatatatcatctttcatccgaacctggggaaattacagttgtttatcttcttctcgccgtacttcctccactggtggccgtcgttgtgcggcgcaaaggtatccaccttcctcatgcgcttctctttcctgcaagtttttttcagaaacatatcaacttctactccaattgaatcccccctgcactatcatcaccactctcttataaagatcaaaaaccaaaagaccagtaatagtttttagctaccttgagccatggcctagatggtgtgattgatgcggactcggcacaggagacattgtttccagagagaaagaaagagagagacacacccggagagagaaatgctagggtgagcctgaaactgaaggccaagggagccttaattcagaagcgtaccaaactagggcacccctttttagcttaaaacatcaaagagctccataattgaggcccttatcaccatataaaaaccaccaccgctctctaagctgaagaccaaaaacgatgcaaagattatcttctcctctccccgtatcgctgtcacgtgctcccgcgcaccgacggggcgacttgagaaatttctttgcagcttcttcaaaggccccggacacacataggagctacaagtggcctcaaaatgatgtgtcaccccgtttttttaaggactaagcactgtcatcgatctagcaacttggggcgattaaatggttaattaattgctttgattggaactcgggcaaattgattatataatcggccggaccagttcacaaatcttggccagaatggaagcctgccccggtgcgttggtgattgcttagataattgattaattataaactagttggacttgacctgattctttcctttgcctcacaaagccagaggcaggaatcgtctcgttgcttggggagggagattagctgatacctaacgcatatcgatggtttttttaaagacctgcacatgctgcaggacaagttgaggcagcaaggaatctcccgcttttcgcctaatttaggacccggaaaatgatctcaccagtgatgtactgtgctttgcctccaataggggtcttagttaaaaggggcgcgtggcaactgggcggatgcattgcccggccactggggatatttttgtagagattggcagtacagacgttatgtgcatcacgatgatagcggccagttgatgaatgcatcacgatgatagcagccagttgatgcatcaagtggcactgcaagcctgaagccagaaatgtgcttttttttttggtagtaaaattgcaagtgaaaatgctgatggcaatgcaccatgaatatactatagccaggatagattgatagtagatcataaatttgatagataaatagatagatagatagatagatagatagatagatagatagatagatggatggatggatggatcataaatactagtacgtggtcaatgaattcagagagaaggaaacacgtactcacataggatgagatagtttattgtgcttgtgctgaataagacctgcttagctgagctctgacttttacccatctncaaaaattcagaactatacatctccagttctccacctttttttatatatggagtggttactccccacgtccttctctttgaacttaactatttacaaacactatgaggaccgagagaaaaaccagtggcattttctaattgactccttctagaaacaggacaggtaacgacttgctattggtccatagcaagataggagaagggggatgcatgctattgacatccagatcttggcttattcattgacctgcatatagtatgctactaagtaaattgcccgctaatttaattggttacagactaaaatatgttgtcacaatcctgatgaacagaaataaataagggtaaaagtgtggtcacaatgaactacacgattaacaagtaggagccaagtgatagaaaattgtatggttgtggctccgcgatgccatcggcaaaataa

SEQ ID NO: 24717 - DNA, 2960 bp, Oryza sativa
  unsure (1)..(2960): unsure at all n locations
nnnnnnnnnnnnnnnnnnnnnnnnnnnnnnnnnnnnnnnnnnnnnnnnnnnnnnnnnnnatcgatgatctggtgttctttgttacggtttgagctatgatgggcctatttaggccacaaaatacataacttatatggtgggcataaatgcggcatcttatatagttctatctcggcctatagagtctatctaaagtctctgatctctaataccagaaatctccacccctatacaaaccgtgcaaaaaaggtccggatgtagtatagatctttggtttcgctgacatagcatcctagtcagcaaagaaaaataaaaaaaattatgggacccacatgtcaatgagaagaaaaaatgtgaggctcgcgtgtcagcatccttttctttctgctcttttcttccgaagcttgggaggtaaggggaggcgcccaacgggacaaggggagagaggcataagcgggaaagggagggggaggcggcctcaggagccgttgccgccattcagctgccgaccgatgctagccacgaggtggagttccagcgagcctaatgggaggaggaggcgattggcggcagaaggaggagactagaccacgtctctcttcgtcgatgtggccgacaatgcactatcgtcgtgtccctctacacgagccgcaagcacagcaaggtgtggagccagcaccaatagtggagagtgctagatttaattgggtaattgatccatttaaatcaattaaatcaaataaattccaaggctcattatgctaggaattcatgtgtattcattcttttatgggatatcaatgggatgaagagttttgagaattaatccatttgatttagggaattggtaacttatatcaattagtcctaattgattgttggttgatggttgtgtagtggaggatggttgatggctagttgatgacaattagttgctctattcctcttcctattccattggtaacttacatcaattactcctaattgattgttggttgatggtggtgtagtggaggatggttcatggctagttgatgacaattagttgctctattcttcttcctattccatgactcttactcttcatcttccattcctcttataaaatgagaatggatttgatttcccacgagaatagtgagacacactttcatccattttctaacgctgttgctgctacggtaatcccatcccgacaagtgtgtgcacacacgttgggagagtaggcctccgaaaccacgcgctgctgcgacgtttgcacggacgggcgggcgatcaggtttttggggagcgcaaggcgcgactactcactgttcatcaacatctacttcaccttcaccaatatgtcgaacactggagacaatggcaacactggatacaaggagaaggaggctcccgtcaacaccaacggaggcaatactgcctcaaactccagcggatgaccattcttggggtataaccttcttacattatttcaattagaagttttactgttaatgttcatcgcaatgtcaacattgtgttattatgtgattgttgatgcttattctacattaagcatgctcatgttgattacattcaccactatcactggatcaaatcccattgtaaatatcatgtttattatcttgttattttggattaaaatatgccgaattatgaccaaatttccaacaatccaaaaacctgataggtcattttcggtagttggctttgctgcaacactgaaaccacatgcttttgatggttctaattataaaagatggaaagcacgtgcactactgtggttgacagcgatgcaatgcttctatgtttcacagggcaaacgaagtgaaccgcctctctctcctaaggaggaggctaagtttgaggcttcggattgcctgttccgtggagcattgatcagtgtactcactgacaatatagtggacgtgtacatgcacatgccttcagggaaggacatgtgggatgcacttgaggccaagttcggagtttccgacgccgtcagcgagctgtatgtcatggagcagttctatgactacaagatggtcgatgatcgttctgtagtggaacaggctcatgagatttagatgctggcaaaggaatttgagaacaacaactgtgagttgccggacaagtttgtggcgggtggcattattgccaaattgccaccttcttggtcggactttgctacttctctaaaacacaagaggcaagagttcagcgttactgatctcattggctctttgggtgttgaggagaaggcgagagtaaaggacaaccggggcaaaaatatcgagggaggttctagtgccaatttggtgcaaaagaagaaccctcatgcatcccacaacaacaacaacaagaaagtcaagcctgatgtcaaaccaaaggctacaaccaattttaagaagaaaggcaagggaaaggccaagggcgactgctttgtgtgcggtaagcctgggcattgggcgaagaattgtcctgatcgcaaggacaagaagtctgccaacatggttattagcgagggcggaggaacatcggggtatggtaattttttacctacagttctctctgtttttcattcacctgattggtgggttgatactggtgctaatattcatgtgtgttctgatatttccctgttttctttttatcaggtcgggagaggttcctccttgttgatgggaaacgggtcgcttgcggctgttcatggtgttggtacggtcgatctgaagtttacttcgggaaagaacgtgcagcatgtcccttcaataaagaagaatctagttagcggctctctattgtgtagagatggttttagacttgtgtttgaaatcaataaatgtgtcgtatctaaatatgaaacttttattggaaaaggttatgacagcggaggtctgttctgttttctttggatgacatgtgtaataataataataatgttgggaaccatatta

SEQ ID NO: 24718 - DNA, 3669 bp, Oryza sativa
  unsure (1)..(3669): unsure at all n locations
nnnnnnnnnnnnnnnnnnnnnnnnnnnnnnnnnnnnnnnnnnnnnnnnnnnnnnnnnnntgctaatattcatgtgtgttctgatatttccctgttttctttttatcaggtcgggagaggttcctccttgttgatgggaaacgggtcgcttgcggctgttcatggtgttggtacggtcgatctgaagtttacttcgggaaagaacgtgcagcatgtcccttcaataaagaagaatctagttagcggctctctattgtgtagagatggttttagacttgtgtttgaatccaataaatgtgtcgtatctaaatatgaaacttttattggaaaaggttatgacagcggaggtctgttctgtttttctttggatgacatgtgtaataataataataatgttgtgaaccatattagcaagaatgatgagtccaatgtatggcattcgcgactttgtcatgtgaatttcggttgtatgacgtagttggctaacatgagtttaattccaaaattcactttggtcaaaggttccaagtgccatacttgtgttcaatcgaaacatcctcgcaaacctcacaaggcatctgaggcgagaaatttggcaccactagaactagttcattccgatctgtgcgaaatgaacagtgtgttgactaaagggggaaagaaatatttcatgacactgatagatgattgcactagatattgctatgtgtacctattgaaacaaaggatgaggcattgcattactttaagatctataaagctgaggtagaaaaccaacttgaaaggaaaatcaaacggttgaggtcagataggggtggagagtatttttccaatgagtttacgtccttttgcgaagagtttggaattattcatgagaggacgcctccctattcaccccaatcaaatggggtagccgaaagaaagaatcgcactctaactgagatggtgaatgccatgttagatactgcgggactttccaaggaatggtggggtgaggcaattttgactgcttgtcatgtcctgaataaaattccagtgaagcataaggaagtaataccattcgaagaatgggaaaggaagaaattaaatttctcatacctacgcacatggggctgcttggccaaggtaaatgtacctatagccaaaaagcgtaaacttggaccaaagaccgtagactgtgtgttccttggttatgctatccacagcgtgggctataggttcctaatagtaaactctggagtacccgacatgcgtgttggtacaattactgagtccagagatgccacattttttgagaatgaatttcccatgaaaaatacacctagcacgtctagtcaagaacctgttttaccccatgagcactttgcaccgatagaacacaatgatcaaacgcctgaggaaaatcctgaggaggataacattgtagcaactcgaaagagtaagagagaaaggactgcaaagtcttttggagataactacattgtataccttgtggatgacactccaagaaccatagaagaggcatattcatctactgacgctgactattggaaggaagtggtacgcagtgagatggactcaattatgtctaatggtacttgggaagtcgttgagcgtccatatgggtgcaagcctgtagaatgcaaatgggttttcaagaaaaagcttaggcctggtggtacaattgaaaagtataaggcaaggcttgtggccaagggttatacccaaaagaaggcgatgatttttttgacacatactcaccagttgcccgcttgaccacgattcgagtactacttgctctggcagcctctcatggccttctcgtccatcagatggatgttaagacagctgtcctaaacggagagctagaagaggagatctatatggatcaaccagacggatatgtactagaaggtcaggagggaatggtgtgtaaactgttgaaatccttatatggccttaagcaagcacctaagcaatggcatgagaagtttgacacaacacttacatctgctggctttgttgagaacgaagctgacaaatgtatgtactatcgctatgatgggggagagggagtgatcttgtgtttatatgtcgatgacatattgatttttggaaccagcctcaatgtgattgaggaggttaaggactttttgtccaaaagctttgaaatgaaggatttgggagtgactgatgttattcttaacattaagctactgagaggagatgagggtgggattacactcgtgcaatctcactatgtggacaaggttttgagtcgctttggttatagtgactgcaagccagctccaactccttatgactccagtgtgctattaaggaaaaaccgaagaatagcaagggatcaattgagatactcccaaatcattggttcattgatgtacttggctagtgcaacgaggcctgacatctcatttgctgtgagcaagctgagccggtttgtttcaaatccgggagatgatcattggcaagctctggaaagggtcatgcgctatctaaagggtacaatgagctatggaattcactatactggttacccaaaagtactggaagggtatagtgactcaaactggatatctgatgctgatgagataaaggccacaagtggatatgtgttcacacttggaggtggcgctgtttcctggaagtcttgcaagcagaccatcttaacgaggtcaacaatggaagcagaactcacagcactagatactgccacaattgaggccgagtggcttcgtgaactcctgatggatttgccggtggttgaaaaaaaaaccagtgccagctatcctaatgaactgtgataatcaaacagtgattattaagttgaacagttcgaaggacaacatgaagtcatctaggcatgtaaagaaaagactgaaatatgtcagaaagcagaaaaactccggagtgatagcactggactatgtccagacagctaaaaatctggcagatcagtttaccaaggggctaccacgtaatgtgatagacagtgcatcgagggaaatgggcttgagacccacttagagttgcacaatagtggaaacctgtccattgtgatcggagatcccgtgaatttggatggcgaaacaaactattgtgtaaccgagagaagagacccttaaatgggctcattttcatgatgtacttctcttctattctgtatggaaggatggcttatgcctcaacgtgttccgagtgactttcattaagcagagatgttgacctgcagaacatcttagaaggaacacacctatataagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactaccaattcaaggcatagtccattgttcagttgtggtcaggtgtagctccttttctaggtgaaagttcaacttaacagtcttcaccaaaacactggtatataaaagctgctatggaatagagagcattctcatgagccttgaaatttggtggggattgttagatttaattgggtaattgatnnnnnnnnnnnnnnnnnnnnnnnnnnnnnnnnnnnnnnnnnnnnnnnnnnnnnnnn

SEQ ID NO: 24719 - DNA, 3092 bp, Oryza sativa
ccgggaggaggagcacgaccaggtgggttgtggccgctcgctgttttcacatgacacggcgcggctcgaggaatgtggatggcgctacctgcgtgcagcgcgcgggcgcgcgccggtagaggagacgacgcggggggccatctcatcctcaccatctctcatctctgctcggggacacgccatgtgacgaggtgtgcgcgcctcccggctagccctttgctccgacaattattggcggccgctgcatctgcatgagcggacacgcgccgtgtcgccgcccttgctgctgatgctaatccaataaatctctcccacggtgttttcacgggctatataggttggagtacgatctaaagtagtaagatggtgatgatgagcagcagttttggcctagctaggcgcctcggtcgcacatgtcaaacaggggtagtgcactctgatgagaacgaaatgggggaaaaaggcacggggtcttttctgcctggatcgagattccagtgctggtgccgaaagaaaggggagaaatcgtacaggcatcatgtgtggaaagggcggcggaatctggtaaagagtggacatgatgctgatgctgttctccgacaatgctaaaaggagtggagcttaagtatggttggcaaatcatggcgtgctttagctgccagcaagataattgttgcgacttgcgagaagtaagccgcaaattatggcataaacttgaaagcatatacacatggtctgagcactcaagagagtcacagctcaagtttttagtcaagtcgctcaaaatttcctcctcatccactgcaaaccaaaataaaagcagatggggaaagctggtacattagtcacgcacgacaacagcacacaagcaacagagcctaccagagcatcatatgatcagatctacccacttgcaatccagtaaaaaagaacagagaaactgacaaaccgatggagtaaagcattccttcctcgtgatcaagctgcgccaccgtggttaccatccgctgcattttctgaagcaaggtggcccaccgtaggataccgctctttaaacttatcttcccaatcttgcaagacctctagctcgtctggaccaaggccatccaaatctccagtgaggtcaatagggtcaaacgacatcaatgcaagggcccgagttgcatccctcccagcaaacaaggaatatggtccttgaggaccataaaagagcctgggagttaaaaaaaaaaaactgagaacacaatcatgaataatgaaaaataaaactattgatgcatgatgacaagcaccagtaggatctaactgcatctcagagctggtgttcaagagccaattataataagcatcagatagagctatgcttctgacaaaatacaagcatttcttttatgcacgatgtaatatattaggagatctcattttaaacctcatgtggacgtggaaattgagaagtatgtaagcacagaattgacagttgttgcagtatattgcgcaagtaccagtgcgtttatgactctaatccacaacatggcacttgtggaatatttgtacaaagggtccagaccttcaggtacatatacctaattctttggcagtacatggggatagtggatacccaactagaaaactacagtatgagctctagagtctagacagcatcaacaaataggaatatgcttgttgtctgtgaaatagcagactatctactcctaattgcaggctgcaggacaaacagttcactactaaacaacagttgcagataatgtgccaactagaatataccatttgctagacaaacatggactaaacaaggaaagaccacacatgataaattgggatcaatgagacagcaagaaaatatgtaacttaaggaatagtaaggtggtctggtggagacaaggctacaagcatccaagcataaaaaatatttttttacaagaaatcagaggagaaataaacaaagaaatagtacatcaaaataggtgtaagggagcataggaaaaatggtagagtgaaatacacaaaatgctaaatatggtagtgtatcgagccagctgtttcaaacaaatggtctagttattctctaatattaggcaacacatttaagcatctgtctggtgcacaaaagaaaacttaaagctcatcaaatcagtagagcaataaataggcaattaggcagtaagtaaaaaaaggagtttagctttagaacttagagaaatgatccaacaagacaagagtatcacaacccttttcatctaaagttcgacagtacccactaaatttcttttgctttcacattgaaaggttgtgtaacagtacaaggcatacatggatctgttatcccacattgtacgagcagttatattttgaattaggaagttccatgagacgaatgttaccaataccgatattttacacattaagcaggcagcactaagtaaaagcactaggaacaatcaaggaagctaggatggtgtcatagctaactaaagtggaccagaggtttgaggcttgtgcagacgatccaatatttacagagccacatatgtcccactacagcatttgttggttgcggatatgcagcaagtcatttgaaccaacgcccttggtggtagatataacttcaactctctagtctaagtttaatccaggataatcaaacgcacaacaacatccttacaataaccctagtgagaaccagcaaaaccatgccaagttgatgactgttgctcaaacttgcatagacaataggcaatttcctcgttactcgtgtagagttccctaaaccaatttaattgcaacaacagcttactaagctgataagacccatcgacctactacctcagggctcgcatgtctgaacaaatggaatgtcacaccaccagtttgataacctactcacaagcactctatggtccatgatttcacatacttggaagagctcgtagtttcttaccactttgaaacttgcttaatggctactatactaatgctgctgcctattcgtttcatctacttgttccagcttagatgtgtcttagcagtgtgaaatcagttcaacagcaatcctagtctgccgtaaaccatga

SEQ ID NO: 24720 - DNA, 19246 bp, Oryza sativa
  unsure (1)..(19246): unsure at all n locations
gtcctccaaattttatctgagactcagtttactctttaatgtttttatatgtccatattagttcttcaagtttttattaaagtccaaacttattcttgaactcacttagaagtcatatggctaaacataaccaacaactctcttgataaatgacacttataccctcccttcactcacatatataagagaaaattttgcgtgcaatgaattcttttatagatagtgcatagtaatttatataaacgaaactaaattatgtacttgcaagtgtatacgatagccattagactcaagtttcaagtgtatatgttgaaataatggaaagtacatatgcattgttgtttattcatcttggttttctcttttctagggtagggtaaaaggggcattttctaacagaactgttgaatagaaatagccatatggcatattaagtgggcccaacaatgattttaagccaaaacaaatacttagaggatctatatggataaaataaaacctgaaggatcaaattgagtcttcggtgaaacttaaaggactaaattagctattcacccatcttgtaaatgtgaggtgcgagcacgtgtagaatttatttgaaatatggagggatttttcccatccttttaaattcatttgaaataatcttaaccatccaaaagactcgtatataggaatttttcctttaatttggattgaatttacctagttttcctacaaatttggattgaagcccttggtcttcagatatgcatacaatggttctatttggcacagctcgagacctaagattttctaacgctagccatttctgcctatagaaatccataaatatgatctaacattacagtttggataaatctttctgttcgtattttataggaaatattaaatttcaaatcactgtaattttacttacaaactttaaatccaacaaagatatgagatctagagccgtgcccagggccgtgccgtcaaatttgtaggccctgtacaaggctctaagtgaggcctaaatcaagtaacaaatatagctaaaataatgtatatactgtagagcaaatgcgatataccaagaatagtatattttttaactcttgttttgcataatcagaaactgtcaaactgaaaacggagaatggtcgttgttggtgctggcttgctgcctagtgccttgcttgttggttgcttgctaagttagtattcactggttgaataaaaatgtgaaattggatgagccggctggcggcttggtgctcggaggagacgagacgtcgagactcgagacgaattgaataagtcacagatacgaaaacgaaagagaatacaaaacgccgtgggccctcggggctcggagttgagaatacgaagcgtcgcacacgcgaagtcgccacgtggagatacgcgcggactcgaacggggttctggcgctctggcctcacacgaatacatgggatgggccttcttcagttgggctgattttttgaggccctatacggtcgcacgagccggatgcccctgtgcacggccctggccgtgtcagttatgtgcatgagcctatgtttgagggaagcttctggcagctgcagtttttttaaaaaaattcttcagctcccctaaattgtccagattattttaaccaaattccaaaatatatatatttgtagaataaaaaacaaactaggagttagaagctagaaacccatatttttatattcttgtcatcatttgtttcatagaatctcgagctaatagaatcttgagctaacatatatataacagggcctcaagagcctattaagagaaactttagattctgataaataactgatgagaatttagcaggtgagaatccgaaaaggttaggaaaaccaacttatggtatctagtctatttttaaaattttgtaactacagtatatcataatttgaataaaaactaactattcgagggaacttgtgagatgtgttacaaaatccatgcatgggcatgggctccaacgagaatgaattaacggaaatcatgatttagcaattgagccaaggtggagtaccggaaccggatcacacggttaggcgtgaaatggagcaatggagcccgataggcgatagcgctttacatgcccattattcaacgacgtccatgatttagcaactgccattaggtacacatatatcacgaaaacgatgtctacatgtgctgattcaacctgctcccacttttcaccctactttgctgaagcagttagacgttgcaagtcgcaactatttatcgaccagccttcgatcatccccgaaaaaaaagaagacttctcgatcgtgctatatccttttcccgtgagttatccgaattcctacgtgaatcttttcgataagtttggcgagaagcctgctagctcaccggccggccggccgtccattcgagcccaacctttcccgggtcgccgtcgtacgttgtcgttgccttctcgtcgccatgcatgcggctgacgcgaccaacgagctgtatgcgcgtactgtgcgcgtctgcgtgcaaccgacgccaacagtggtcgcacccgtctcgcgaaaggaagggtgaaaaaaaccacgcatctgcagacggacgtcgtcgccgctggccacagtacgccccccaccgaccgcgcgtacgcctcccgaaaggcgcttttttgaggggaaaagatacacgactactcagaatctaatctatcctcgcctagctagcttttagtttttttgttcggtcgatcgatcgatcatccgatcgccacggggtcgaagagcggaggcggcacatgtgctcgtgggaggcagcagatacggcactctcgttcatttgtttcgtcggccgcggcgcgatcgatcggcagtgaggtaggagcggatgggtactgggtacacatcatacatacacgatggctgaatctgaacggcttcttggtggtggccgcgccgacgcgcgtacgtacgggcaattgataactgatcatctagtatgctgtatgcatatgcttgcttcctctttgcgccacgtactgtagcaaattggtactgtactgatcatttctcttgaattcgaatagttgagctctgttaaattaaacaccataggagtattttgtttcttactaccgtatatttgtatggaacttgtctggcgaggccagcatcaattcgatttctcatttctcgcacagactccgtttcggaaccagtacacaggaaatgaatgaattaacggcatccttggtacttgggaaggaagactaatggactagcgtcgacgtgttgcgtacgtgattccggtagaaaaattgggggcagtcggcggaggtcgacgtcagtcgacgcttcagtacgtgccagatttgcttacaagtctcggttgtatatatcctcagcctcagatcattttgcctgatcaaatttgtttaattattagtttgtcgcagtcaacgaatgacctggcatcgacttttacctacgtactacaagtcgtggattggttacctacaagatgcaaagagaattcatgcacgtaagcaaagtgagcgtgaaaactaaaaactaaataaatgatcacgtagatcaactatacaaaaccactttctaagaggagcactgctgcacgtatgataaatctcaaatgatcagcgtatgatacattgatactttgtaatatcttgtgagtgcggtaaatatagggactaaaatgtcttcacgtaatcaataaatcatgagaaaaattcctatgtactcttgagaattcgtccaatcctttatatacccctgaatttagcctcatcctttatatatccatgagtttttattttgatctcctctatgcccattccgttagttgaccgttaaatatttttgaaattgacaatattacccctctcttttacttatgtgctagtttaatgataaaaacataattcttatatgaaaaaagatctatttgtaaataaacaacgggaatataattatttgacaacaaattttaaaaataaataaaaacatttaaataaattttaaattaactttgttttcatcaaaatttgaacccgacaaataaataattttggttcacaatttctagctaaaactcttatatggattttgtcaaaaaaaaaataaatttgttcaacaatttaaattttcttttcaataaataattatgtcccatttgattttatcatgagttacagtttttcacattgtgaattgtaagaatgggaaatggacgatatggtcattttaaaaaaatttaacagtcaactcacggtcagctaactaaatagggatagaggagatcaaaatgaaaactcaagggcatgtaggggatgaggcaaaattcaggggtatagaagagattgcgaattttttcaggggtatgtagggaattttctcataaatcatctaatataatcactgtgtgcatagcaatttccttctaagagcaccatgttaacttaaaaaaatgattacatagatcataaaaagtatcacgttgtacatgttgattaaatatattgtgcctataaatttgcatttaacatcgtaggcaccaaaataaccaaatacattgtacattgtgggaacccatgtatttaatcaacatgtatttttgttatgtacattgggggattccaaattaaccaaatcctaggttaaaaatctatttgttatgcacattgtgggaacccaggcaccaaattaaccaaatacaacttagagtatttattattgattataaattttagacttgagaagctacaactaagtctccaatcaagtatattatttatgaatttaaaaataattaaatcataaagaaaaccccttttgatatttttaaatatcaatacgttcaacacacatgttaacaattagtgcagtatataatgaaattaaaaaaaaacttttgattatatggcagatgcacatgcacgtacaccaaccacacatgaaacacgacactttatattcgtgaatataatttctaacgcatactcaagtagatggaaaccgacagtacattctttatcaccttaaagttatacttaattctatgtagccttcaactttggtttcttttttttgttgctcagaagtcagaagtaatattgttccgtttacattcgttacactacaactttttccttgttatcttaaatattttacgagtgcgcaatatgaaatgctaacggttccaaaagggtccgtccttttctcttcacaattcacaaagaagcataaataaagaaacaaaataaaaaaaaaagatactattgcgcaccgctaatgcggtggtaatgcagcgccaccattgatccaaaggaaaaaagaatagaaaaacaaaagaaaggaagaaaaaaaaaaggaagtctaaagaacagaggaagagaacaaatgccagcccttccgtttcgccctttcggctttcctccgtcgtggtggactcctcccggctacggccacacggcgccgcaccaaccccccaccccccgcgcctgaattttttacaatttagtccttttgaaaacttatttcacaaatagacccctggagaaacttatcccagaaatgattttttctgggataagtttttctaggggtttattttagaaataagttttccaaaaggatcaaattgtaaaaaattcatgacgcctgggacccaaccgcagggacacacacccacacgcgcatccatccatccatccatccaacccacctgcgcaggacgcaccgcaccgcaccgctccgctgctgctgctgctgctgctcatcatctctccgaagcttctcatctcctctccactcctcctcctcctcctccccctcgccacctcccacgcgctgccacgccggcgacacgaccactgcctccccccgcgcgggcgcgccaagcgccgggatcccgctgctgcgttccagttcgcggccggggcgtagtaaccacaggtgaggtttccttttgggcgggtgcggctgcgttttttttttctctctgagaattgtggtgcgcccccgccctacgcgggggatcggtgaattggatgcgctttgtcttcctgatggccgctgcgagggaaaagtgggatctttttgttggtggtctactgattttgatttttgcggggggggggggggggggggcgttctgtcctgtttgcgtagtgagtagagttcacgctgatggtggtggggaaggggaatggaacggatgagttgccagaattttgggaatcggggggcggttggcattggtctagttgggttagttttacttgcttcgttagctggattgttaaagctccaaacttttcatggctcttctgctcagtttgagcctgtatggtgtagttcaggaggtgtgttttgccgtgggttggttagagaatttgatgagcctggaatcgacgtaatgaatattggtctctcttgctccagaagaactccgaatctgttgccttgatggcacgtgaattttcagttgataaagttggagtttcatcatggatttgtgtggtaacttgcgggataaagtaagtttcagttcgttttagaagttgaatttctctatcctactttatgagagattctaagagttttctcgttttgctctgaatttatctgtatatgaggacttttaggggggggggggggatgaccaatttcttgaaaaacctattgtttaattggagctgttcatttctagttcccaattttcagtaaatgcgttcttagcaagtgattgcttgataccacgatgataccccgcaaatgcatcctctccgtaattcaggatcatatgatgttaaattgttaatcactagttctttcccagtatgtgagttcctttttttgttcttctctgtaaatttagcccttgtttgtgtcacagtctctcagagttctagaattcacactactgataccgaatcttgagcacagtcagtttgactgtttgagcattacgtatgaatctgtttctacaacgatgtatgtaatgataatgatgattgtaatttgtaattgatgcagtatatatagactaacatacagagctgctgatgaaacattagcttatctttcttgccagcttaatcaactctttgataccatctaatagcaaactccctttatataaaatacagacacaaagttacacagttgaccattatttcataccaaaatagcttccccaaatactatcttttatctgcagtgcatgcccgtaactttttgtttcttgtgaatttcagcagtgcaatacaccttaaaatggggtctacacgatcaaagaatgaagatgacaaggccattgtcttatgccacgaaagaaaacgatatgttagagaagcacttgatggaagatgtgcattcgcagctgctcacttcgcttatattcaatcactgagacacacaggatttgctctgagaaaatttttggagcctgaagtgccaacagattcttcgctgtacacatcgacatctgcaacaccagaacctcctactattcggcagaaatcgaggaacttatctccatctatttcacatcaggccagtgactctttctccccagttccatcccctttatcttccggacggttccgtatcaatcatatgaaatctggggggaaccctgtcatgaccattgaggagaaggtgcctgttcctgtaacagcaactctacaaacatcatcccttgttcctaaagctgtacatgacctggatgatagttccacatttgaagcacctccagggacaccaccgtgggactactttggcctttttaaccctgttgagaaccaattttcatttcatgacgagaaggagcctggtcatgactttgaaaacgctgatgatatcaggcgtcttcgggaaaaggagggaattccagagctcgaagaggaaggggagaagactcctgtgcatcctgacaatgttaggcgcttccgtgatgagaaaacttcagatctcaaagatgcagaaaaatctcctatcaatggaagggaggatgattttgcagagtcagaagatgatttcgataatccatcatctgaacctttagtgagggtgttccagaaccgcaatgatatgcctgttgaaaatactgtgatgaatcagacacctgaacatgtggcttcagaaaagttagcttcagagaatagcgtttctttttctcgaaaacaggagaatagtgattctttttctcgaaaacaggagaatagtgattctttttctcgaaaacaggagaatagtgattcattttctcgaaaacaggagaatagtgattctcaaattgacaggccaaacaatgacaaggaggtgctagacattagcatgtttgaaagtgatgatgaaagccctgtggcaagccctgtaaaagaagtgagatcttccattgctgctcttcctatgaatgggaaatcaaaagaaccttttcatgacgttagaaatggtgcgaaggatttgcattcatgcatgaaagagattgaaatcttgtttattagggcatcagattctggaaaagaagtaccaaggatgcttgaagcagataaagtcaatttccggcctttactgcctgaagaaaaaggttaggtatcaataaaattaaattactgttctgtagtatcttatttggaaattgcatggaaaataatggcagaaagattttgggatgcaaaaatatcatgatgtgaaaattttcatgattcttttcaatgttatccatctatagaatatcttttgcctgtgatttttatcatggacaattctgtctttactaattttattgcaattttggtgcagcacatggatcaaaagcatcaggcttctttgcgacattctttgcttgctgcggtggggaggaaattcctattcctcagcgtaagtttttatatctgaaatacagtctttccgcagcagattatgttgctgtgtatagttttgcatcatatcatgtttgtttcatgcagtttattcctggatctctggttaaaagatttggtttttccacaaatggaaaaattctatgttatctacaagctgatatgtactttccacattctcacacgagcaattttgacagaatcttaattattttgtcttttaccttgtattatatatgttacagctttttttctcccttccaccataacaagaggtgcccttttgtcataatgcagctcctcctgaggctgaagtgaagtaccttacctggcacagatcagtttcttcactctcttcatcatctagaattcctcttggggtgacttcaaaagatgatgctgatggtctcactggaaatatctttagtggtgtatacatgaattctggcagtcacgcttcaacactagatagattatatgcatgggagagaaagctttatgatgaagttaaggtacttgtattttggctggtcttgttactaaaatatttactttagtttatctgttctagccagtttttgaaatattgtaaagtagagaggtagcaatgaagtgttttaggattgaaactagccttctttttttttctttttttttttgcaaaaagggaaataagatcgattttgaactaattaaaacagaacctacctagaacatgtaataaataggaactagccttttttttttttttgcaaaaagggaaataagatcgattttgaactaattaaaacagaacctacctagaatatgtaataaatgggacatacgaaaacctgaatgtatttgatagaaggattgcgactcactatatacaacatggcaattgcacaaagtgctactgtaatcattccacagcaaccactcaggctatttaggacaattatgtaagtagtgtgagccagttacattattttcttatgtacctacgtaatacagccataaaaaaattcactaccgatgcccacttatatgttcattttgcactttttattcctattcccttcacttaattcctttgtactaatgttcttgaataaataagctatatccgtgtatgtttgccttaatctgtgaatttctatgttgtaaacatagttaaatcatataatgatggcaaatttgatgatttgtttgaaatgctaacctttatattgtcttcaggctagcggtgcaatttgtaggcaatatgacgaaaaatgtaggcaattgagacaccaggaatcaaaagctgaaagccaaatgagtatcgatagaacccgtgctactgtgaaggatttgcactccagaattatagtggccattcagagaattgacatgatctctaagaacattgaggatctaagggacaaagagcttcaaccacagttggaggaattaattgggaggtatggttcaccatctatgttttactatactgttttctagtgacatgttacaattcaatgaacactttaatgtcgatgtcagcatatttgaccagcctgatcaaggcccctttcaacaccttaggtcaagttattagtagatttactcctggttttggattatgggttttgaccataacttgcttggtcgaacaaccgccaggtgtatgaatgaaacaaagggccaacttgccctggtcctgtttttgctctagtctacattaacagaagataaatggataaggtagtacttaccattgcatgttgcttggggatgatttattcctacctccagcattgcccaagtttcataaagttgtttgtgagctttgtagaatataataaagcaatttgatgctcatgtactgcatgttacctttgtctagttatttactgatagttttccaatatttgcattttaatagatagtatatacatctcatttgcagtttaactcgcatgtggtctacaatgcttgagtgtcacaaacatcaacgtgagattattaagtccagcagtggcaacacgaaggtcttaattcggtcggagtcacaatttcaagcagctctactcctccaggttgagctaaacactttatattcaaccttcctgaaatggatagcataccacagatcgtacttgcatagcctaaattcatggctacttaagtgtgtgaaaccactgaggggcaagaagagctccaggaggaagaaggaagcagatactcccataactaaatttgctgttgcacccatgtttaaaacctgtgaaagctggataaagttattggatgatttaccaaccaaggacttggaagatgctatcaaaggcctcgtggcagatataaaccactctgtgcctcgccaagaaaagcggcgtggtacttcaaagttgacttcctcattatcccgttccagtagtaccaagacgatttcctcattttctcggaatggagagttaaatggtgaaatgtcagagatccacagaaattcccatactacggatttacagtcaagtttggagacattcctagaggggtttgcagagttttcagatgtttcactgaagaagtatatggaactcgcggttgacattaacaaagcaaaggaacaatatgagaatgtgaagttaaagaacatgggaaagtgaataagttcgacaaagtcagaccaaaggaactaatttctggaaggaagaatgggctacaataactcaaagccatttagaagtggataagtggatcacccatgtgtatattagcctgtttaaacaataggtataaattactgttacttttctttttgggttcagtttgcaagataggtttaggtgggagaggaatacttgtagatttctggccaatgccatgccgcagaagtgtaaatctgaggtttaggtaaaattaaactgatggtgggggatacaatatgtgtatttatcctgggtatatcattatatgagttttcccttttcttctctttttgatctgtgtagaccttccagtcctttatacagctagacgtatctatacagccaatttctccttttgcggtgaatccctgatcgaattgtgattgctagaaatgtactgtttctgtgcatttcgcagcgaatgtttcactctgaatgctgtgttacactgaatgtttgtgttgaacctggaatatatttccttcgttgctttttactaccttctcaaaggcctcaaaacgtcaatttcgcaaggtggtattgttggaggcatatgtcacgcgaatgtttcactctgaatgcggtgttacactgaatgttgtgttgaacctggaatatatttccttcgctgctttttactaccttttcaaaggcctaaaaacgtcaattttgcaaggtggtattgttggaggcatgtcacgagggccttcgcctgggcctgccgaaaccacaagaaccgtgaggtgttggctgagtccatgaggcgaagcagctggcgaagctagatgatgaagaccgaggggttcgccaccaagcccatcatcctaacaagccttcactacgggcgaagaccgtagagcgaagcaggaaggttttgctctggttagaagcggttacggcagagggcttggaaaacaccgtggcccatggaggcctttcgtcagtaatgggccagcctaggagttcacttataagcttatgaatacaaaggatactgtatgccctcactaaagtccctatcataagggtaccatgtaaattccactgtataaattaaaccctataaagtgtcagtgtgtactaaggctataaatagcaccatagggctatgtaatgggggatcccaaaaatttcttaccaattaatatattacttttactattccactcaactcagtgagtgaaccatatctttcgatgtgacgcagttgtctttcgacagcaggtatcaaggaagaagcaacatgattttgcctagaagaaaatttcttaaaattttctttattatgctcttcatattctctttaatgaaatttatgaaatatcccaatgaatattacagtaactatctcatcctgttttttctttgttttatccggacgaacatgatgtgtacttgtgcagagtgtgtcgtgcatgtgcagtggtgtacgtgtctaatataggggctgtaagtgtaaactttttatattatcatactacctctgttccaaaataattttaattctagattatttgacctatattaaagtttgagaataaagaatatgatgtttcttattaaatgacgtatagataaaagtgaggatggttgaggatagaatggagagaaatttaaatgagaagtgattaatataacaattagtactatattgtaataactattttatgataaattaaaccctataaatataattattataggacggagaaagtattttttttcgtttggttttatatgtgcttcagatattactggtgggtgtgtgggtgttcctaatgctacatgcagcagcggcccatttaggcccaagagttcatcgcgaatcgtcgtcttctctccatttccctttgccacgaacaaattccagaaacaccctcccatatccctcgcggcgggccaacggacggggccaccccacggcttcgcggcagatctccctcctcctcctcctcgtcctgggcggctccggcggcgtcgccggcaggggaagccagaacgcgatggatctgtggaacaagctgcggagcctcgacgcctaccccaaggtgaacgaggacttctacagccgcaccctctccggcggcctcatcaccatcgcctcctcgctcgccatcctcctcctcttcctctccgagatccgtacgtcacgcgccacctccctgatccctccctctccgcctcagatcccccttccgatttttcgggtttccgcctgccttgggtgtgggggcgcggtggctttttttgcggattggttccgtttgttcacgtgtgttagggcgggtgcgaaacgggaggagtctgtggttggttgaccgtccgatcgagtgggaattggaaataacgggcggataattaacagtccaatttaacatgcatttgaatcgtgtattcgtattggttagaaggtggcgtgaggaattaattacatgaaggtaagaggcgcttggtgtggagggtacggtagattagtaggatgtatgatctagaatgctgttgatttcaattgccatgctatggatcagttggtgttatcacttgtcagagtgttggtatttgtttcattttgcaaggatgtttttgtgtggatttagtgagtcatatgtaaattgttctgttatgctaatatcattaatgtgaagagccatggtttgattaatttgagagcatttcatgttaccatttctagttctttttttctgatgggtagattaattgttatttgccaatactttactagttatttcctgcactgaacattcttaacttttctgcagggctgtatctatattctgctacagatagtaagctcacagtcgatacctcaagaggggaaaggctacacatcaatgttagtgtggatgttcattttcattttccccgaagtttccaattttcttgcattgctaagacattttgcatctccagtttcctcttgttaatttgtgcccctccatgcatgtattcctatttggaaagccacgctcttgggcatttaggctccatctatatattatattattaagacaggcttgataggagacatcatgttccttgtggaggctagaaattcccacattaatcggaggaaaacaaaaagagagttaaataggaatacaatttagaaataactgaaattcggaattagaaataaggaatattggaataacagtccatatagaacccaatacgagaataattaaaatctctactacttaaaaagactaagatgattctgtcgtccatcattgacgtcacagcgcctcacgcgcattcgcgtccaagtcgtgtgcgtttcaatcctgctgcatggcaccgtatcgatttaaaggatttttcttttaaataaaaggggaaaggaaaacgtggcaggaagactgcctatgataatctgagagcaaatcaggaaagagttccaataaaaacgacttcacgccaattcaatcgtcacccaatttcttgctacgtaataggagttttgggttgtgcttttatagagaattgaatcgggttttttcttaagattggtttgagatattcttgtgcctttcatccagaaaagtaagatatgccccggtcgatgattggcgatttatctgtagcccgcttggctctgtagctccgtatgcatgcacatccaattaagctctctgatgcaaagatggacatgtttatgagtagattttgggatttctccctgatgtgcaatcatgccaaagatgtctaaattgaatcctaatcatttaagattgatcgtaaatattaattagtttctcccattacaaagctcgggcacatttgctagttccagtctaatttatctttctttactcttctaaaaagaggagttgaggtgattggtgtgttctcacccccacattataagatctttagtggttgcatatacgtggtaacaggatatttatacgttctttgcattttttttatgtgaaaaaaaggcattccatggacgtatgcgctaattggtcttatgtaaccatgtaaacaatcttgaggtccgaggtatttttttttgtatgtgtgtaatcttatgtggccactgcacatgccattttctgcaactagttgaggaatcctatacttattgttaatttatgttgctgcacttttgcagtttgatgttacgttcccagctcttccttgttcacttgttgctgttgatacaatggatgtcagtggagagcagcactatgatatagtatgtacgacagttttcatcagtttccttattatattatatatattttgatctgttttaaaaagtgcttcccaagcactgtatcacataatattctacctgaggttccaaaccatctgctttgcagagacatgacataataaagaaaagaattgataatcttggtaatgtaattgaatcaagaaaagatggagttggtgcccctaaggtatgttttcttacttttaacttgaaaaggtgtacaggtgaaactgttctgtttctttttccttcacattcatcaccattggaactgttcactagtttttatcttagaaaatttgagatatactttagttagccaattaattttataaccagaccttgaacattgtggtctgtgatatttttcttttactctggaaaatagctggtcctattgtgcttccgttataaaattttggccttcatagtgcttgcatgcagccaggaagttattttagattcttctagttgttagtgactattcttgttgtgattttccagaaaaacaagcataggttatttatgctgccactttatttatgtcagtaacctctataaagaaacaaattgaatataaatccaggcatactggcatgaagggatcggtataatggttgtgaaatatgctgtcaaggataatgttcttatatcatatccacgcatagtagtggtgtactggcatgaaggggttgtcatattattattccttactgtatgatgggtgtgcgctatgttggcaaaaacaatatttaactttaactaacttgaatcatggaactctagattgaaagaccactgcagaaacatggtggaagacttgaccacaacgaagttactgtggatcttgttatggttctgaagaggtaccttgtacacttctctaataccattatgttgagtttgcctatttttattaatgtaactatttatgtatttacacctatattatttgcaacactaatttttatccttcctcttccattgaaattgtaagaaaaactaatattgtttttattaattcatcagtcagatgatcagtgctgtaactcctgtgaagacgtccgtgatgcctatcggaaaaaagggtgggcactcaccaatatagaagagattgatcaggtactacgcacttaaccatttttcttcacacttacaagagattgcataatcttgttcaatcttcctgcacatggttcttagcaaaactcgtccatgtattgccccttgtcatgtgtttgtccttggtctgttcatttgctaactagtcagttcttgaaacagtaatttgtggttgagcattgtgtttccttatcaccacatagatcaatatagaatattactgcactactatcttgatgtcgacggcatgttcattatatatttgtgtaatgaattatattgggagccatggcttgtactgcatctagccatatgctagtaagtagcctgcaacccaattggcaatccaaatatgtctataaaagttaagtttgaattatagcctctatcataatgttgtttggaaaaaaaatctgtattaattttgatcaaactatcttatagcctgcacttgattttctcttatgttgcaaaatgcgatgtttggtcattttgttgcatgcaacatgaatatgttaacaaattaatgcaacccattttgtcttcctaatgaacttatttaagagtttgtactgcctgctgcctgcaaccaatgcatgcagacatcttctctatcagttttatgcttctatcttatccttaattgacttatgttccagtgtaagcgagagggctttgttcaaaggttaaaagatgaacaaggagaaggttgcagcattcatggatttgtaaatgtcaacaaagtagctggaaattttcactttgcccctgggaaaagcttggaccaatcattcaacttccttcaagatctcttgaacttccaacaagaaaattacaatgcaagttgattttttttcttcatccaccttattgaaccattgataatactgagcataaacaattaaacatgaacttataatggttttactgaaacagataagtcacaagataaacaagctttcctttggggtagaattccctggtgttgtcaatcctcttgatgggtatgtttggaatttagagaagctatatcacatctctctttggtccttattttccatgttcctgatttcctgtgtatttcagtgtagagtggatacaggagcacacaaatggattaacaggaatgtaccaatactttgtcaaggtaatatttttagtatctagtcacgtttttctcttgtggggaactagtcatgctatttaatatggttgcacaatgtcatgctgttggcgtatgaagagatgtcatgctgccttctttagtttatgtgcctcttttgtgcaggttgttcccacaatctataccgacattagaggacggaaaatcaactcaaatcaggtaagcaacaccgttctataacatactttattctgaagccaaaacttttgattttaattctttttttcttttgcagttttctgtgacggagcactttagagaagcaattggctatcccaggcctccgcctggtgtatatttcttctatgaattttctccaattaaggtgaagaatggatatactgattttatgtagtccttgaagcattaggtagcgatatttctgtgctgtctattgattagtctgtaactatgctatctagtctacttagctgcatgctttaaaaccacaagcatatgcctgtttttgtttcctgaaagcatcatgtcagttttctagttacatgtcaatttgtttagctcttaatacatacaattagtcaatataggctatttagctgtatgctcggatgatcgtcacaagcatgcctgcatttatttcctgaaagcaacgcatttgtataagatattatgcaacaattaccatctttgcctgcattcttcgtcctttagattgaagttatgtcatttgcctgataatttgattgttctttggcaggttgattttactgaagaaaatacatcgcttcttcacttcctgacaaacatatgtgctattgttggaggtctgtcatagctcgcaaacttgtttatctttttgtgctttccagaaaacataagcaatagactgatttttgcatgaacatattttccaacccatctttcaattgcaatcgtacagggattttcactgttgctggcatcatagattcttttgtctaccatggtcatcgtgctataaagaaaaagatggagatcggaaaacttggataattccatatttagcatataccctgtaggatcatagtttgaattgagtcgactaatgcttgcctgagaaannnnnnnnnnnnnnnnnnnnnnnnnnnnnnnnnnnnnnnnnnnnnnnnnnnnnnnnn

SEQ ID NO: 24721 - DNA, 3538 bp, Oryza sativa
atttatttcctgaaaagcaacgcatttgtataagatattatgcaacaattaccatcttggcctgcattcttcgtcctttagattgaagttatgtcatttgcctgataatttgattgttctttggcaggttgattttactgaagaaaatacatcgcttcttcacttcctgacaaacatatgtgctattgttggaggtctgtcatagctcgcaaacttgtttatctttttgtgctttccagaaaacataagcaatagactgatttttgcatgaacatattttccaacccatctttcaattgcaatcgtacagggattttcactgttgctggcatcatagattcttttgtctaccatggtcatcgtgctataaagaaaaagatggagatcggaaaacttggataattccatatttagcatataccctgtaggatcatagtttgaattgagtcgactaatgcttgcctgagaaaggtacgaagtaaattcaggaggaattttggctaatatgttgtaatacattttctagccgctcagacttttgctgattattcaagcctagagcatagacatgtttgtataagctgttgcatcgtcgtatttaactgtgttttgggctaaatgtactgtaacatattcataaaccttgcagaaagatgtatttcgctccatccccagttgcccaccccacaccttttttctttttttggaaaatttcatccataccacagacaatttggtcagtagcaataaataccacaaaattatcccacatccgttttataccacaactccgtcagatttgtttcaaaaatacctatctttacttctttagtccaaagagtacttttcgcggagatgccactccattaatgtggtttcgatgaaatactactcactaggatgcaaaggataaaatgtactaggatgcaaagaataaaatgtcacttagtaggttacctttagggacagcatgcgagcgtgggcgggccctccagcaccgctccataggaggccatgctgaagagtggtctttgccaccacccccgccctctcgtaggatccacgcactaccctttcttgcctgctctcttcctatggggctacgtgttccccgccttcggtgccacctgcacacgcgcatgtcgtcctcgtggccctgccaccagtgagcactccagcaccactgtccaattcggtctcccttgacgctcccctattccttcctctctctatatccaagggtattttggtcttacaactctctaaactgacacaatatcctaaagataaaccactgagtggtggtttatcctttgcatatttcatcgaaaccccataaggccatgggggcatattgtcctttttctcactttttgggcttgtttactggagcatctccaatagattaactaaatcaggctctccaaacatccatatagccatctctctatctaatttggcaaatttaactcgttactcactccaacagcctctccatctacgctctccattctgagtctatgacagtgagacctatatgcagtcttttcaccatatttccaactacaatgccttcaatattccatccttcagcggcaacaatgctaagaagagggggagaagccgatggtggtggtaggcagcgagagggatggatagccaatggaggcggcacgtagcaagagaagacgagagcggcaacaacagcaccaactatgacggcggtgggctcacgaggtggggaggtgaagctgtgatggctagcgacggaaggagcgagcgaccttggtcggcggtagaggtgcactcgcttggtggggaggcggaggcctgacgactattgacatcggagtaacgaagaagggtgttgtcgagctacccaatcggtggcgtccttgctatcgagctgccccgccagtggtgccctccccacctcaccgttgagtcaccgccccatcctcgccgtagagccgccccgccaccctcgctgtcgagccgtgccaccactacgccctttcacccttgcccctcccttgtcgttgctgcgctgtctcgccctagctcctcctcgccatcgagccaccccgccaccctcattgttgagccgcgttgccaccacgcgctctcgccctctcacctcccttgccactgtcacaccctcctgcccttgttccttcctcgtcgcacccgctgttgcgctctcccgccctcgttccgtctcctccaaccacgggcagaggcctgtgctgggtggccggcgctgtggagccctgctggtggctgcctggcactctcaatgggaagggggcaagactgcaggagggcggagaaaaagaatcatggggcccatggttgacaagtgatgttgggtggccaaatttggtcagggagggaagagatttggctagggagaggttgttggacttggaacacttttttttttatagagttgctaaattttggcttagagagacacttggagaggagatgatctttgtcaaagttaccaatttttgacattggtaaggtgataaactaaataagattttaccattacaataccaaactctgttaaaaatgagtaattctacaaacttcaactcacataacacaccaaattattgttacctctgtccataataattgtatttctaggatttgaatttgtcccaaaaaaaattgttacaatagagtactaatggtctcattaatcacatcacgttcaaatttctttctattttactctcaactacccttccactcttacctatacaccatttaataaggagtatcatagtctatcttttcaaaccttaatatatgctaaataatctagaattataattattttgggacggaggtagtaagatattaaacctaacatcttcatatttttaaccttctcataatttgatattgcccgtctttagctttactaataaatggtgaggtttattttggtaacggtaaacatatactacctccatattaaaatatagcaatctagaatgagatgagatatattctaggactatatattcatagtcctagttgttacattttaggacggagagaatatttttttaagcaagtttactgggaagctttgcaaatacatgcggcgtgcacattggtccagaccaaacgagcaaatgttcgatgtactcaagccaaacgggcagctggctgaaactgttcctgccagcaaagccagcggctgaacggccaaccaatgccgcgctgcactgaactcagcatcagtcgcgcgggccagagcaaacgttctctctcgcaccgcacgcggcctgaccccgcccacgtcggcggccgtcccggactccccccggtcgtgcgcgccccggagaaatcgcgacagggagagccgcaccgcatgcgcccccggccatcccatcccgtcgcgctccccgcccgagcgattcctcccgatcggccgtccgggccccgtccccctccgtcacaataagtgcccaaagtcgacgaggcctttttcacgtgcccgcgacggcgacgcactctt

SEQ ID NO: 24722 - DNA, 6562 bp, Oryza sativa
  unsure (1)..(6562): unsure at all n locations
nnnnnnnnnnnnnnnnnnnnnnnnnnnnnnnnnnnnnnnnnnnnnnnnnnnnnnnnnnnnnaaagaatgactaggaaatcagtcaagatcttcccccatatctccttctagatccaaagttttcaggatcattcaggttcctaccatctttcaggtgcaaaatacctttctattgtgatcacaagcaaaatatgcattctgcacaaagtcacagcaagccccagcagattcttttctctttccattgtctcccgatatcaagaagcaaagcgtttcctaccctgtaaacctaaggactcttgaaaccgaagaaaacaaaaccaaagccaatttcttgattaatcgccaaggcaaggctaaataaccctttatgtcagggttgacccaaacacctcacctcatgaaggaattccagagcagcaacacaacggcacgtaatgccaacggtaagaacaaaggacgccactctggaggcaattaaaattttgcttcccaagatacggacgccgttttttctactacgtttgattgcactaaacacaatactttaatggccatacggccatacagacgaatatcttaatggccatatggactaatattcccctaatccttcgtcaccagtggcaggcaatggcattaaccgcattgtctagtggcaacgggagaaactgatgttgactctctgatgagagaggcaggcctgaacatgtctggataatgctcgcatcgtcacatgacagtcgaacacgaccgttgagtgtgcttagttaccttggatctaaagccatttcaggctggcttcaacgctgcaacgcctgcttgattggatcgatgcagatactacatcttcgttgacgagagatcccatggttttagtgtccgttgcgatggtaaatccaacacagtgtttggttcttgatgcctgaagaagcagctgaagaaaactgaggggagaaggatttacagtgtcctttcaagacggctctgaatctcagtatctgaatctgatgattctgatcacctaacattcgtttaattagttgataacttgattatatattactaacagcttttacccatccatgatgctgtactatttgattctgattctgatctctgagccgacccacagctgcagttttgtcattatccaaatggactccatcaaagatcacatcaaaggccataagacagggacatcagcaaaagcgattgtccgttaacccaaccaccgtctaaaatgccatatggaatgattacatttcatctcatctcatttgcccccaacacttcaccaataatcaatacttattagcaaggacacagcacaaaaccattaacatcacaaaaaagagagggaaagaaatcactaatagtaataaagttgttatcaacaggttgtttacctttccttccgtcataatttatctcttcctagcactcctccactagctcctacataaaagaccggattaatcaaatccagggtcacagctgcctccattactaaaaaaaattgtatctttaaaaaaaaggggaaaaaaatagcgattgaagaagcaatttgtcacaaacagttcatgcttcacctaacgcgaaattggacaaagtccatctataatcactagcagtagttggtaaccgtggacaagaagtatacaagctaataagctatggattagtatggaatcatatagctggaaacatgtgttctttttttgctaatcccctccctaattaccacacacatgccatctagctcagaatgatacatgcaaactcagcaaatcatgcacatttttcttattttctcaaaattaaatggttgaattagtcaaggacactattgcactaatgccagtagccgttggaagggcaacagattaacaacaagagagtacatatttcacatgtttgcagctcctgggagacagtccagataagagcatctcaactgccttctagcattttgacaatgccaacttcttcaggctcaattatggaatggattatacactgattactctccagaactaaattatccttagcattgaaggtgcacagaaatgtgcagtatagattaagtaataagacgatccgaaatgctgcgtaattgcgcttaatgtaatgcagtatagattaagaaagcttgttcgtaccactaagtaactgcaagttggcaatgtaccatatatcgtccgtcccaatctgggagcgtgcaagaaagaatcaactgatgataaatatgaaacaattggattagcattataatgatggatcaagtcactgcttttctttcagataagttggacatggcaatgcagatgtagaaaggggaacaagacttagcaaagggggaagcaaaactggttaccccttagctcatccatttgcacattttcataggtgaagcaatagaaagaaaaaggagcaagccaaggcaatcgtggaattgccagtttaacaagaaggccccacagagcacatcgggagatcctaaagattgtcccaaaatcccttgttatcttttcgaacggccaaatcccttgttatccattcactatctgtgcaattttcaccctttgttctatggaaggaacaaaaaaaatccttttagataggcacatgaactgaacaaattgcaaattggatgcagtttcacttctgaatttttatataatggacatagattacatctccggctctccggcttctgttataagaagcacagccataagtttcacttcagaatggcagagagtttctctcaagaaaggtgcaggatttgacaatgtggttgcttaattccattttgtcgattcatgaaatggacagaaccaagtgaagcattccaaatttctaattccattatttgttgcgaggatgatgctaaggcagtatcgaaaagtcgaggagacacacgatcgctgttacaacatggacgaacacctcggtgtgccactgaatcgagctgagctgaatagctgatcagctgaagcgaagagagcagagcgatctctgcacgggccatggtggtgggtggcgatctcaagttctcaactctacgctctcagaagccgttcatctctagcaggtaggtgcggcgcttgctgagcgcgctgacggcctccctgtacgggccgtcgaatgcgtcggcgacgaactcgtcgagctccttcctgccgccgccgattccgccggcctcgccgacgggcttgatgacgacgagcgtggcgccctggatccgcgtgccgtcggagagctcgagcatcggcgcgtaccggagcttcatgttgcaggcggggacctgggtgcggttggccgcggcggcggcggcgagcggcttgtcgcggaactccctgatctggtcgcgccccatgctgagcgtgccctggccgtgcgcgtccgtgagcgccacccgctccagcgtggggtgctccttgacaatctcgcggaggaggtaatgccttgtggccgcggcgatgagggagctgatggtccacaccacgcgcagcttgagcccgccgttggtgtagaacgactccgggatgctcccggtgtcgtcaccctgcgaggcctcgctgtccccggcggcggtggcggtcgccgccgccgcggcgggggcggcggcccggtccaccctggtgccgccgaggatgacgcagctctggagggtgctcccgaacacggccttccacctgagcagcaccccgtcgtcggtgccgacgtcggagacggggagctccatccggaggttccggatgctgctgaagttcttcagcacctgcgccggcgagtggtgctgctgcgcgccgcagccgccgccgccgccgccgtgcttacccgcgcgctccccaccaccgccacccctgaccccggcgtcgcagtgcccgaacggcttgagcacggcgagcagcatcgtcttgaggaggtgcgacagcaccccgcggacggcggggcgcgggccggcaaggccgagcgcgtcgtcggcgtcggccgcgtcggtgatgacgcggtcgatgcggaggcaggcgtcgtccacgagcggcacgagcgagttgaaccggttggacacggccgagcaccgccccagcgagcgcgcgtcggcgaggcggttgaagatgaggagcacgagcgagtccgggacgcggtcgaagtggtcctccccttccgcctcccgcggcaggagcaggtcctccgcgaacaccctgtgcctcgactgcattttcggttccgcgaacaaggagattgtgagatcgaagaggaggagggagggaggtaggtgcggtaggaggaggcgagtgaattgaagggaggaaggcggaggtggtgggtttataaagaggagaggacggggctcgctaaacaccatgactcgctgtcgggcccttgcaatcataccgttacagatgcggcctctcctctcctctgctcggcgtttttgcgtgttgccattgtttaatggtcgaccaattagtgtgtagggctaatggcaactaggcagcaacggtacactttccatcggcaagtttatactggtgtggtgtaaatacatgtactcgcgttcctgctgcatgcagtcaccgcgccctacgtacgtggcgagcgaggctgtgtaatgacactgtgcagcctcataaccggtggcagccagacagaaatggcctgtctgtgtgggagagcagtgataataacacgaatgaaatccgttctgatttctagtggcatcaaactggcttccgttttccacgttttctatgcaacgagtttttcatatggtcccttagaagtaacccactctctatttcaatttacttatcagtctacgtactccgaattaataatacttatcattttagataataacacggtcttaaaaacataactttgacaactagtaccttctattataatatatataaaaatatcaataaatatatggttttattaaagtactttttaatactaatctacacatatggtttttatattctaagataaatattttaaaaattatttgtagtcaaagattttaaagtttgacttacccttgtttaaaacaactaatattattagccaggaggaagtagtatttaatttttttttattaaaaaacttattgttgtcatattgtaaagcacattcagaagtgtctttcccttcatatctttcatcattgtagccatattaataatattacttcttaccaccatgagttttaatgctggctttgggtaatattacttttaccatgagttttaattaattgtaatttttaaccaaacgtcctatttagtgtgacaagcaaattgaaacggacggactatatccatttattaagttgtggtatctcaacataagtatgtatgagttgcggcgcaaataaacgctataatacgtggtatggtgtctctttgataatttttttaaaaagctattgtcagacatgatacatcatgcataatacctctaaagctcgcgtgcaaatgagtcatttgcatcagcctaactagaaaatgtagcaagctagcttaatttgccaaataaaagtttgcacaaaactattgcttgctaaaatcatactaaatcaaactatatatagtcaattattatccaaaaacactttttcccattctttaaaagaaaagggagaacaacagaatctatgagatctaaccatgtacaacacttttggggataaagtctctttacactaatcatgcatatcattgaatcaaaagcaatttaatattctggcgtcactgaagtagaatagagacgataagtgcataatacaattctttattacttgcaactaacttttatatacgtattaatttctgttttgtactaatacatttgaaaaataaaacctttacacacatagttgccattagaaataagctaatatcaaactttttgaacatttaagaactcgaagagaaacaatccaatctgtaaaatatttccaacaaatattccttggactgaaaatgtatactgctaactgtcaactgattttgttggcacaagagttgcttttctcatgaccggtttactgggcagatatcctgctgatcaagtactatgcacggccgtgtacattttacagagtgggcgtgactttctgcattgtacgtagtagcagaaaaaaacttactgctccacgaacggaactaccgaaatcaaagcaagatcagtagcttcattatttgtcctatcataaggacagcttaaaaccaacacgtttccgttgtgtgcaactttagttcgatgtaatagtactacttctgtcccatattacttgttttgacttttttacaatgtttgatcattcgttttatttaaaaaattagtacaaatataaaaaataataagtcaaacttaaagtacttttgataataaaacaagtcacaaataaaataaataataattctatttttttaataaaacgaatgatcaaacattaaaaaaaaactcaaagcgacaaataatatggaacggaggtagtagctgtttaatttgtggtccttcatccttgtgtgctaaggctaaggga

SEQ ID NO: 24723 - DNA, 4815 bp, Oryza sativa
tggccagtgaaatcaaataaaggaaagaaaaatctaggagttaattttcaaaactaggtgtagatattttaagcgataactggttttactaggaggataatgcatggatatactttcattttctcattaattctcggtgctaattaaaagtaacttcattgtgattcgattcctaggaagtcgtcataccaattttcaagcttcctcttagctacaaatgttataaaaccggctctgaaattcacaccggaaaacgtcataggagatccaaacatgatgatgacaccgaagcacgatatttggtaacggagttcagccgtagcctacatatcagggacactggaacaaattcgttgtaagggtgcacctaagaaatttctagagcttggacgaaactttgggtaaatgtagtatcctttctgaacgcagcttcttcctcttttccaccatgcatcagttatcccactcagatgcctagagtcactagtctttcggcctcatcttttagcttatgtttatgcttataagccaaaatttaaatttttaactttaaatttggagttgattttagggtttttttttttcatcgtagtttattttcagcctttgcttttatatcgctaagaacacgtatataaaagttttatttataaatcattttccatttataaatatgttgtttctcttattccatcaataagcaaaacgatggagtactttagcctttaggtttaccatggtttggttatccggcctcaatcataaaaggaattaagaatacaatataccacacctgaaaacaatttaaatggaagggaagataacctaccacgctcgtgtgcgaatatattggcaacttggcatccatgcaccgatagaggatgaccgtttcaatgggagttttccactcccgcacaggcacccacctcgcaaccgaatcaatcagttgcacacgagcgacgagctagcgtagctgctaccagtttgcaagcatgcgaccatgcgttcgtgcccagcgttgcacgcaaggccagaggagaatctaatcgaccacgtcctaataatgcgatgcgataacatcataacagtattatcactaatctttcagctcactgagttgtacatatggtccactgctggtaacatgattgggaaccaccaaaagggaagcatcacaaacaaacttaatactgcaaagaatatgatatatattcgtattgatgattgatcggtcagcccatgaactgtccgtactcgtgcttaagctaccaattggtgcatttgttttaataaaaaagtatgtgcatgggttttgaatgttttgataccatgttgctgccaactaggctcttcccgagctataaataatcatggtaactaatcatggtgtttcccaaaggtagcagcaggagccaagaaggaggaaggaagaagaatggggctctcacctagaatgctatagaaaaaagagtccatgtcgactccatgatgtggattggaatcaaaactaatcgaagtttagtagttcacttattgttggagcgtgtcatgatcttgtgcctaggaatgttttttaatgtgccattgctttcgtctctctgctggcagtgcacctaattcttcgatggagattcggatattggagaaaaaccttcccacggttgcttcactgcactaccaagtgttgtactgttatcatttgttaattgccaggtagttatcccgcttggattttgaaaaaaaaaacagagaaggaaatgatttgtcggactaatttgtaaatattactcaaactataaatatttttgcaacattgattgagattgagatcctttaacttacccctctaacaaacctcagtgatctacaatgatagggagttagtcggagtaattgcttgtcattcatcggttggcactgagatgagctcatcagtgtaaagtggaacacaatgttagagttatattctagatggtttcttatgcggattcccttcgctttcctctcccggttgtgattctataagccggttcgagatggatacgatcggattcacgctgctatatgtactggcgttttcggtatgaatcgatattgttttctgtgtaattgtctcacatggtatcagattagtttcgattctcgcttccgctttctcgccacgatcatttcctttttcgacgcgtgcgccctctaacttcttcgccggttctcctcgcgacgccgcgatgtcgtctaatgcggagtcgccctcttccaaaactccgccgccttcaacgggttctcttccaccaacggccactgctcatcaagccgctgttgatgaaatctccaaagtcgcagctgaagccatccgggctgccttcatcaagccgtccacttctgtcgatattgaccctgtcaccgccagcaacgttgcggactctgcggcgcgcattgcttccgcccgcagtccgtctccgacttccatccctgctggatacacttatctcctccgcaccgatcgactcttctcctgcggccgactcggtttctggctctgcggctgccctgacctctactgtgccacccgccaccaccgaggtccctgcggcaccaaccctgccggcacctcttgatttggccgccctcctcgccaatgcacagctacaagccggctcggttgcttctcttcatggcatccctatagagcacggaccacgcctccctattggcatacctgtgacaggccatctcaccggcagtctacctactgttcctcaggctgcaccagtactagatgcagagacgactgcctctcttcactcccaggctgtctctgtcctaaatgtgaaggctctcgtccctattactctcgacattgccgcagcaaactattccaagtggcgtggcctcttcctcgtcacgctcggcaaatacgccctcaccgaccacgtcttctccaatgcgttctaccccaaccatgcgcattggcttcaaatggactgtgtcattttgggttggctatatggctctatctccgtcgatcttctggaaaccgtcatgacgccaaacgccaccgctcgccttgtatggctcgccctcgagaaccaatttctgggaaatcgggaatagcgtgcgctccacttgtcagctgagttccgcaacatcatccaaggtgatctcaatgtcaccgattattgccggcgcatcaaatccatggcggatcgtcttgctaatctcggtgaaccagtacaggatcgctcccttgtgctatgcttgctcaacggtctcaatgagaaatatgatcatctcaagactctcctaccgatgcaacgcccgttcccaacattcattgaagcccgctcgcaacttcttctagaggaactcaccaagtctcaccggctctccagctctccggccaccgccttcattgcctccacagcaagcggcggcaaccgttctgattacgggggactacttagttattcttgacgactgctcccattttgtctggacttttcctcttcgtctcaaatctgacacatttcccactttgttaagtttttttgcttatataaaaacacacttttccaccaccatccgttctatccaatgtgacaacggtcgtgaattcgacaactctgccgcacgtgatttcttcctccgcaatggcgtctccatacggatgtcatgccctcacacttctcctcaaaacggcaaagccgagcgcacgctccgttctctgaacaacattgttcgctctctactctttcaagccagtctcgccgcctctttttgggttgaggccttgtacacagccactcaccttataaaccgccaccccactaaaactcttaaacatcacacacccttctttgcactctatggtacgcacccctcatatgatcatcttcgagtttttggttgcaagtgctatcctaacctctctgctactgccgccaacaagctttcccctcgttctaccttgtgtgtcttccgtagctatcctactgatcataaagggtaccggtgttttgatcctatttacaatagggtttacatttcacgtcatgtggtgtttgatgagcattcgtttccatttgccgaaaagccttttgttgatagctgtgctgctaatctcgattttttggaggatttttctttacaggaccagccggctgcacctccagggtttactaccaagattcaggataagtcagtacaaaacccatcaactggatccttttccacgactacactacctgcgccagctgttcctccgggatttcctgccagaacatcgcaacaaattattctccaagcgccacatcacgccaaaactagaaccaaaacagctccggcatctcctagatctcccacttctccctcaagcccaacctcggtcggcccatcctcactctatcagccatcgccaccatctagaccatcgccaacatatgggccactgccatcaacagggtcatcgccatcctccggcccaactcgccctagccatcgccctccacttcggatcgctccagttctctgctttgggtgccactgccgcctgttgtttttcccacgcgcccacggagtgcccggttgcctggtgttcctgcgcctccctcaggccttggtgtgtctcctgttataaacacacatcaaatgactacttgaggtaaagatggaatattcaagcctaataatccctggaatttacatagtggttccctttctcctgtacctcggacctacagggctgctcttgctgatcccaactggcgcgctgctatggaagacgagtacactgctcttatggctaacaatacatgg

SEQ ID NO: 24724 - DNA, 559 bp, Oryza sativa
  unsure (1)..(559): unsure at all n locations
actatagggcgaattcgagctcggtacccctgcaaggtttatgaatatgttacagtacatttagcccaaaacacagttaaatacgacgatgcaacagcttatacaaacatgtctatgctctaggcttgaataatcagcaaaagtctgagcggctagaaaatgtattacaacatattagccaaaattcctcctgaatttacttcgtacctttctcaggcaagcattagtcgactcaattcaaactatgatcctacagggtatatgctaaatatggaattatccaagttttccgatctccatctttttctttatagcacgatgaccatggtagacaaaagaatctatgatgccagcaacagtgaaaatccctgtacgattgcaattgaaagatgggttggaaaatatgttcatgcaaaaatcagtctattgcttatgttttctggaaagcacaaaaagataaacaagtttgcgagctatgacagannnnnnnnnnnnnnnnnnnnnnnnnnnnnnnnnnnnnnnnnnnnnnnnnnnnnnnnnnnnnnnnnnnnnnnnnnnn

SEQ ID NO: 24725 - DNA, 4633 bp, Oryza sativa
gaggaagaagtgaatgagagtgaggatgatatgtgggtcccacaatactttttttttgtgtgaatgacaaatggatcccacattttttttattctaatgccacgtaagcgccatgtaggacaaagacttagtcaagaccgtcacgtaggcgccgcgtcagccaaaaccaccgagggatattgtttacaccggttttaatagttgaaggagttgatatacctggttttatgtttggaggatatgaatcgtactcggacgatagttaagggagcaagtatactttttcctcgcggaaatatcggatactagccgaacgttttgcgtgccgggtgtcggagatgaaaactccgaccccaaaacgctaacgtggtctcactgttcgagcgagatcagcgccgtggatgcccgtatatgctcttcgtttttttgcgattaccccgtatgctctttcgattatcttgcatatcgtgcccttcgtacgaagagagaggccattagttcatcatcaatcatgcatcagatagagctacggtgattaagtttcttttcccttgcgaatgtagtactaccaagtcacgctctgagttttttccccttcaacggcttgatcagcctacagtgcaagtaacgaaagagcagataaaacaatcatgaactgaaatgttacagggtatacggttgtacatttaggactgtagttggtcagacaaggaagaacacagggaggagatcaggacacagggaagaaaggatcagatatttgcagcgtttgttatatagttatcgttgggtaggacaactttcttcgcatagtgtttgtcattcgatgagaaattacagttttacagcgttccagataatctgcttggaacaaggttcagtatacccttcgtatatagaaatcatcaaaccaaagttcctgttgcacacggtactagcaccggcattgcacggagcagtatttttggttgcatctgctactgctagttctttcagtatccgagtagttacttctctcctctcatagtctcattagacgagggaaacgtgatttacacatactcacaaacacatgaaaaataaaaatgattgacgacgttggatctagcatcacatgaaaaataaaaaaaatattttttctttgatgggaattctatacgattagcatgcaaacagccaaacagtaacttacacattgttagggcctctttgatttgaagaaaaaacatagaatttttagaggatttgaaccatatagaaaaatttcctatgaaaccctttaaaataaaagattgaatcctatcatatcctttaaaattcctatggaatggacaatcctataggaattttgaaggaaatttagcaagagctccaacctcttgaaaacattcctttgagtctatctctctcatccgattcctgcgtttttcctgcggttcaatcaaacggtcattactgtgttttttctgcgttttgcaatcctctgttttgcatttatatttctgtcagaatcctacgtttttcctattcctccattttttcattcctaatattcaaatgacccttaattcacccggcaatcaatcggattagaaaaaaaacaagcaaaataaagagaaccgtcatagagcagtccgcaacgccgcaatgctcgcccgtacgccgctccgcctgcccatgccgctacacgccgctgcgcctgcccatgccgctccatcgccccaaccgcacgcccgccgtatgacgagtcggatccggcggtgccgagctcgtagccgctggatccggcgttttgcgagggccaaagagcagcgagagagagagttggaaggcggtggtcgtcggtgaggaagagtagcggcgaccggcgtggaaagtggaggcggcggccgacgacgagaagaggagtggaggcaatccatccctcatccccaagccctcccttcaggccggaccttcgtccccatcgtcccggtgatgtgaagggaggggaaagcagcaaccgtcgttgcgcaacggcggcgacgacggcgacgacgctcgtgaggcaccgaccgagcgagcaaatgaggagtgggaaggtgacgggatgctcgaccccctctcgtcacgctgcacccactggagggcgcgggtgcgagccaggttcggtgcaggtaacgtaacccaaacacgcccttatccgcgcgcctcatcgcctcgccaagacgccaaccaaacacacaccccttatccgcgccccgcccgcccaggaaatcccgcgcggccaatcacagcacgcccgcccgtgatcgcgagatccgacgccccacccgtgatcgcgatcccactcccctccacccgcgcgggtacccccccacgtcgcctactcgcctcgtctccccgtcatcgccaacgtgtcgcggctttccgccaccaaatcgatacggaacccggcgcgcatccggtcctctcgtcgaggcgagaggaacctatacattcgccacactcccctgcttcgcttgcttgccctcctcttgcgtagggaaaaggaagaacacaagagcaagcgagagcccagaaatcctatcctcgactggaggtttttgtgtattgtatagtggtagatttttttactgacttgggagttgtgtgatagtgtgggttgcgttctttttttagtgtgtaaacgatgtcgtctttagtgtcgacgccgttcacgacggcaaccggggtgcagaagaagctgggggcgcccgtgccgctccactcgttcttgctgagccggcggcagccagcggcgggcgcggggaggggacgcgcggcggcggcggcgatacggtgcgcggtggccgggaacgggctgttcacgcagaccaagccggaggtgcggcgcgtggtgccgcccgagggcgacgcgtcgcggcgcggggtgccgcgggtgaaggtggtgtacgtcgtgctggaggcgcagtaccagtcgtcggtgacggcggcggtgcgggagctcaacgccgacccgcgccgcgcggcggggttcgaggtggtgggctacctcgtggaggagctccgggacgaggagacgtacaagaccttctgcgccgacctcgccgacgccaatgtgttcatcggctcgctcatcttcgtggaggagctcgcgctcaaggtgaaggatgccgtcgagaaggagcgcgaccggatggacgccgtgctcgtcttcccgtcgatgccggaggtcatgcgcctcaacaagctcggctccttcagcatgtcccagctcggccagtccaagagcccattcttccagctcttcaagcgcaagaagaactccggtggcttcgccgatagcatgctcaagctggtgcgcacgctgcccaaggtgctcaagtacttgccctccgacaaggcgcaggacgcccggctgtacatcctcagcctccagttctggctcggaggctcgccggacaacctccagaatttcctcaagatgatcgccgtctcctacgtgccggcgctcaagggcgccgacatcaagtacgacgaccccgtcctcttcctcgacgctggtatctggcacccgctggcgcccaccatgtacgacgacgtcaaggagtacctcaactggtacggcacccgccgcgacaccaacgacaagctcaaggaccccaacgcgccggtgatcggcctcgttttgcagaggagccacattgtcaccggagacgacggtcactacgtcgccgtgatcatggagctggaggccaagggtgccaaggtcataccgatcttcgccggcgggctggacttctcgggacccacgcagcggtacctcgtcgacccgatcaccggaaagccgttcgtgaacgcggtggtgtcgctcaccgggttcgcgctcgtcggagggccagcgaggcaggaccatcccaaggcgatcgccgcgctgcagaagctcgacgtgccgtacatcgtggcactgccgctcgtgttccagacgacagaggagtggctgaacagcacattgggcctgcacccgattcaggtggcgctgcaggttgcgctcccggagcttgacggtggcatggagcccattgtgttcgccggccgtgaccccagaacaggcaaggacatttccagattccttttggtctcactcacctacttcgcaggtaatcctgtacttgtagctgagcctgaaactgttttttcctctgtttgatgcagggaagtcacatgcgttgcacaagagggtggagcagctctgcactagagcaatcagatgggcagagctgaagaggaaaactaaggtacgcaattccacacagttcctgtataaattgtagtacccgtatagaattgcattgtttctgcctgagagcaaaggcaaccacaaacgtcacatctggatagttctgaattcactttcatatcttcttgaggtttttgagggatttaagattgcatgctaaacaaacatattagcttaacaacttcactgtcatgctcaaaactggtattgcacatgcgccattcatcccatgaagagctcttgtacatttgatgccgcaatcctgatgtgaaaattccagtaatgcataccatcacatgatattaagttcaatgaaaagccacgtgttatgcaatcattagctgccaactg

SEQ ID NO: 24726 - DNA, 5427 bp, Oryza sativa
acgagggacgccaccgccgacacggcgaggaaggccaaggacgccaccaaggacaccacccagaccgccgccgacaaggccagggagacggccgccacccacgacgacgccaccgacaagtaaactcgccggaacaccatccgcaagcacgtagtgctcctagctatcgataataatgtccacattttttttgttgatgatgcagggggcaagggcagggcctgctcggggcgctggggaacgtgacgggggcgatcaaggagaagctgacggtgagcccggcggcgacgcaggagcatctgggcggcggcgaggagcgcgcggtgaaggagcgcgcggcggaaaaggcggcgtcggtgtacttcgaggagaaggaccggctgacgagggagcgcgcggcggagcgggtggacaagtgcgtggagaagtgcgtcgaggggtgccccgacgccacctgcgcccaccgccacggcaagatgtgatcccccatgagcgcggtggacgactaataaaaaaaactcccagcatgttaacctttgtgtttcaagtttcactagctgcttttattttgctttcgttaagtttccactaccgtgtatgttccttctggtaatctaagtgcagtggtgctgaaatctttataaagcccttcagtttaccgcttaccacttttgcttcaaatgtctcgtgtggtttagtgtgcatgttcgttcttttctctggttctggatttgggatattatcgtgggcacgtttccaaatctctatatatgagcctcccagaatgcttttctaaagtaaattttcgaatgctagataatcctgaaaatctcatgagaatctttttttggcgagggagtgctcgtttaagttcgccaatcgccaccgatcggcgcggctcgtagagaacggatagagaagtcgtgggctcttggacttgtggtggtgaactgtcgtctggtgatgcatcctctgccgcacaaaccaacgtgaaaataagacaatcgctgatggcctgatgcccccgagtgaaacgtgattgagctcagcatctctctcaattcgtccatccgaatcgatgctgctgctgccggcataatgcgaaggagcgagatagccagtttagccacgcaccagaataccagacggttcgaagtgagaaaatccgagcaaagtaggactcacatccgtttccgtttacgtttataatgttcccattggatattataagtcatttgatttgattttttttctcggttagtttgatcaaatttataaaacaatatacttatattttttttataaaaacaaacatattatcaaaataatatatttaatattaaatttaatgaaactatctctactattataaaaattaaaaatgtttttgccaatggctcggtaagtcttcgtgtcccgaatctgcctcgcacataatcactatcagtttaactatttatgtgtctctaatccgtatctgattttcctttttccatcgtgtggtcagtccctaacggacttagactcatacacggagccgctctcctcatccgtttccaggcataggggtgtaactacgcatccgtctggaccacctgatccaaacaccctatcacacgagcagcctacctaactaatggcacccgtaatggcacccgtaatagttatctataaactatctacaagagatctatgtcagtatattttcctacttggaagagattaaatggagagaaagagcagagctatctactaacttagagatagtctatagagaaaaacgagacaatgtattagagagctatagatacccatatagacatactattgaagtggtttactattaatctagtctattgttgagatgtacatgttttatagatagcacattactttaccattgtggatgctctaaggctgtgttcttatcttcaagttttcaacccctctctctcattttccgcactaaacggcgtgtttttttaaaaaaagtttctatatgaaagttgcttaaaaaatcaaattaatccatttttgaaaaaatagctaatacttaattaattatgtaataacgcgtgctttgttttgcgtgcccgggagaaggggttcccgaacgcagcctaagcaggcctgatgaacatacataattttaccatctcatatttttctttgcaaagcccccatttctttgtcagctagccttccttgccaactttgcacatgtatatagagtcaacattcacatatctatctctaccattacaaaaattgaaaatgcttttaccagtatttcggtacgtcatccatgtatgagttggttttttaagttcgtttgattttgaaattacacatctgtatttgagtcgggttttaaatttgtacgcttttagaaatacggaaggagctgtataagatatctctttaaaaaaactcgcatgctaacttgagatgattgaactcctgattgtagctcatgattttctagaaagaaatatatccaagcgaattccaatagtgaatttcaccttaactaaactgtataataacaataataagattaaaataattgtcacccgttgcaacacacgggtattttttaaaaaatatatataaagatgaacatgttatcaaaataatatattaaatttggtgtagaagatgttactaattttcctataagcaatgctaaaaagtaactttgattaaaaagaaagttaaacgatttataatatggaacgaagggtgtagcatttaaaaaagaaaaaaaaaacaactttgattcgggacaatgcacaaacagtagtacatactacatagtgtgatcaacttgatgcttattattgccttgaaaggcgagtcataagttacagaaaatgaacactatgtacacaggcctgaatttttctcttgaacaaggaaaagataaatatgcactcagatggtcagacaacaaaaggccccgccaacataaatcagttgcagatccggataacttttttcacttgaatgccacatacagtcccttacttatttggattatttgtccagcattgtgtaagacggcaggtcattcacctccaatacatcctctagtactagttcacgctccaactgagttcttgtagatttcaatacctcctggcaccacgaaaacgaacagataagcatgccattgattaaaacatacacacagtaactgcataatatgcacctactcgggcttacattgaactccatgtaagaagcacgtttcacaagccactgagcatcgagaagccgaaaggctatgcagtagaggtgatcaaatgcattctcatctcgtccaagcagttcaacaaaacgaactcctgactttgaagatggaacacctgcacagttcgaagagcgttaaaccaggggaatgggaaccacaccaaccattatagtgtaaagacgatttttggaaactgagatattacttgactgtagatccagcatttggatcagcataaatgaaatgttgatcccagcaaccgcaaaagggtactcccagtctgctctctgcccttgtactttgttcagaagcgcctgaaaggaaccctgtaccagaataggtgagtaattatacaaaaacaaacagcattaacaaatcttctcagaatatcatatagaaggtatttacaggatagttcctagcgaaaaatatgaggttctccaatgatatgaatcctccacccctgcgtggacaatatcagcattagatggctttgtaactgaattcgactggagcagaaaatggaataaatggaatacctgaagtcagttgatggatcagtgccttgccaacccatctccttccatagttctgatttcagtggaggaatgtcacggttggggtatgctaacctccaaagttgtctcaaagcatcctaatagcaacaatgcaaaattacttgcttgaataagagggtcacttgtggccacattatagccaggcctaagctattgaaataggtttacatacttggtgttcaacacgggagccatcgaaagggatttgcaatctagaccttaaagtattcagtctatcttcctgaaagaaaattgtatacattaaggttcagaattacatcaattcctgtgtgtctattataccttttctcaatacattacctgcaaaggactaagatacactggactgctgttctggttgtccaacgaaaagggaaacaatctaccaaatagtgatccagagccaacaataatatttgctgcacgtagaacagcaaaggggaatcagtatcttattcttgaaagcactaagggttacatctgtgaaatagttgcaacacggcacaacaataccacttgtagtgaatcagagaaaaaaaattaaggcatgggtttacagaatggaaaaaatactacttccactgctacgatttcttatgcaagtgaacattgctacatcaacaatttatttgcatgatttcaaaaaatgaaacagggtcaatgatatgacacggacatccaaattagcaaacttacttcacaacagttattctgtttagtcaagtttactaacccacaagaatgtttttgcagttcttatgaaaatgatgacatcagcaaatgaagataaggtactaaaggctccataagagaactaagacatgatgacagctgcatccattattcttgaattcgtgctaaagcagcaagccagcaattatataaagtatggcatgggcagacacaaaaacagaactatacctgtgtgcattagatcagcccgacaacctgactaccattctaccaatggttactcatcaccaatttttttttaaaaaaataatgcttgtatgagacaaaatcataaacatactgtgtatgagaaatataggcacattaacctagaatatcaactctgaaagatggtgtcaatgggtagcttactgaggttataatcagtaaggattatctgtaactcattacatgtgctccaaaattagaaaaccaggaaacagaaatgaacaatgacaggattggcagccaactagtgtcaagtgggacaaaacttattcaaagttgcaaattgcaagtgaacagtacctaaccattgtgcccattgcgcaatcaaatttgagaaaagaaatgaccagtgtagctgttccttctttctatcatcatcccataagtcttgccttctgggatcatataccttcagatggcggaaaattctgtcaataccttagaaaaggatatactacagttgtgttcgtccgaaaaggtagtagcaatggtaaataaaactatgataagaaaggcctgacctctgatccaccagtatcagagctagatttccctagtaaaggttcattaagggaatctacgctggatatgtcaacatgctcattcttccttccatcgacatctccatgatggagt

SEQ ID NO: 24727 - DNA, 6178 bp, Oryza sativa
  unsure (1)..(6178): unsure at all n locations
ctccgcaagacctaagacataaacccggggctcaccagtacaaaatcaactactttcccaattcccaaccacggccaccaaagtctcctcccgctcccggaatgcggcaaccccgacaggttcctccccccgaaacttcaaaaccctaccccgcctaccacgattcgatgatcccgccagagcgagcgcagaaatcccgctcgatcggcgcccaaattggagccagaaaaaaaaaagcaaagaggggaacgctcgcacgtcacgtaccctggggtccttccgggatcaggaggatgaggaggaagacgaggagaggaagctccccaccctggctcaggctgcctttggcctgngctgtggggattcggaggaggcgactcgaggaagctttaaaccgaggagaaagagagcgagagatggagagaggctacgggaacgggagagaagaaaccttcggtccaaaggcaaaatgtggagtacgactacgagtgtatgactgactcgttcggctgcttgctgtcacgcggacgcggcgcacgacacgttagcaaactttggtgggctgtgccgtgaccgtgaagacgaaagcccacgaagaaattcgcccccccacaagcgaagtgtatccaggccgccgggccctagcctcgtcgcagctctccgcaggcgccaggatcgcctcccgcccgacccggcgcggcggtgatgatgtggcgggcgggtggcgcgtcggggtcgtcgtcatcgagaggcacttcctcgtggatttgtatcaggtgcagttggtactatcactataacttacgcagtccactgccacatgttagatccgaatctaacggttcacatgcacccggatactgtagaacactgtagcaagaaatgttcagtattttttgcgtcagtactgtagctgaagatctggtccattcatcaccaaaatgaacggttgtaatcgcatgcattagtttaacttgcagtcgctattcctactgcaagtgatcccaatcccttcctcgtccgcaaccgctgctcaagatgacaaagatgtgttgaccaagacgagaaaaatgtttttctatgaacaacacattcttgcatttagagaaaaatgttttatctctaaataaaaaatgttttgaataactaaaataatgaaagatagtggaatcaaagattaaaacatttttgtttcacacatggaacataaagtttacaccgtttgaacatcgacagattctcaaagaatagatgataaaaatgtaaaacaccattaaaatacacattgcaatatttcaatttaactcaaataaacattaagataaaatagactgaaatatcaaaaatcacaaaatttacaggtatagatttggcttatttctcttctccggtggccaaatctagacccacgtcggaatggttaagcgatgtggtgtgcgggcgtccaacgcgaagagtttttgatataatacgggcctgtttaggtcttctggcaaaattttacaccatgtcagatcgaatgtttggacatatgcatggtgtattaaatataaacgaaaaaataactaattacacaaattacgagacgaatcttttaagtctaaatgcgccatgatttgacaatgtggtgctacagtaaatatttgctaatgatggattaattaggcttaataaattcgtctcgcggtttacagacggattctgtaatttgttttgttattagactatgtttaatgctttcaaatatgtgtctgtatatccgatgtgacacgccaaaaatttacacccctgatataaacacaccctacttcagtacttgtatatattaggcatgagtaggccgtactatgtactcacatttgttttccatcaccatttgactcacaaaacatcatcactcatgcatctttacctcccattacaaaaggacgatgtactggagatctggaatgcaattaataatattatataaaaatcactccccgtaccgtaataagttttctttttagtttctttcatttgtaccaaagtaagttcatttataaagtagtcattgcatgaagtttgtgaaactagaaaataattgtattgggagtattgataggccatgtttagttccctaaaacttttcccgaaaacatcacatcaaatctttggacacatgtatggagtattaaatatagatacattaaaaaactaattgcacagttagggaggaaaatcgcgagacgaatcttttgagcctaattagtccatggttagccataagtgctacagtaacccacatgtactaatgacggattaattaggctctaaagattcgtcttgcggtttccaggcgagttatgaaattagttttttcattcgtgtccgaaaaccccttctgacatctggtcaaacgtccgacgcgacacccaaaaattttcttttcgcgaactaaacaggccctgatatttttataaagtaggtatattctatttatgtttgtttgtattgttacatgggttagatgaaaaataaacttattttgagatgggcggattatgtatagagtaaggccaagttcaaacacacatgaacaagaaaaattgcaataattggagtagtatgtttttcaattctacaggaattgaaaaacacatgaaacaaaagatgacctttttgattaaaccataggaaaagctgaaccaataaagtttccaagaggtttaatctcttgcttattttcctttggaattggcactatgaacacaatttctatggaaagtttcatatcttcttcatgtgaatcagaggggtttattgggaaaaaaatacaagggaaatgaatcctccaaaaatcttttgccaatccttcctctaggatttgtttcctatagattattttttttgatacaaaaattttcatatgattgtaatctgctgacctgttccatgggaaaataagcaagaagttagacttcttggaaactttgtttgatttattttttcgtgtgatgcaatcaaacagcatctttcctgttttttgtgttcttcaattctggtagaattgaagaaacacaacaattaagtctctacatttttttttcttcttatatttttcttatcatgtgttttaaagggtccttacatttaccatgcatgtcaatgccttttcaaatactatcggagtatcgaactatataatttaatgtgctaaaaagaagccattcttgcgactgaggtagaaatttccaccgtcatatcatattgtcacttgcgaaaaggattcctgctaatagaaaaaaagataagaaaaaaaaaaggaggattcctgcttggtgagtgcgcatagtacgaacgttggaacttgaagtctccaccaccttgctcttttatttttgcatcccagctgcttatcatcatctagtagtatcattctactatcaaggtctccaataaggagttcatgtagcccccaaaagattaagcatattattagccacttgcagtataatgtccccagaaaatcatttacaagtacagtctcttcgctccgttcatagtctttgccccttttggaataaagggcagtgtgtggaactagctagcttatgcacacagcaacaagtactggtgctaaacgattagtggaaccgatccttttttagtgacacaattttgtagtaatatcagccgttagtgcacaactgcacatcaatgatgcattcatggaactgagtagcttggacgtacaattatcatcatctttaaatggtgcagttctttctgaaccttccattgtgacaactgtcatttgagttgatcgagcagctaatccacgcattagagagctgtggggtcattcggccggccgcttagtttgtattgtagttttacagggttttgtcttatatcagctaatcctgcaatgttaagtttgatagtaacctgcattcatcactcgagtggacgaagaagaaatcggcacagtaagttgtcgacgggtttgtacatcacatgaacttgtccctctaataatattggtggacgcccgattttgagagtgtgggtattcaagatttacactatgaaattgaaacaataaacgcttgtgttactaacggaaatatgtgtgttttttttaattaggtagataataaagtacagaaaaatatagtagaagatgaattatcttgttagcttaccatgattttaagacatgatagatgtatttttcaaaaaaaaattgtcttgcaaaagaaaaaggaaaataggagaaaacaatcactgtaaaaaaaagcaaggcgttgctgagaatctaagggcctgtttagggagttttaaattctgagaagcagctgtttaatagccagcttctgagaatctagaaaaactctgaaacccagcttctggcttcttatttcatttttcaaaatctgtaactatagattctcagaaactatggactgtttagggtagcttctaacataagcagtttttgggaaaagctgcagctagaacaagcttcccaaacaggaactaaggcttcaccactagctaagattcacgggttaactaaccgggcaacaacaactacaagttcagcaagtcagtagtatagctaaacttttaagaaatatatgtgggtattcacttgaatacctatgattaggatgtactccctccgtcccataaaaaaccaatctagaactggatgtgatacatcctagtactacgaatctaaacatatctctatccagatttgttgtaatagaatatgtcacatcctggtttagatttattttttgtgggacagaagaagtaggcctatgctctctgacgcatggggccatactgtaggggtggacatctcacctgttagggacttatatctctctgattatatgtcgaggagttgcttcaagttgtttggtttgaggtttgaacgttaatccattggctatcatcgaaagtaaagtaatacctctgtctaaaatataataacttttaacacctagaatttgtctcaaaatataacaatttcttcatcaacattcatttctcaaccaatcacaaccctccaccattcacttttcttacctaccttcacttctcaaccaatcacaaccccttcctatttaattcttcctacttttataataatcgtgtccaactctaaaactctttatattctgggacggagggagtagcaattattatcatacataaaaagatgtaattgggatgaagcatatggtttctcggcacaaacaaaactaaggggtgtttagattaggggtgtaaagttttggcgtgtcacatcgggtattatataaggtgtcacatgggatgttcagacactaataaaaaaactaattatagaatccgtcagtaaatagcgagacaaatttattaaatctaattaatccatcattagcaaatgtgtactgtagcaccacattgtctaatcatggagcaattaggcttaaaatattcgtctcgcaaattagttataatctgtacaattagttatttttagcctatatttaatactttatgcaaatatttaaacgttcgatatgacagggtgtaaaatttttgggtgggaactaaacatggcctagcaatctgaattttgcgtccgcctcatgcgcctcggtaaaaaaaagtattgtcatcctctacgatgttattgctagtagtaaatagtaatatatatttttttataccgcactaggtatgattggtttttttttgggtagtatacatatttggagtggaagaagtaggctattagagaatacgaatccaatgataagattatttaagttcactattggcttttttgttttcaaaagccatgtcgtaaggacaaaaagaaaaacttttactgataaattattatctgcctagttttgatgatttatcaaactgttatcatgaccactatgtgcaaatgtactatgcatgtaaaccatttcatacccattgtttcgctcgcctatagctgattatccctaaatcttattaacaacaatagtaatttatggataaaacttttaaatatgtgttttttgacttgtaagtagatattggaaaacaaattatactgaacaaactattaagataattgaagttttaatattgaaaattttgactacggctgataagttgatgatctaatttgcacacaacc

SEQ ID NO: 24728 - DNA, 596 bp, Oryza sativa
  unsure (1)..(596): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctataacatactttattctgaaggcaaaacttttgattttaattctttttttcttttgcagttttctgtgacggagcactttagagaagcaattggctatcccaggcctccgcctggtgtatatttcttctatgaattttctccaattaaggtgaagaatggatatactgattttatgtagtccttgaagcattaggtagcgatatttctgtgctgtctattgattagtctgtaactatgctatctagtctacttagctgcatgctttaaaaccacaagcatatgcctgtttttgtttcctgaaagcatcatgtcagttttctagttacatgtcaatttgtttagnnnnnnnnnnnnnnnnnnnnnnnnnnnnnnnnnnnnnnnnnnnnn

SEQ ID NO: 24729 - DNA, 636 bp, Oryza sativa
  unsure (1)..(636): unsure at all n locations
nnnnnnnnnnnnnnnnnnnnnnnnnnnnnnnnnnnnnnnnnnnnnnnnnnnnnnntcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttattcagactctcggcgaacccatcattttgatcacatgtgggct

SEQ ID NO: 24730 - DNA, 1111 bp, Oryza sativa
gtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacaaacgccacaaaaaaaatggagcaaaccctcctcccctcctctagctaatcaggcaagaaggagaggcaccgctctcttcttgctcaatcagctcgagtggcaagggatggagtataagtacaactgtcggaacaaaggtgctggttctagacccaaaaccggcacctttgtcttcctaaccggcacctttgtgtggggcatgaaaagcactattggaagaaaggtgccggttctcgatccaacaacggcacctttgtgtgaggcatgaaaagcactatcggaacaaaggtgccagttctagaccaaaaactggcacctttgtcttcacatacaaaaaaccggcacctttgtgttgggcccaccaacggctagtgtgggagggagaatattaaaggtgccggatttgggctgagatccggcacctttgacttgtcataccaagaaccggcacctttgtgtaggacccaccgtcgggatgaaaagcattagtgaaacaatggtgccggttttgggttgagaattggcacattgtctaaaaaccggcataggttaggtgggagggagaagattaaaggtgccggtttagggtctagaaccggcacctttctctgacacaggttttaggtgccggttttaaaatgaaaccggcacctatttggatataaaggtgccggtttttgaatatgtggagcatgggggtgggcgtatgggtgggcaagacattataggtgccggttttaagtgtgccggcacctatagtggcgacacctatt

SEQ ID NO: 24731 - DNA, 17726 bp, Oryza sativa
  unsure (1)..(17726): unsure at all n locations
nnnnnnnnnnnnnnnnnnnnnnnnnnnnnnnnnnnnnnnngtgggtctgacgttaatgagagcaacatcgtgcccatcactttggacaagttgacgcctgaacaaaagaaggatcttgaggcaatgatgcagcagacacaaagctaattcttgaactcattcatggagactcgccaaggaacaattgttcagaggtacaagatgaaactagttgttgatgttcctgggacaagttcttccaaggatggagaagtacaacaagtctcggatggtacgactcaatcaggtgataaaggtgcagcagatggttctcaaggggttcaaggtgatggttctcaaggaacttaaggtgatggttctcagggatttcaatgtgagaatcttaaccatgatggcaacacggcacagctacagtttaacaacattcaagaatggattgactatgtcgcgcaacatgctttgatttatcaatctggagtgttagtcaacactttgtcaaacatggttgatggctcaatagcttaataccaggctacaggaccggtctatttgccaggaggtgttttcacgaactatcagcccttgatcactaataatcagccagctgtttagccaattcctcccaatgcaccatcggctcaaccgacagcacctgtatcagctcttgcacctgttgcaccatcatcggcaccaggtcaactaattaatcctcggttgttggtgggagagcagccacaacatagtggacaaaaatgtgaatcggctaatccaagaccaagttgcagctatgttcttgccagctcagcctactgttgacccaatccagcaacagccgattcaacagacgccaccgaggtagcaggttgtgcagccgattcaacaaacaccaccaagacagcaggttgtgtagccaattcaacaaacgccatcgaggcaacaggttgttcagccgattcagcagcaaggtttgatgaatgcatcggctaggtttagaacacctgacaatcagctaaggcagcacgctgcgaatcaagttgtccaagagcatttggttcataatgtgcaaccagatcaaacggtgaaacctcaagttattcccgaacatttggtgcgcaatgtacaaccaaacattcagaattatcaagggggcaatttaaattatcagtatcagcctccatcgccgcaagttcaatatcagcaaggaggatcggcttagcctcagttcgctcctcaatacaatcaattcgagcccgtgccacaacaatcacagggggtgcctcagcaacgaccatgggccgatatgattgcagatgtgatgagagagcagtttgggcttaagccgaaggatgctggaaacttgtatcggcatccataccctgagtggttttagagagttccattgcctaaccgattcaaggttccatatttttcaaaattctcaggcaggacagtgtttcaacctatgaacacgttagccgattcttagctcagagtggtgaagcatcggctgtggatgccttggttttcttccttgccatgtggatcaatcaacagttgggccgatttggagaagcattttcatagctatttctatagtggggttcatgagatgaaactgtcggatttaacggcgagtaagcaaagacatgatgagcctgtgtaggactacattcaaagatttagagagatgaggaataaatgctacagcttgagtttaattgatgcctagttagccgatttggcttttcatggtatggtagctccgatcacggagaagttctcgtctcaagactttgatagtttgtcacatcttgcacagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggctgataagatctttgatttgctacttcgggagaaatagattgaacttcctgccggtcatacaatcccatcggctgaggaattaggcaagaggaggtattgtaagtggcataattttgggtctcattctaccaatgattgtaaagtcttcagacagcagatccaagaggctattgaagggggcaaaatcaagtttgatgactccaagaggccgatgaaggttgatggcaatccttttcctgtcaatatggtgcacacagctggccgaacagccgacgaaggaagggctagaggttttcaggtgaattcggctaggattatcaataagtatcagaagaaatatgacaagcagcgggagaggcattatgaagaagacgatggtagctttaatcctcattggggttgtgagttctttagattttgctggaatgaaggtatgaggttgccgtctattgaagactgccctgggtgcagctatgttacagaaagttcaagccgatcgtataatagaggcaatcggctaaggcaaataagagttcctgttgatcaaagattgggtccagtgaaccaagatcgtggccaagaggacaatgaagacaggaagactcaatggtgtccttctggtatttttacaaagaatcagaagagaagggttcaaatgttgaggaacagggaacgctttcaggaggttgagcaagaaatcaaccattggctgaaggagacgaagccgaagcaggagtggcgcgttaagaatcaagttcctacagcagacgaagccacaaccgatgaagcaaaaagattggctaaagggaaaagtgtcgtgactgcatcggttaacatggtattcacgttaccttctgaatttggggtcaaacaagccaatgttgatgaagttgaggaagaatcagctaaattgattttatcatgagaacaagaagtctttaagaaaccagaagggacggagaatcggcatcttaagccattgtatgtaaatggctatatcaatgggaagccgatgtctaaaatgatggtcgatggtggggttgtggtgaatttgatgccttatgctacatttaggaagctgggcagaaatgctgaggatctcatcaagacaaacatggtgctcaaagattttggtggcaatccattagaaaccaaaagagttttgaatgtggagctgacagtcggcagcaagactaaccctacaacattttttgtcttcgatgggaagggttcctacagcttattgcttggaagggattggatccatgccaattgttgtattccttcaaccatgcatcaatgcttgattcagtggcaagacgacaagattgaaatcgtgttagccgacaagtcagtcaacgttgctagtgccgatttagctctttgggagatgcctggtctcgattgcttatctggaaaagtttgggatggagattttctaaaagtgtccaattgtgatatacaaccaattgaagatggagagcccaagcttttattttgagggtgtcgtggagggttcaaatgtctacaccaaggacacagtagatgatctcaatgacaagcaaggacagggtttcatgtcggctgatgatttggaagatattgatataggtccaggtgatcgaccaaggccgacatttatcagtaagaacttatctccagagtttagaaccaagttgatagagctcttaaaggaattcagagattgctttgcttgggagtattatgagatgccaggactcagccgatcgattgttgaacatcggctacctatcaaactaggggttagaccacatcaacagcctccgagaagatgcaaagccgatatgctcgaacctgtcaaggctgagattaaacgtttatatgatgctggttttattcgtccttgccaatgtgggtttctagtatagttcctgttatcaagaaaaacggcaaggttagggtgtgcattgatttcagggatttaaacaaagctacccccaaggatgagtatccaatgccagtggccgatcagttggttgatgctgcttcagggcacaagatattgagttttatggatggaaatgcaggatataatcagattttcatggccgaagaagatatccataagacagattttcatggtgcaatcggcttatttgagtgggttgtaatgacttttggcttgaaaagtgctggagctacatatcaaagagccatgaattatatatatcatgatctgatcggctggttggttgaggtttacattgatgatgtggttgttaagtctaaagagatagaggaccacatagccgatttgaggaaggtttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaatcggctcagttttaattcaggagcttgaaggaaaagagagggttgtgttttatttaagtcgtcggctcttggatgcagaaacaagatattcccctgtggagaagttgtgcttgtgcttatatttttcttgtacaaggttaaggcattatctattgtccaacgaatgcactgtcatatgcaaagccgatgtcgttaagtacatgttatcggctccatttttgaaaggaagggttgaaaagtggatattttccttaacggaatttgatcttcggtatgagtcaccgaaggcagtcagggggcaagctatagccgattttatcgttgatcatcgtgatgattcaatcggctcggttgaggttgtgctgtggacattgttttttgatggatcagtatgcactcatggttgtggtatcggcttggttataatttctcctcggggggcaagttttgagtttgcttatactattaaaccttatgcaactaacaatcaggctgagtatgaggcagttctcaaagggttgcagttactcaaggaagttgaagccaatgctattgaaattatgggagattctttgctagtgatcagtcaattggtaggggagtatgagtgcaaaaatgatatattaatgatttataatgagaagtgccgagaactgatgaaagagtttcggttggtgactttgagacatgtatctcgagaacataatattgaagctaatgatttggcccaaggggcgtcgggatataagccgatgatcaaagatgtcaaaatagaggttgccgcattaacattcgatgattggagatatgatgtgcatcattatttgcagaatccatctcaatcggcttctcagaaattgcgatataaagcgttgaagtatactttattggacgacgagctctattatcgtacgattgatggggtgttgcttaaatgtttgagtgccgatcaggctaaggttgcaatcagtgaggttcatgaagaaatttgtggcactcatcaatcagctcataagatgaagtggttacttcgacgtgcaggatatttttggccgacaattgtcacaccctgaagttctttcccaagcctaaattgaagttactagccgtcaacccgtgccttacacaggttattggtagtggtagtataaagatcaaaattttaaccatacgttcactacgttggccatattcgaattgtagcatgttagattgaaataatagttaactactcccttcgtcccagaatataagcatttttagagttagacaacggttattaagaaagttggtacaattaaataggggagtgttgtggctgaaggagaagtggagatagctggaaaaattgaatggtggaggattgtgattcgttaagaagagaatgttggtggtaaattgttatattttgggacaaattctaaaggctagaagttgttatattttggtacagaatgaatactacttgttaattattaatttcgaatcaaacaaatgctaaatttgtgatacatccaacttttttatttgatattgtggaattctggaattaattaagtatttagttgtgtctgtggtcgagtttaaatttaagtacaccctgtaatttaataattttgaaattaaaaaaaaatagttatactcagtatggaccctagaagatataagatatatgtaattagcttttttgttttatcattcccaaaactcataataataattagtgatctatggtctcttgcctatttgtaccggttaagtacaaattaaagagtctacgatattgccaattgcatgttttattttttcacaaaccccaaataaaacctaatgttgtgattttgcgattttgccaccatacatgctatttaaggtgaatttggtcacgtctatcagatcaagcatagattgtttactcttgctgcaagtaattctcatatgaacctacgtagtacatgataaatatttgtttacgtgcatgattatttgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctagtaagtatgcttctctctctctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacccttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagtaagctgcaaactacatgtacatatgcattgcatacgggatataccgcgcatatggaaaattaaatatagttgattgcattcagagaattatagatcaatatatttttatctgcttctactgtcattaaacaacttgtcaaaatcagacaacttagaacatgcaagtttaatggaataaaaaaacacattcaatatgtaaaagatgatcagcaaatagttgatcattccaatcaaaaccataaattgagtgcgtcctaattaaatagactgctaaatatgtattgcaaattgaacacgcaaaccatgcaaattcaaaggaatacgtatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaacagggatgaacgatacctctggagcgatcactgattcactggaaacttttaacttctcctcatgattgaggcaaattgtcgctgatcgggaccacagtctgggatcaaggtcgactgcagcctatgcatatctcatcgccctcgctcacgttcttctcgatcgcgttcgccgtttctttatcgcttcttaatttccaatctgatttctcacgatggaacttggagataaattagatggattctgtccttccatcgataactggatagataggatttgcaaggagcccactgagtttaagattgattggcccacgatgttaaagtattgcaggatctacggtgtagattaaacgacttatctaattgatgctcagatctttctggttaacgtgagagctccaaaaaagtgtccgattagtataggtatagatagatagataaatggtctcaaggaaataccggtgtaaagcaagagtaaaccctaataaattaatgcaaataataaccggatttggcatgtggaatttttcttgagttctacatgtcgaaatacgctaacaagatttttagtggaattttgagagctctggaaataattttaaccaattaaaattgatcacaagcaatatttaatcccaggaaaactcatttccttttttcctttttttctttcttttctttttcccttttctctttcgaatgggccgcccgcccattctctcctcccttccctttccgctgggccggccgaaggccgaggcccatctgagccggccgccttttctgtctctccgggtcgccgacaggtggggcccacctgtcgggcccgtctgccttctccagacggagccgacgcgccctggaaccaccgacacgcctagctgtcttgtcttncgggtcacgtcggccacgcccgtgcgtgcgcccgtgtattccgcacccactgcctatctcttccgcccgcgtccgctctcgtgaccgccgggattcgattatcgaattccacctgtttctcctngcccactaccccacgtnggacggcgatatccgctctctccgtcacgtctggacccctcctctatttaagcaccatcgccacccctatctctttttccccatctcgccgagtcctcccgtgctttctaacgccctagcgccgtcgccctcctctccaccgccgctccggtcgccgctagccgccgctagatgccgtgccgagccgcgccgtcgacgccgtcgcgttcgccgtcgtgcgggccatcccgtccacccctcctccgtcggaatccaccgccggaattcactccttgccgtgcgccggtgagcaccgccatggccgccgtcctcggccggcgctctcgccctcttggattttcctctctccctctaacccctctcctcttcttcgttagatggttccggagctcgtctcgccgtcaccatcgccctccgtcgctcgccgtcgtcgatcgtcgtcggtgaggaccctcctcccctttctccctctctcccgcgccgactagccaccacgccaccggccaaccgcttagccgccgctgtcgccatccacgtcgctgcgacgccattgctctccgccgccggccggtcgccgccggtcactgccttgcgccgcgctgcgccggccgcgtaccgccccctccgccgtccgatccaccccgagtggatcggggctgtcggttcggctgcccgcgtggctgccgcgtgtgcaccgcgtcggcgccacgagtgcaccacgtggcgcaccgctccttcccggtccgtggacccagtccaccatggaccgccctccccgagtcactgccatgtgggacccgcatgtcggcgccgcccctctctctctcgggatttatgtattgcgcaataaatcaattaaggatttttctgttatagtaaaaacacagtgaatcttctaaaattcatatctaattcatctgagctccgtttaagcccattcaagtctcagtaaatcaagaaaaatgcatagaatccattaaaaatggttttgttctctgtttcagtagtcttatagcctgtttgtattgtttgctttgtatgtcgcttagattccggctctcccgatgctccggtgtagtttgaaatagtctccgagattcctccagcggcagagcaaggcaaaacatgcttgtcacttgatcatgttgatcctatattgcaaatgctctattgttttccttcaaatgctgcattgttttatattattaccatgggatgtttacctactgttatagccatgttatttttgtaccatgttcctttgttagcctgggatataacatgactacatattgaactaggggttgcttagccatgcttagttcaactagcacagaatggggaaaattatatttaatgtatagacttcaggttctagtgttgatgttggattagagccaccgtcctggtgtcgcttcattaaaatatgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgatgcatccaggcaagggtgggcgtgatggagtttggatgggccctgcgatggcctatgcggcttccggattcaccaaggcacgagaggggactgcccgctgccttgcaaggagtgggggtgaaacctgaggtgtggtgtgcttggttagagggggttatgcgaagggtcctgtcacggcctctttccggtatgtctggtggcatgtcggcgcacggaaacgtgtcgtggggctgtgtcttgtgggtacagttgtatacctctgatcagagtaaaactattcgaatagccgtgcccgcggttgtgggcggtcaaccagattcaccgtgattagtttcaccctagtctagtctaatggaattgaatagtataggtggatggttgggcctgttgcaacatggtgtagcgttggacagtggatgtttaatattgattaattattacaaatgttttactgcttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagaggggcgaccacccaaccaactaccgcggagaaggcattgacgattttgtggcagagttggctcgcatgaccctggtggtgggctaccccaatgcgtcggagtactcgactgttccgccgctcagtggcaagcttcctcaccgtgttcgtctggaggttcatggctaagtgggcacctgcctcgctaacatggtggttgtggcatctggaggcacagcagatcacgcctgtcaggaggcagcatatctgatgatggccagacttcgtgagcgcgacaactacatcttctgcaacacggcgtaccgtttccaccctcgccgagcaagtggtgacggtgtcagcaccttccgtccgacagccggtgagaacgacaccaccttcggtcacatgtgcgcaatgatgaggggaatggacaggatgcactcggatctgcacaaggcgtccaaggccttgaatgatgggaagctcgtgaggatcatagctctgaaggatgagatagcacgcctgaagaaggagaatgctcacttgaagggtctccccattcccggaggagtccggatccgcaccatgccccgcaagtcgacgactgcacccgtgcgcatttagcttgcgcccaggaacccacctccgcccgcagctctcgcagctcctccagttccgcccgcagttcccgcagctcctgcagctccacctccagtcccggctccagtcccagtgtcagctcccgcgtctgctctctccttcgctccagcatcagccgccaggggtccagccagtggcaacggaggttggttgcctgctactcccagtggcagccgcgaccacagtagcagcagttccagtggctcagagctgggcagcggcgagacgtatctgctagactccaggagccgctcagagggacctggcgacgagcaggaggacgccttcgactccaccgaccgcaggagccgttccgagcattaggctcgctttcccttagtttaccgactgcttagtatttgtctgttagtttgtgtgtttaggtttgttcgcttgtgggtcagtcgacatttgatatcatgtgcctatgatatggctgtcttaataaggatttgcttgctgtttaaagtgtttcaattcagatcagaacaattgcagtttaaattcctataaaataaagcttagttcctgagcatctgtttttcttcttttccaccccctccgtctgctcttccttcagatggccaacaccaggaatggcagccgtgcagcaggtgagggcagcaacggcgaagaacgcaccgacggtgggtatcccaacagcgcctccggcaatggtccgcccccgctccccgagaatccgactcttgccccagtaatggctcatcaaactcagatgatggcagccatgatgcagcagatgcagcagcggcaccagcagatgcaccagaggatgcagcagcaagccgagcagcagtagcaacagtttggtccccctccccctcagtccaagctactagagtttttacgcgtcaggccacccaccttttccagcaccaccaaccctatggaggcaaatgactggctccacaccatagagaagaagctcaatctcctacagtgcaatgatcaggagaaggttgccttcgccacacaccagctccaaggtcccgtgtcagcttggtgggacaatcacatggccacccgtccggcaggtacggaggtcacttgggtggagttctgtcgcagctttaggaaggcgtaggtgcccgacggggtcgtggcacagaagaagagagaattccgggcactccaccagggcaaccggacggtaactgagtacctccatgagttcaatcgcctagcgtgatatgcaccggaggatgtccgcactgacgcagagaagcaagagaagttcctagcaggcctagatgacgagctgaccaaccagttgatctctggagactacgccgactttgagaagctggttgacaaggcaattcgtcaggaggatcagcgcaacaaagtggacaggaagagaaagccagcgcagttccggtcaaaccaaggaagtcaccagcgaccgcgcttcactcccggacagcagggtggacctaccaccatgatcgtccgccagcatcgccctttcaactcgagcagcttccacccgggcgctagtggcagctagaaccaccagggaggtcagctcaactgcagtgcagctctgcgcccaccaatggcaccggcacaatcagttccatcagcccaagccaagaaggagactagagcaaagccaaggtcctgtttcaactgtggcgagcatggccactttgccaacaagtgcccgaagccaaggcgtgccgggccaaggtttgcccaagctcgtgtcaaccacgcgtccgcagaggaggcgcaagcagcaccagaggtcgtactgggtacgtttcttgtcaactcagtccctgctacagtactttttgattctggtgcaacgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgaatccaaagacctagatgtcattcttgggctggatgggctgaccaagttcaagggagtcattgattgtgcgaatcgcacagtcaccttgaccaatgagaagggagaaaccatggtgtacaagtcaccagtctcaccgaagcagagaatctccttaaatcaaattgaggtggaaaaccctgtgaccaccgaggagaagagttcgcggaaattggaggatatccccatagtctgcgagtacccagaagtgttccccgaagacctcactaccatgccacctaagagagagattgaattccggattgatttggcaccgggaaatgccccaatttacaagagaccgtacagaatggtagccaatgagctagcagaggtcaagaagcaggttgatgagcagttgcagaaagggtacattcgactaagtacttcaccttggggtgctccggtcatttttgtggataagaaggacaagacgaagagaatgtgcgtcgattatcgcgcactcaatgaggtcacaatcaagaacaaatatcctttgccgcgaattgatgatttgtttgatcaactgaatggagctaaagtgttttctaaaatagacctgcgatcaggctatcaccagttgagaattcgggaggggatattcccaagacagccttcaccactcggtatgggttgtatgagtgcacggttatgtcttttggacttaccaatgcacccgcattcttcatgaacttgatgaacaaaatgttcatggaatttctggataagtttgtggtggtattcatcgatgacattcttatctattccaaattggaagaagaacatgagcgacatctccgtctggtactcgagaagttggaggagcaccagttatatgccaagttcagtaaatgcgacttttggctatcggaggtcaaattcttgggtcacgtcattacagctcagggcgtggcagttgatccgtcgaatgtggagtcagttaccaagtggaccccacctaagaccgtgtcacaaattcggagttttcttggacttgcgggttattaccgtcggttcattgaaaatttctccaggatcgccagacctatgactcagttgcttaagaaagatgagaaatttaaatggacagctgagtgtgacaagagttttgaggagttcaataagaaattagtatccactccagttctgattttgcccgaccagacgaaagacttccaagtctattgcaacgcgtcccgtcatgggcttggatgtgttctaatgcaagagggcagagtggtcgcttatgcctcgcggcagttgcgtccgcatgaagggaactatccgacacatgacttggagttggcagcggtggtttatgctttaaaaatctggacgcgttatctgattggcaaccgctgcgaagtatatacggaccataagagtctaaaatatatcttcacccaacctgatgtaaatctccgacagcgaagatggttggagttaatcaaggattacgacatgagcattcactatcatccgggcaaagccaatgtggtggcagatgcattaagcaggaagagctattgcaataccttatgcactgaaggcatgtgtaaggaattgcagcaggagcttgaacacctcaacttggggcttgtagaatacgggtacgtggctgccctagaggcacgacctacgctcgtggatcaagtcagagcagctcaagtaaatgatcctgaaatagcggatatgaaaaagaatatgagggtcggaaaagcccgggatttccacgaagatgaacatggcacaatctggttgggagaaagattgtgcgtacctgacgacaaggaactaaaggatctgatactcaccgaggctcatcagactcagtactccattcatccaggcaacaccaaaatgtaacaagacctcaaagaaaagttttggtgagtcagcatgagaagagaaatagctgaatttgtcgcactctgcgacgtttgccaacgagtgaaggcagagcaccaaaggccagcaggttttctacaacctcttcagatcccgaaatggaaatgggaggagattggaatggacttcataacaggactgccccggacatcatctggccacgattcaatctgggtagtcgtgaatcgactcactaaagttgcccatttcattccagtgcataccacgtatacggggaagaaattggcagagctgtacttggcaaggatcatgtgtctgcatggagtacccaagaagattgtatctgatcgagggagtcagttcacctcaaaattttggcagaagctgcagaaagaattggggacccgtttgaatttcagcacaacctaccatccgcagacagatggccaaaccgaaagggtcaatcagatcttggaagatatgctacgtgcatgtgtgctcgattttggtggagcatgggataaaagtctgccttatgcggaattctcgtacaacaacagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcgacagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatgatcggcatccatgtcatgttccatgtatcccagttaaagaagtgcttgagggtacccgaagaacaagccgattcggagcacattgacatccaagaagatctgacctatgtggagaagccagttcgtatccttgagaccagtgaaaggaggacaagaaacaaggtcaccaggttctgcagggttcagtggagccaccacttagaagaataagcaacctgggaaagggaaaatgggttaaaggccgcccatccgcacctcttcaccagctcttccgaatctcggggtcgagattccgtttaaggggggtaggtttgtcacaccctgaagttctttcccaagcctaaattgaagttataaatggtctcaagaaaatacaggtgtaaagcaagagtaaaccctaataaattaatgcaaataataaccggatttggcatgtgaaatttttcttgagttctacatgtcgaaatacgctaagaagatttttagtggaattttcagagctctggaaataattttaaccaattaaaattgagcacaagcaatatttaatcctaggaaaattcatttccttctttttcttttttttctttcttttctttnacccttttctctttcgaatgggccgccagcccattctctcctccctccccttcccgctgggccggccgaagg

SEQ ID NO: 24732 - DNA, 3308 bp, Oryza sativa
gtgattagtttcaccctagtctagtctaatggaattgaatagtataggtggatggttgggcctgttgcaatgtggtgtagcgttggacagtggatgtttaatattgattaattattacaaatgttttactgtttccaactactgtttataaatgctcgctttatgcaaatgaaccactatagctatccctcgatacttccctgcatcatacccctattccggtatgacgtgctgagtacagtgggtagtactcagtcttgctctatttttcccaaaccccagagtttgagtatgcgtcagatggtggcttctccgaggagtaggcttcgtccgtgccgtcgaggatgcctgtggagtggggatcccgctgcggtgcaagtcaaggcttagccccatttatcttttaattttccactgcatttatgtaagacttttataatgtttgtaagacgtggatctgtatgtcaactttgttgtttctgttccccggccggtcctggacgagaattttaatgcacattctgcttggaattctattcgagaatttctgggcgtgacaacaatgctggaggattgtttcaaatattacaagggatgtcaagattgtcaaaaatttggagcgattcaaagggcacaggcatcggctatgaatcctattattaaaccatggccatttagaggttggggaattgatatgatcggtatgattaatccgccatcaagcaaagggcataagtttatattggtggcaaccgattattttaccaagtgggtagaagcgattcctttgaagaaggttgattctggggatgctatacaatttgttcaagagcatataatttatcgatttggtattccccaagccattacaaccgatcaaggttcaatcttcgtgtccgatgagtttgttcagtttgccgaaagcatgagtatcaaattgttgaattcttcaccatattatgcacaagctaatgggcaagccgaggcatctaacaagagtttgatcaaattgattaagagaaagatttttgattatcctcggcagtggcatactcgattggccgaagccgtgtggtcttatcggatggcttgtcgtggattgatccaaggtcctccttataagcttgttatggacatgaggcttgtttaccatgggaagttagaatcggctcaagaagaacgagttgcaaatgatttgacagccgatgaatattatattctcatagccgatgaaagggaagacttggttcaatctagattgcgagcccttgcaaaggttaccaaggataaggaacgagttgctcaacattacaacaagaagggggtgcccaagactttttcggatggtgaacttgtatagaagttgattttgccgattgggactcaagatagtaaatttggcaagtggtcaccgaattgggaaggaccgttccaaatctataaggttgtatctaggggatcttacatgttgcaaggactcgatggagaagtttatggacgagcgctaaatgtaaaatatttgaagaaatattactcaagtgtttgggttaatgcatgatcggctggtgttgccgatacattatagccgatgtattcacatcgccttgagatggccgatgttatatcgcccttagttgttttcatattgtaatcggttatggtttgccgatgtacaatggctgatattgttatatcgcccttagtacaaattataattttatcaatgcttttgacattgtaaaattaggggggcacatatatgaaaaattgcaaatttttgagcaaaaaatatggagttatattgaatcggcataaaggttatcaagatgagttagataaagagctagagtttcttagccgattacaaaatttcctaagatctattacacaagatatcactgagacaagtagcgctggatagccgatatagctctttgcctaatttgttctacttcttcaatggcttgggcatcttgagcatcggtttcagagatgaatcttagggacttggtcatatcagcgacattcttgatagccgatttcagccttgccttttgttcttcgacagattgtgggagatcgactagcttcttgtgttccagatccagatcggcattgcattcttggagttgtgccaagagctcaatcttccgagcttcaagccgatcaatattagacctgatcgggccttcagatagttgatcaagtttggacttttcttcatgcacgagttgccgattggcttggatggtagcttcaatctctttgcgttctcggcgttcggctagtttctgcttggctttctccagcttgaattgatgctgttcaagataagtagctggagtaaggacattggctagttcttcaggaattagagcttgaacttcgtgtagccgggtcctaattgatccacagtcgaccaccaagctgcctagagaagatgcctctagccgatgagagatatcttcaagagttttcttcacatcatcggataagggggctaaggctttgcttgtggtatcctcttctgtctcatcaaagtagtccttgatgtcaatagagaatagatcggctaagacccgtaagaacaatttcaagagagttaggagctaaatagacatagccgatctaagttcttgtatcaaagggaaacttactgggatagcaggagcggctggttgttcttcttcctcaacgcggtgactccctatagccgatggagtttggtcactggatgattgctgtacagggggagaaggaggaggaggctaaaaagagacaagtattagataagatcggatgagatcaactgctgaaagaattaagaacatcttattggtggagccggtttgagagttggtgctgccgatttcttcttaacagcaattctctttttctgcaaagacaagattaataagtaatcggctgaagataaaatggttataaaagggaatcagggaatggtacttaccctcgagaaatgagctggggcagaaggagttgaaggggtttgattgggtgaagccgatggtgttttatctgtatcacttacttcggctgcggcttgatcaacatcttctccgatttcctcttcatccaaagcttgttcaatggatggatcaagggcaggcagatcatcggttggcttgggtttcagttttttggccttcttcttgagagccagaaccgatggatcaattgctggcactttgggtttccttttcctgcctgcatcggctggttctctcatctgcccttggagcagacttacggtcttaggggcatgatagccgataactggaggggtt

SEQ ID NO: 24733 - DNA, 2789 bp, Oryza sativa
  unsure (1)..(2789): unsure at all n locations
nnnnnnnnnnnnnnnnnnnnnnnnnnnnnnnnnnnnnnnnnnnnnnnnnnnnnnnnnnnnnnnnnnnagatatccatcactctatgacacatccaacggcttgattgtctagatgttgtccttcttttcatacttatagctgcatcagttgagtttgatcttatgagtcgtgattagaatctcaaatctctagcctgtctttggttgccgattagggtagtatcggagtttcagctgatcttacctaacttaactatattcatcttatatgctttactgatatgttaaatctgccctttatgttaagatcttgttgcgttaaaagtatattaggctttctgtttgatatattctacttgcattaatatcttaatatagagtggtatcggagtattagccgatacatgctagatctatctgatcggctatgctatgtacatatatagtctcattattaatatatatttcgatttaagtgatttatactatctcggcatagcgaccgatctatcccaatcacaaggattgcgtattgttaatatctacagccgatcgagtagatttagtatatccgacataaggattgtgtattgttaatatctacagccgatcgagtagatttaattctgtcttacttattaatgactgccgatcgatgcatatatgacatcggctcaaagataaatgatatgtcatcggcatttagccgatcggcgtttatggatttaatcgcggtttctttgtctttgtttcttattgattgcaggatcaaattaattggcacgctcacacacccaaaggcaagttttggacctgcactagagttaagcagatctcccaggcctcgtgtttttacatcaacaaaacccaaattcatccctacagccccacatccatacagcacattcgcattcatatttcacattcacatccacattctacattccacattccacatccacatcacatttcacattcacatttcacaattcacattcacattcacattcacattcatcacaacaaataaaaacctacaagccattcatcacaacatataaaaacctacaagcctaagtcaaaattcgtaaatccaaactcaaaatatatatcctaaacatttgcatataaatcctaaacatttgcatatatatcctaactcaaaatatgcgtaggttaaaattcctaagtcaaaagattgtaagtctaaatttttaggtcgaaaaattcctatgtctagattatgaacattaatatgaaaaattcctaagtctgcaatatttaagaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtacctgaagcatgtcatacctcagcattgcggtgattgtatccatcctctacaaaatatagcatgtaccgcatgacgtagaatccacagaggtcgatggcctctggttgacgaaggatatatttatgttcgaagatccgaaattcagttgcatcaatcttgcatctcccatacgatcttccggacctacagtacttcttatatgccctatttagtgcactgaaaatagtttggtacttgtctatccctctcctcaggctatcatatatgcaaattgaactatcgtcgatgttgattacgaggaggatccaatgatggctacacatagtgacaatttatcaataacttgatatgggtcgaggggcaaacataactggaaatcgatgatagtgacttactgagaaaggtaaggaaataaaatgtggtcacatccattaagtttggcgagggcatcaaagagatagcggtcaatttcagcttcggatgtgcattgcttgtcaaagtttacaacggctgggtctagaaaagctatcttatggttcatggatctaacctgataagagcaatgcccgcaaaaggagaacacagttgagaattactgagtacgtagaatgctatggattaagaacgacaagatatcaaaggactcaaaatgaccacaattgcaggaggcagatatcgaattcccttctttggtacaacggggagtcctctaaattctacaaagcatgtattactggggtggtgaaaatccacatcagtgtagtaggcaccgaacatcccgacccccttttttggcctcctccaaataccattcatgcagccaatgcgcttgagttcctaaggattcaatttccgtgtcaagcaccatcggttgaccaagttggaatcgcagtacaatcggggcctcttcaagttcatctagattgtataggcttttcaaaccagctgacttgcagaaatcaannnnnnnnnnnnnnnnnnnnnnnnnnnnnnnnnnnnnnnnnnnnn

SEQ ID NO: 24734 - DNA, 3295 bp, Oryza sativa
gcttcttaggtgacttcggtggtgcgcacttgatgaaatgctcgatgacattcggaggaattggaatctttggttcctcgagcttcttaggaccaaaaagtgaagtgatgctggcattgattgtcttcttaggcagcgatgttgttggctttgacactaagtatgaattggaatgtgtgagtcactatttgcttgatggaacagacatctgtgatgcacttggtgttcgggtcttttttctgagtgggggtggacttgtggacttctccggacgatgtggttcattaggtgtgttttcacgaggtggactgaaggtcctctgtcgaggcggagaaggagctagatttgcacctcgtccgtttgaagggctggaagcaccgtcgcctggatcccctgccccatcgttcaacgtgataacgatgtagcgtttgggccatatgatcaggttgtgaagagcagcgcccagagtgtcaaccccttcctccggaggaaactgtagcacataacctctgtattggcttggcacgtcttccacttcaacccttgagtggcctacaggcaatggaacaccatgtattgtttgccctgcacatattggatgtgccacaccgcgtgcaatctcctgagtaatgttgctttgaagagggacatggagcacgcacggcatatgtgttgttatgtcgtccacaacataacgtgatgtgtcctgttctggaggggggttatccgcggacgcgcaagtgctccgtttggcacctgggttaaccacttggtcaccagcttgcccctgttgtcttggtaacccattgggaaacagcactgcaagttgttcctttacctgacgggccacctctaatctcatacgtttggcctcctcttctctcatgggtcttcttggatgggcccgatacatgtgtgcatcatctgggaacccttcctttcatggatcggaaccaacgcctctcgtgcgtccagggtgctctttcatccccagtgccaatgtgaactcatctttttctcttactggcacatatttaccctgtctcgccaagaaaacagcctcggtgatcttttctttcagctcttgctatcgaggtcccagtgcaaccaactcccctgaatccgatagttgagccttcctggcgtacgcgtagtgctttgtccgggtcccccatccatctatctcaacaactatacctgcttggcacagttgttcctccttctcttcccatttggggatattcttagcatatctgctcggcccaagtcggtagaaagcttgttcaacgcggagttggccttgtttagggtgctcacttctcttgcctcttgagatgttttccagttcacaaactcatcccattaatctgtcaacttctgatacctgggtttctcaaaatccagggtccggttgcgttggaccaacttcgcgttcaagtcagtcctccactttctgaataatgtgctcatcttcgataaggctcccttctttgctagctcttcttggccttttggaaaggtgaatgtcagcttcaactttcgccaacattcttccttcaggttatgtggcaccgtccagtcgagttgtgttacatcatttgttttccaatgtctatacttgatgggaatgaaatccttgacgatacatccacacgccctaccatagggagttactgccgtcgatggttcgtgtggccacccagtttcagtgagcactgtcacaacgtagtgaccatccggcatcgagctaggacccctaggctacctcccatatgagacggttgaatcctggcccgaaccaccagtggaagtgccaacctccttggaaattgcaaattcgattagttcgaatggtccattagagttggaatttgctaatgcactattgcgtgaaatatacgtcgaaattacctcgctgccttcggaatgctcttgatttaagtttaagaatgcgctagggctggcattatgttcaccctcagatccggagctagcgaattcttcgtgttccatctagtcatcatcgagcataataacattactaatgttgaaaaataacatggtctaaaggtgtaagatattttgtgctctcggaactgctacaagcacaaaacaggaatatatttgctctcagatggcgggttgccaacttaatggcctcctcgccaaaatatggcaggctgccaattgcacggcctccatgccatggtgtactaggtcgtcatcgattatgtgtggcagtataaacagagacgagaataaagggcaattcaaaaatagtgaacaaaagagaataagggagagagcgtgtggataagagagatagagggtgaagtgggtaagtggttggccgggtaattaaatagtaggagataggtgccggttttataccctaatccggcacaattcacaaatcacacaaataaatgaaatactgccacacataatctcccatcatatgaatttcatcatcgagcagcaagttatattcacatggggagtttggaaagattgggtaaatgttcagatgtgcattccaagatatacttttcctttaccaaacaagaaatgaggatgatggatcatggaaacagaacctaagggcatgaacatattaatactagtaatataacctaagtaagcaagtaagcaaccttaagtagccacattttaaatcagcagcagcataaaaaaaagctattagcaatccagggagcatgctcatataagtattggctcacacgaaaaactgtactcttatcataataccatagatctgatcaactgtatgagatcatacaaaatactggtaatatgtaagacggatgctctcctagtgtcctgacaaaaaattgcaggccagcattgttacagaacaaagtggccttaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagtatttagcataatcgacagtggaagtattgtatctagataatatccaggtgcacccccataatcgacagaggtagtacttagcatattcatgtctcagacccataatcgacagagg

SEQ ID NO: 24735 - DNA, 1631 bp, Oryza sativa
  unsure (1)..(1631): unsure at all n locations
nnnnnnnnnnnnnnnnnnnnnnnnnnnnnnnnnnnnnnnnnnnnnnnnnnnnnnnacaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagtatttagcataatcgacagtggaagtattgtatctagataatatccaggtgcacccccataatcgacagaggtagtacttagcatattcatgtctcagacccataatcgacagaggtagtacgtagcatattcatgtctcagatcacacacatgagcaaattttgctaaggggaggagggaagaagaagaggatggatggggggagaggggtgntcctctgcgtcgggccgtcgttgacgccttcaccttcgacttgccggtgaccctcttcacctcgccgtcgcaccgtgccgctgcaatcgaaatcagaatcaaaattcttgtcttcctcccctccctttccttgcatcccctccgacaacagcagcaagaatcctcctctctaagcaagaagggcgtgaagcgnaagttctagagtctttgtaagnagnagnagaatgggcttaacgcatccgccgctcacttcctcctggccaccgcacgctgtagagccgtcctcaccgctgcgtcaagcagccgcaccgccgcgcgcagtcgagccctcctcgccgctcgcctcctcctcgccaccgcaccgcagcagacgacgacctgtagggcgccgcgccgatataagggataaggaagaagggatgagagatagagtgaggcatatttaagtaaaggagatggtaccggttctaacacaaataggtgccggttctatcattaaattcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacatacaacgcttggtcattctcttcagcagttgcctcgttttccgtctcgatatcaattgtgggtagcggtggctcatcgggctgatcgtagtcatcttcgtcaatgatattctccattccgacaatacttcgcttgccttttaatacaacatgacatggcctcatgagtgatgggtccttaatatagaatatttacttaacggac

SEQ ID NO: 24736 - DNA, 6226 bp, Oryza sativa
gcatcgatgcgcacagcactgttttgatttgtactcttgttgtcctgagtcttggtgtaaatggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaaatgcagcgggaaagattaaagcgagctaaaccgggaagcttgacttcagcagcgggcgacgccactccacaggcaaaccttgacggcagcgacgaaaccaacctctctgagacggctctaactaagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggtgaaatcgtgacaagaccctccacataaccctcccctaaccatccacaccacgctaaggtttcacccccacccctcaaaaggcagtgggcggtcccctcttgcgccgcagtgaatccggcagctggacaaccggacaccccggccgacccaacttcatcacgcccaccctcgccaccggtgcctaggaaagggtcgagctatacttcagatcaagcagttacccactcccgcttgtggtaagcacggtaagtctcccagggtttcccatgaaccggtccttaactgccatgggtgcgaccagcaaaaccatgcactcacagcccgccattcagaatattttaattaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgaactgatgagacctcagcaacgtcttcgagaaaccgcggatcgacgaaacggccgaaacccacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataactgtgtttttactaataaagaaaaagtccttaattaattattgcgcaataatacccagggctgacgtcatccaaggggggcgccgacaggtggggcccatgggtcagcggctcaaaggggagaggaagggggcgccggcatgtgggccccacgggcagtggctcaaggtggccggtctaccgtagaccgggaccacgcgggtggtccaccgccggtccacgggaccgacggtccggatcggccgggaggccgatcggacggcacggcagcggctaggcacggcttcaaaaccgaccggccggccatggcaaccggctgtgacgcgcacggtcgccggcgacggcaatcggcggcgcgggaagcaacggcggacggggtacaggacggcggcgtcgaccgaaggtgacggcgagcgcgtggagagaggcggcgcaaacgagagagaggggaagagggaggaggggaggatcctcaccggcgagtatggcggccggggcggaggataaggtggcggcgacgacctggcgatgaagaagggccggacgggtggcggcggcacctacggagggtgttgagaaggattaggagtagagagagtgaccacggcggccaccattgttggccggagacgaaggagaatggatagctcaccggcgtgcgaggagaaccgggctccggtggggtttagcggaaatcgagcggcggccgaggtggctcacgcggcggcaatgctaatgccggcggcggcttggcgcggcggcggctctagcggctgcggcgcgcgaccggaggtggcggcaagcggcggcgctagtggcgagcggcgcgcgaccggtaggaggcacgggaaagcgcggcgaaaaggggaaaagggagagggagatgcgggaaagctttataggggctcgagaggggcggacatggccgggaaaccccccgatttggccagcgacgtgggggaagagagagaaagtgggggggattcaaatcgaatcccgcccatttgcgggcgcgcgtgcgggcgggaatggcggggagggcggcgacgtggggacgcggagtgggggtgcggcgtggagcggagaaggcggcggcgcggacggtttcggcggcggttgccgtcgtggggcgggcggctggaggaaggggacgacctgacaggtgggccccacctgtcagcgtcccggagagaggggaaaggggaacgggccggcccaaaggaaggaggccgagcgcgtggagagagtgagccgacggcccaatagagaaaaaagaaggaaaagaaaaagaaaaagaagaaaggatttttcctgggatttaaaattgcattttggtgatttttaattggttaaaattatttccaaggctctgaaaattccactaaaaatcttgttaatgcattggagcatggggtactcaagaaaaattccacacgctatttccgattattaattgcatttattaactagggatttagctctaggttaattaagataatttcttcgggcaatttatttaaccaatttttaaagcaagaaaaaggggaaacttcagggtgtgacaataaccctcgacgatgctgccttcgggtcttgatctattcctgacatatttctttatgatgcccataaacctctcgaaagcccacatgctatgcagatatgctggacctaagatctttacttgttccacaagatgaacaatcagatgcaccatgatatcgaagaaagaaagagggaacaacatctccagctggcaaaagttgagaatcgcgtcctcctgaagcttgcccaatgaagccggatcgataaccttttggtttatcgcattgaagaactggcacaacttgatgattgggtcttggaccttttctagaaggataccctaattgcgaccggtagcagttgcgtcataagaacatggcagtcatgtgacttcattccaaccaacctcttatctttcatgctaaccagtctcttaatgttcgcacagtaaccggatgggactttgacaccccacatgcattccaacatactcgttttttctgcagcactaagagtgtagcatgccggagataggtaatagcggtcatttcctctgtcctgaggatgcagctctttcctgatgcccatgtctttgagatctttccgtgcttgcgaagtgtctttcatcttgccaggtgtgttcaacaataccccgagcacgccttggcacacgttcttctccacgtgcatcacgtgcatcacatcgatcgcatgacgaatatccaggtctttccaatatggcaagtcccaaaagacagacttctttttgaatagaggggtctcaccgctcgatgtggatgcacatgtgcttccgctcccttgcatacttttcattactccaaatctgcaaattcaccacgatacagaatgcaatcatttagacaagcgtgaattttctgtatgtcaagactaaggggacatgtaacttttttgggttggtacgtcgattctggcaagacattgtctgtaggaagaatttctttcaagagctctagcaactcatgaagctcttatcagaccatccgttgctcgccttcaagtgaagcagcgataggaccacttggagcttgctgtgctctgccttacatccattgtaaattggagttttggagtccttcaccatggttgtgaacttgtgatattccctatcatcagtgtcaaatctctccccgtcgcgcaacatctgatctagattaggttcaccgtgatcgacacatgtttggtcctcctcctcctcgtagcctacatccgcatcatgcccatgacagttgccagcactttcctcaccttgattctcctcgctaaggaaattgtccataaaaccccttgtaaggatatgtgaatggacccgctgagctggaagttgtctgtctttcttacaatcatggcatggacaccaaatatattctggtgcatcgactaagtttgtgctggtggacgtggcaacgagagccgttactcccctgaaatactccacagagtcacgatccgctatagttatccattctagatccattatatccagtgggtacctgcggttattatcatttattacaaaccatgaaggaaaaaaacaatgaagatttcatcatttacaagcacattagaataaaaacaactaggaatgaccattttaccctacgacaaaaaagaggtttttgcacacacccacggcaccttaattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattggaattttgttaagtactttgagtgtccaagtattttca

SEQ ID NO: 24737 - DNA, 5101 bp, Oryza sativa
gtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggttttattagtctttttcttcgttttgcgtgttagcttgtcgtttccgtcgttgcgaaggttcgtgagtgcgtccgaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaagaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgtggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctagttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcctaatttttaatcatacaaagagcatttcagtaattaaccacatattaaattaatcattaaatggtctaattgtaattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggtttgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacaatagcacactattgggataacttatgactcactattatttaaggatggcttaatgatagttcacg

SEQ ID NO: 24738 - DNA, 1314 bp, Oryza sativa
  unsure (1)..(1314): unsure at all n locations
agagaatatgagagctcttgcttgacatgtgtgactgaagtgagaagagcaactccttttatagcctcccaatgacggttgtgacggttggaatggtcgnaaataccctccaaccgtcattgggggctaatccacaccgtccaggcaaagccctggatcggatggcgctgaggaggattcggccgaacctggggccggcccaatccagcccatttttggctggcggcctcctccgttgttcttctctgcagacttgtgaattttggcccggtttgtcgtgtcaattctgagttcttggcccactcatacataagtctaattctcgacatcgcctaattgatttattgtctgtgttgatgtcgattctcctccactttattgttattctctgcaaaaggttagtgaacctaatactagtggaatattattattctaacatgtatatgcattgcaagcattattagttctcctctattttggcaatattgatggtcgaaactgatcgataacgactgtcaacaaaaccccccaagcttgaacctttgcagctcatttacctcaggttcccagataattgtttgctatttatatttaacctttgagagagcacttacctatgaacctatatataagagatataaaacagagcaactcttcatcatttcaacaaagagaactagcttgtcttacctagcataactcaaacctatcctatctttttttttggtattttctattttgcaaatttttatgttgtcttcaagtttataagatgcaattggaaagcaaatatgtaattggaaagggaaatatgcaattggaaagggaaatatgcaatgtgatacaagttacctcagtggggggagagatatctccccccaagcttggctttccctcagggtccttgataaggattgaacccctgaaagcggaagtacgcttgaacatcatcgtgctgttgctgcatcatgttgttgatgttggcaaactgagcatcagcagattgttgccattcttacgtttgagctatgtgttccgtgaggttgtactggatctcccccgtctgcacatcaagggtatccattctcctagtgatttcacccaagtcccatcgagaagaactcgagcgccattcacttggagatggaggcataccacttgatctaagacgttggttgtccccccattggatatcatgaggcacacgccaccggtcctcactggcacttgcccagcttgagactctaatgctgggcgtggaacttgggtccatccgggtgcatccccagttggttcccaacctgcctcatacat

SEQ ID NO: 24739 - DNA, 2837 bp, Oryza sativa
catgaggcacacgccacgggtcctcatgggcacttgccaaacttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaaccaggctcatctaccacagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcagaaaagacatgtgggacccaatagccgttgcccagccaaaaatggtaggtaactgttgcctggccggttcggtcgaacccctcgtgggcccaaccggcaccactttcggccgttggattccaacggttagtgcagtcgtggcacagtgaattttcgttgaaaattttattttggtttgctctgaaaaattcatttgaagattttcctcaaaactcaaagaatcctaaatggaaattttgaaattcaaacatgtgttgatgcataaattcaaattgttaaagcaaaaatgcagatacataccaatttcctatggcgaaggtcgcgtcatttaaaatccgacgtgcaagactgtaccttcttctgattcagttcgtggattttccacccgtctctgaaggtgatggagcgggcgtgtttggcttttccctccacaccttccatggctttggtgcagaaggcggcttcttctcagccgactgctctgacttcttggccggtatagttggttttatcaacgtcctccaataacggttcctaggcatcgttgtttccttctctaggaaattctgcatgaacttcaccaggctatccgtcttgggtggctccacttcgaccacttgaatattctgcgggttcggcccgtactttatcctgaccatggagcattgttcgacccttggttgaaactcaaacttttcctccttcccgttaatatgaaaacggatacttcccgctcccacgtcaatgttggcttccgtagtgctaaggaatgggcgccccaggatgagcgacatctcttttcccgtgtccatgtctagcaccacaaagtcaaccgggatgaagaaatcccgtatcttgactggcacatccaccgccatccctgctgggtaacggactaacgagtcagctagttgtaggcgcatcagtgttggtgccaacaccgtgaagttgagcttgtcaaagacgtcttttggcatgacgctgacactggctccaagatcgcataaggcctggtcgaactgctgtaccccgatcgagcaggacaccccggatctttcttcttctttgggagcttgtggagtatcacgttgctgcattgctccgtcagcttaaccacctccgttgttgggagtggtctcttgttgttgagtatgtccttgagataacgggcatatgttagtacttgcatagcatccaacaacagcacgtttatgtggattttctggattacttcaacaaaacgagcgaattgctcgtctactaacggtttcctactccgttgaagaaacgacagcaaccgtgcgtcgtagtactcctgcggcatggtcttttcttgctaaacctctttgtcagctgagtcactagatagcgcttcttttgtaatcccgttagttcgtgcagggg

SEQ ID NO: 24740 - DNA, 10171 bp, Oryza sativa
tatataacttgtgattgactcctcaatcacctttgccatgggcatgcacttccataatctataacattgagggacccagagatatctctccataggaggggcaaatcccatcttgattattcatatcccacaacatgtttcatagcatacccgaaaactacttttatagctacccatttacggagtagcgtttagcagtccctaagtaagctactacacatgttgagaagcatgataatctcaggtctaaggattcaacaccaacactaaatgagatcactgatgacacaacacatatggctcttgcagtgtctcatgttgggtctatccaacaacatgttcaccaacatgtgtccatattattaatttggtatctctataccatgatccatgagacatgatcatcaattaatatatgtgctgatcatataaacatatttgttccacatatgatatttgatcagggatcctttagaaatagtaacaaacaacataatgattctcatgaaagaatcacatattcattaaccaataaggagttatctatttcaaggaacaatgttggataaatatgtaaacaaagtatgtgatacaatcatctctataattgcctctagggcatatcactaacagtctctcacttgcactagagtcaatcatgaacgtatcatatacccattgccctagtgtgtgcctcatgcttaggctgagggagtggctttgtcaacggatctgcaacattcaaatccgtatgtattttgcatatcttcacatctcctctacccactatctcgcgaatgaggtgataccgccgtaaaatgtgtttggacttttgatgcgatctaggctccttggcttgcgcaatggcaccactattatcgcaatagaggtccattgggctagaagcactagtcaccacacctagtcgagaaatgaatttctttatccaaacagcctcctttgctgcttcagaagaggcaatgtattcggcttctgttgtataattagacactgtatcttgcttggaactcttccaactcacagcgcctccattcaggcagaacacaaatccagactgtgatctaaaatcatctttgtcagtttggaagcttgcgtcggtgtaaccatttacaacgagctcttcctgtcctccattgactaggaacatatccttagttcttctcaagtacttcaggatattctttacagctatccagtgactctcacatggatctgattggtatcggcttgttgcactaagtgaatatgaaacatctggacgtgtacatagcatagcatacatgatgaatctgattgccaaggcatatggaatcacactcatcttgtttcgctcatcagtcgtttgagcacactgattcttgccaagattaatgccatgtgacatcggtaagaaacctttcttagaatcttgcatgttgaacatcttcaacacctttcaatgtatgtactctggcttaatccaattagcctctttgatctatctctatagatccttatgcccagaatatatgttgcttcccctaagtccttcattgaaaaactatttttcaacgatgtcttaacggattcaagcataagaatatcgttcccaatcaataatatgtcatctacatataggattagaaacaccagtgcgctcccactaatcttcttgtatacacaagcctcttcttcgtttttgacaaagcccaacgccttgactactttgtcaagacgaatattccaactccgagatgcttgcttcaacccataaatggatttctgcaatttgcatatctttttagctgattgtggatcaacaaatcccttgggttgtgtcatgtacacatcctcatcgagatttccattgtggatagctattttgatatccatttgccatatctcataatcgaaataggcagcaatcgctaaaacaatccgaatagattttagcatggcgactggtgagaaagtttcatcataatcaacaccttgaatttgtctgaaacctttcgccaccaatcgtgccttgtagatgttaaaatttccatctacatctgtctttttcttaaagacccatttgcactcaatggcttttacaccattaggtggatcaaccaatagttccaaacttgattgacatgcatagattctatttcggatttcatggctccaagccatttctcagagtctggtcccaccattgcttcctcataggtagtaggttcatctttgtctaacaacaatatatcacgttgtcctgtagttaacaacgcatacctcgcaggtgtacgtcgtatcctatcggatcttcgtgaagccggtgcttccacaactggttcaacaacaacttgttcaacctgttgaacaacatcttgctcagcttgtggttgtgtggacgttgaagcgttttccggtgtttcttgaatttcttcaagttgcaccatgctcccactatcctgtcttgaaataaactctttttccaagaaaacaccgtgtcgggcgacaaacactttgccctcttcccgattataaaaataatatcctttcgtttccttaggatatcccacaaagaagcatttatctgatttaggtgtgagtttgtctgattgcaaacgttttacatagaccacacagccccaaatctttaagaaagacaaactgggacgctttccagtccatatctcatatggtgtcttatccactgattttgatggaaccctgtttagtgtgaacgcaactgtctctagagcgtaaccccaaaagcttagcggcagatcagtttggctcatcattgatcgtaccatgtccaacaatgtacgattccttcgttcagacaccccattccactgaggcgttcctggcggagtgagttgtggaacaattgcacattcctttagatgatccccaaattctaggctcaagtactttccaccacgatcaaatcgtagatacttgattgtcttgcccaaatgattttgtacctcattctgaaattccttgaacttttcaaagtactcaaacttatgcctcattaagtagacataaccatatctactaaagtcagcggtgaaggtaataaagtacccaaaaccacctttggcagttgagctcattggtccacatacatcagtatgtactagtcccaatagttcacttgccctttcactttgacccgtgaaaggtgcctttgtcattttgccaagtaaacaagattcgcatgtctcaaatgatttaaaatcaaaagagtgtagaagtccatctctatgaagcttctgcatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaatcattgtccacttcgcctcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttatccagactctcggcgtaaccaatcattttgatcacatgtgggctcattggattaccttctgctagcctgcacgcaaccaaggactttgaggtattaaacctctcagctcttgcttggtcctcaaacatgttacgtagtctcgtgattatcgtatgagcatccaatgcatcatattttctttgaagctcaggggacatagtagcaagcatgagatagcttgtatcaagataatcattgcatcgcttttcatgctccctacgttgagcagcaggagcattgttgggcaagttagcttgtaaaggctctgtaagcacaaactctttgtgctcttgcctgagaacagttctcaggttgcgataccaatccatgaagtttattccagtcaacttctctttctcaagaatagaccgcaagttaaaattggatgatgcaggagctgccatgatctacaatagaaatatatgtatgcaaaatcagcatcatgtttacatttaacctttcattaaacaatttaacaaaagatacttccactatgtattgtgaaacaaaattccctctagtaacatagtgagtcaagatcctcattttattagtgtctagtgagctttggcatcatagctagacaactatcaaaataggtaagcaacaccttgctaatcacatcatatgtgactcttgtgctgttggggtgacatctccatgtccaacccaacctatgccccaaggtccaaaactgttttaataaccttgtcaagtaaaccaataatctccgcacatagatgtccgacatctatcctattttatcatgataaaaagtgacactttgctatgacaaacccatcacttatgatcacaaccgtattaggtgcaattactggaagagcataaatcacacttaatttttctgagggaatctatcctaccatgtcatatcaaatatacaacagcagtaaagtaagatagatataaaaaccccaagcgaaatctaaggggcaacgcacacggcggtacatagatctgagggaatctatcctaccatgtcacggggtacatagatctcatctacgattcgccatgtgaaaaccttaacggcgtaatcgaattatgccgaaaccgagtcaatctcactggctcattttttctcattggcgtacggttccagtggacatcggactatccgatgaacacaatcgcgctcagccttggtgagtactagacattccagtgaagtcaccaacccatgcgactatcggttcatctcatcaacccatgcggctatcggttcatctcatgttccgatcacctaagaactcatatacaacataatagatctcatctactacacccgcatatcaactatatgcaatgatctagatcataaactatacaaggcggctctgataccactgttgggataagcgtaagctacgatagcataaatcaaacatttctatcgcataaaccaggaaccaagcaagtattagatcatatatcgttaccactcgacgcgctgcgcagcggaagaagacactgagaagtcgaagaaactctcgcgaagtagcacgcgtcgttgtagaggaagtagtcgatcgcaccggctcgaccttctcctcctcgtgcgttctccttgccgtactcctacgctgatcagcaccgcaaaccagcggcgcctctaccggtatccacacatacagggacgaaacgccacgcgcagatgtgctagcacccgcgcgcggctagggttttgctcggggagggaagtgacggctagggtttctcacgtgatgcaatgcctccaccggtcacacccctcacgaatatataggatccatcactcgggcctccaaggcccgtaagactcctatttggatccctatacgaagtatgctcatattggatctccatccaatccccttagtccggcccattaagcgtgcgaccctgtaggttcatgtatactcggctgcaacccgaaaactccttttcggtccatgcgtcaacagcggctcctagtagaacgaattgacccaccgtgcatacataaagatcatatcggctgaacctctagtgtatacttgtatgaacccctttgcctcacgatatcgattaagctcaaggctagatatatgccatcctctaatagctcaatcattcactcgaacctgttgatagattatgtaacttgtgattgactcctccacctttgccatggccatgcacttccataatctacaacatcgaggggcccagacatatctctccataggagggtcaaatcccatcttgattattcatatcccactacatgtttcatagcatatccgaaaactacttttatagctacccatttacggagtagcgtttagcagtccctaagtaagctactacacatgttgagaaccatgataatctcaggtctaaggattcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttcttgaagtttcccggcaagttggaaccagtcatgcacgaccctgttttcacaacaaaagtgaaaacaaccaaggttatacagaggtaaatataaagtattagttcagttaatctctgttatgaatcttccccttcaacggcgctagaaatgcttgttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatttatatattacttgtgataatcatattctaagcaggggttagaataatccaagggtagagtgacacacaagcattagctacttattctcataatatattatctaagctaagtggaaagaaaagagaaagataatctattcctatacttctaatatatatagtatacatacattcttgttatctgatatactagctagtaccctctatccgatgctctcctggtactctgagaagccacccctgactgtcgagttccttacgacagcccattatgaccatacaaccggggctaaataaggaggaataccctccccagtgaattaacataggattatatacacacgcggaggaatacccgtactgagctattgccatcagcggcccacctctcatccgcagcatataaccccaaataatgatatcctgtaatctagacaccacgtctaaactaccagatactactctaatatcatcgtcatgacatagagtaattgcatacacaaacattatacctgcaccaaagcatctcccagataagctagcagtatattcagtataacatgaacataatataaagtaggcattcatatactcggaaagtatttcaataccataaatgtataaagaagagtattctaataaaagtacaaagcttacaaaagaggaaaggaaagctactagagtcatacccgaactcttccgaaggcttccggactcctgatttctactctattcttattccactagctagatactactaaactaaacttgagagaatatgagagagctattgcttgaggtgtgtgagtgaagtgagaagagcaactccttttatagcctcccaatgacgattgtgatggttggaatggtcagaaataccctccaaccgtcattgggggataatccacaccgtccaggcgaagccctggatcagatggcgctgatgagggttcggcctaaccccctggttcggccaaatctagggccggcccaatccagcccaatttcggctagcggcctcctccgttgttcttctatgcaaacttgtgaattttggcccagtttgtcgtgtcaattctaagttcttggcccattcatacataagtctgattctcaacatcgcccgattgatttatcatctatgttgatgtcgattctcctccactttatttttattctctgcaaaaggttagtgaacctaatactagtggaatattattattctaacatgtatatgcattgcaagcatcactagttctcctctattttggctatattgatggtcgaaacttatcgataacgaccgtcaacaggcttgaaagagaatacgtcccacatggtagagctgaaagaacccttgtggctgcgattggaatggatatcccttgaagaatttatcacgataacactattccatatgattatgcgaaagtgcagttgcaagtggtgaacaaagggttagagtcatacgatctggacatccaaactcctgatggcatatccgtacttggggatgcggttgacattatagtattgtagcacataaagatatactctttgggactggcaacaatgctctgtcgaaaccactgagacctcctcaaaaacaactatcgaatgataaggtggaagaacatgagcaacctaagagcactgaagtggcatctacatcagcaatattgtcaattatgccagcaatagaaccgaaatcgaagtcgcaacaggtttggaatgggtcgaaatagaaccagatgtgtatgaggatccatctcctgcaaaagacaacgtggacgcaccctcggtcgatgactatgtcatcgacaagtccgaagtgcctaaactggtcaaaagccacaactccaagtccaaggataatcagaaggtgaagtggatggtaaccgccttctgaggtggtaaaaaacgtgccaaggaaagagatgttgatgagaagaagaccggtgaacttgccggcccaaaatactttggaacagatgattgtctggcagtgtttgaaaatggcaaagccttttggctggattatgcacttgaagaaggtccgtgggagatgagaagattacataaatggtacacggacgccaacaagaaaggcctaatgtcattagctgtttgaacatcacctgatgctttcatggccgaggaaggtttcttgtggctcaatttcgctgatcttcacgccgtctgtcggtgacatgggatcaggagtatcatgact

SEQ ID NO: 24741 - DNA, 3792 bp, Oryza sativa
  unsure (1)..(3792): unsure at all n locations
ccctaaccacatttattgcggtttggctgagcgcgtcatgccgcatgtaacgcagtgcagtgcactcgtttatccggtctgtgaccagtcacagactggtcagatcgcgggtttggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtggggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctcaccctgagtccccggccgaactggcaaaggggggcctgtgcggtctcccagtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctatgcgggagaaggcgctcgagagggccgaaggatccgcgacttcgacacccacaggaggtggagaagggcggcgagatggggagcgtcncctcctcgtctacggcgatggcagcacgccccagggcgcgctccaagctgcgggcgcgctcctacgtcacccgcccgtcgcccatgacccggagtctccagcccaacgttggctggacgatgtggccaaattgatcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccggaaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgcccccggttgttggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacacggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgacggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgcaaccgtcgatgggggagcgtgtgctcacgtttctcgccggagcttcaaggccatgaagcgagagcttctggccgcggcccctactcatgaggcgacgtgtcgggcgcgggtggtcgaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacattgacctaccggtcaccttcggtggatccgccaacttccgcacggagcgggtgaacttcgatgtggcggacctcagtctgccctacaacgcggtcctggggaagcccgcgttggttaagttcatgcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggggttgattgagcaccgtctcgccgtgcggccgggcgcaaggccggtccggcagaaagtgcggcggcaggccccggaacgtcaagccttcatccgcgaggaggtggcacgacttctggaggccggattcatccgtgaggtcatccatccagagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatgg

SEQ ID NO: 24742 - DNA, 1387 bp, Oryza sativa
ttatatatctggttctgcggttggaggactattttgtatctcaatgacaagttgagggaccatcggtgtactttttcctacaaattacaatcgtctagatgcaggcccaagtataatgatgtgcagagagagcactaagttcctcggaccttgaggtttctgcaagctgcagcccagcctcgccctggcctagcgatgttagcacggcccaagtggtgcccttggctgcagcagatcggagcaaacatatacagaaacttaaggaaagagctgcatagcttagaaaatagaatggacattagcgggaagaatcgaacccatgttttgtttagtatatacttcctccgttcctccgtttcacaatgtaagtcattctagcattttccacatttatattaatgttaatgaatctagatagatatatatgttgtctagattcattaacatcaatataaatatgagaaatgctagaatgacttacattgtaaaacggagagagtacgagttacatatactacttataatactagttataatgtactttacatttgactcaaatttttaaaagttgtatagatacaccctaaatatttggtgatttatttgcccgaaagtgaatatcatctccttccatgcatgcatctactttcatggatgcaatgttctgtctaacgtaaaatctaaagcgagaggcctctcgtttcagttgtatcgcgcgacgcgcctacctgagtgaggatatatgatatatatgatatggtttaattactgatgattgggtaaagaatattaaggatcttcatataacatggtctgttagtagaaactcatttactagtatgatctttattttagataacattaataaatcaccatataggaacttctttcggtactgttatatgatccctgtctagaaactctatatatgacatgaacaacaagaaaacgctgtttagataattaatcatatggtaaatttagccagaaatgcattggttaagtgcagcaagaaaatggtgttgggactgcgcaaaaaacacttttagtgtgcaaactacaattcaccaaccggcaaacatatttcacacaatcaacccttcatcttggcatgaactttgaggatagtttcaactggcaaatcagtagcggaataacaataaacacatgcacacaagacacagtgatttacgtggaaaaacctcctcggtgtgaggagtaaaaaaccacgggaccaacggtccactccaagcttccactataatcaacaataggtacaaatgtagtcttctctataatatctaaagacacatcacaacagctacaacatcaagttacatggcattatcaacatctcaaccatcaaagctaacaagaggtatatcaa

SEQ ID NO: 24743 - DNA, 3865 bp, Oryza sativa
tactcaactaatcctcatccaaactgaccagattgaagtgctcaaagtgagaaacaaactcaccaagtttggtgccaatccaaccacgtttgagcctccaatcgttgacttgatgaagatcgggtaagagcccccaagctgaacaagttgcacttcttctccactctcctctccctctctcttgtgtttgctggttgtttcttcacctcaaagactgctgctcgctctccctccaatggaggctagggtttttcttcccattcctaaaggatgaggtaatctcaaccgttgatcaacacttggatcaatggctcacatttgttggactttttgggctgcaaatgggctgagaacaaaaggtccatgtggagggaatttagccaacaaatggtatggtaccataaattttatagattatgattacatgaataactgattccattaattcagtaaatggatagagctggattggacagggagggaggatggctgaaaatgaatcggaaacgaatggaaactagctctaccatatccgttttcatatttttacggaatcaaaattaaaatcaaaaaccacggatataaaagtggaatcgaatataggtacaaaacgaatacgaaacggaacaaatgaataacaaatatttgatacaaataaaacccctcaaattaagcttccccatcaacgaggagatacacactggcactgccaagttctagtaacgatgcggcttcgatacgtaatgagacctgtgtccagccatagtattttccgcatcgtcgctactaaaaacgatttttctttcatgcggttgaaaaggggtttttacgtgcggatctcctatccgtccgcatcgaagggtctgcaaaattccggtgctagtcaattaagaacaagaaaactgatcaaaacgagccttaccgtccagataatgtacacatgcatgtatatagtactcgatccgtgtcgtcaatcatatcctatatgaatgctgctaatcatgcattattagttattgcgaaaaatccacgagataatatctggatgacctacgcaaattaactaacaaactgactcctgtcgtgatcgtgatcgatcgaggggatgatcagtaggccagccacaaactggtcgatattccggccggatcatcaaagatccgatcttacctcgaatgcttgatgatgcatggtcggtttaattattagcttgatgctgaaatgcacagtactgtagaaaaacactttggtaccgattgaaaaacctacatataggtaccggatttcacagtcaacaccaactcaatgacactgatgactctagattattaatgtcaattttacaaccggcaccattgacacgcacaagaggcaaaaaaaaaagaagaagaagaagaaggcttaatgcattggctcgatataattcgaaccaatgcgttgagttgctctccacagccccaaattacaattgaacaaaaacaaactcctgctcatgctataacttatgtacaggctgaatcacaaattcaataaaaaaaatgaactgctatcacaactaaatcacaaatccaaaaagatgaacttctcgctattgaagagttggggcggcaatgacgaggaaagaaaaaaggaacacaacgaggtatccgaatctgacgatcgtcgagcttgagacggcgccgtcacatcaccctagccctagggaggagggggggagggggggcgtgcctacttgctgtacacggcgaggtacccagatcttaacgatggccctacaacagcaccctcgccgatggtagcatatgcttctccttccccttctcctcttcctcccacccctcaccttccacttcccgcacggtgagcgacgcaaacgccgtggcactgtgcccacgatccgcataggggctgtcaggagtcatggcggacacgcacaccacaatgtccactcgcaagtttaggtttgagtcatgagagaaagagcatgcgtgaagggaggagaaggtgagatcgacatggctcaacagttcactgctggagaaagggactttagtcccggtttgcaaccgtttttagtgcaactaggaagcacaatccgcccatctttagtcccggttgaaataactgagactaaagatacataccaaggcaaaaaaaaaaaaaaggtgtgcaaccaggacgcacaagtcgcccatctttagtcccggttaaaataatcgggactaaagatgcataccacataaaaaaaatgtgtaggatgtgggattcaaactcaatactctcactttagccctcacgcgcattaccatcccacctaatacacacatctaacttgaatagagatgctttatttttaaactaaccctaaagatatctttagtccagattggtgtcaccaaccgggactaaaaattggtgttaccaactgggactaaaaagttagtataaccaattggtaacaccaagctggactaaagatctttggaggcctgacatggcctgacagctattgaatcatggctaaaaatgatctttagtcctagtttttattcgaaccgggacaaatatgatttttgccatctgagtaaagatcagttctccagtagtggtttgtggtgccggtttattaataaaaaaaaagacacttctaaagttatgatgatatgcatgtgtctgcttttccaaagaaaaacggcacatataatatgtaatattataggtgccggtttttattaagcacaacgtttatatttcttccaaaacaacattccgcgagcgtgctgctctctggtggaaaagccaattccagaatttccagcacctatagtatcattattttttttcgtttgtgtaagtagtggcgcatgcgcagaccgtctactcaccattgattttcttttcccctcaccgcgtggcctccgcgtctgttggaatcattccatgtcaatgtctcatggtacgtacggtacgaataattaatcgtactatacgtggctaatgttaattgcgtgagctcgtgcgcaagcatgctagctctacaacaacgactgtgttgaccgattagggactcgatcatgcatgtctgactctggtcgactttgtttttcttaaaaatgtagtgtatataattacggctcgattattccggtgtcatgagggcatgccgcactttggttctaggcgactccatataaatatataatcctccgccttaattaattaatgtccacaaattaaaagagaggaaaaaaaggtctgggatgatatggtccaagcaatgtacaaaaggtactcgatccctccaaaatatcaactatttctctcaagtttttcatgggaattaagaagagagataaaaacattatatcgccatttattaattgttcctattgaagagaagagggtgaggacagcagagataaggggtgttttaaatatttcactagggatcgtaacgatatcgttcttgtagaactaatatagtaataattttatcaacggttaccgttttaaaatatttgtattccaagtttctattagttagtgtcttattaaagttgttactaaatagttaaaaattccccaactattttcattcgtttccataaaaataataaaaaaatgatactgtttcagatctttttccttcctactacaaacactgtttgttactctagaagccgctatagcctatcagctcatgcctccccgagctctgaaacgacgtcccttgagagaagggagactggctagctagcttgcctgtctgtcttgccacatgctttgcttgctgcatagatgaattcagggtatgatcgataccgatagatctctggaagcctatcatgcatgccatgcaccagca

SEQ ID NO: 24744 - DNA, 5259 bp, Oryza sativa
  unsure (1)..(5259): unsure at all n locations
agcgagctccttgtacgtggatgagctgcggcggcgggcggcgttcagggaggacaggtacggcgccgtgagaaaggtgtatgtggtggtcgagaatgacatggccatcgtccaggagcaccagcggtggatggtcgccaacgccgaggtggcggaggtgagggtgatggacgccggcgaccacatggccatgctctccgcgccggaggagctggctgggcacctcgccgacgtcgccaacacatacatctaaaattaatgcgattgatggagaattagttaatttgttttcttttggatgacattatggtgaaacttgatttgggtataggattagtactaagtagggttaattggatccagccattataaatttgtctatttgaaaatatgacattacaaacacatattgtaaatatttacaatatttttaatatgtacaatagtttttttaaaaaaaataaatccattttcaatatttacaatagctaatatttaattgagagtaaactgtactttggacccctttttattaactaagttacatattgcactaggtaatatcatttcttttcatttacactatgttttagtattacccaaacttgcatattggactggtgactcacatgtaagtgagcaagattttcttcctcctcctcggtattccctgagcccgtgtggtgcatgtcactcaccagccttgttaatccccacggcagtcccctcttctcaccatgccgaagaaagatccatcctcttcttccccactccaccaaacgatgatgaggttgagcgcgctggatttgggatgaagtggtgaaggtggatgagcctgtgcagcacagtggttgagttcgcagatgaattggagctcgatctttagacgtggaaagtgctggagctcgagctcagggcaggatgtcctcttgttcttacccggcagcaagcaagcaagcagagcatggtgacctcttcacctctttctcattttttgctatcggcgaggagccagcttgagcttgtttggccctgttcatggcggcaactacaagctcagatttgcatgcctaaaggaaaggagtacagagatgacaagaacgggtataaggtgaaacgtttagcaaaaatctgattcagagtgaaaagggtaagttaatcctagtccaaattacaacatgataaaaagagacggttcaatataaaatttacactttaattaataactaaaaaagtagcccgcgcattgcatgtgtcataggttgcatctgcaatgtgtcataggttgcatctgcaaagtgtgatttctccgtaaattttctttgtcagaattgcctaggtaattttgttaacttttatactatgcaatatttaatacatccctataaataattttctataatattcttatcatctaaaaagaaaaagaaaggtagacttagttttttaggaaacaaatttaacacttaaaagtaagattttttttctttttttactttagtgtttacggcctctcaaatgcattctatttttaccatcaggctagccctccttttatttggttcacattgatgtgatttgttaaatacttagatatgaacaataaagacagggaaaaaatatatatcatagaactcacttccctatgatattggtgacctatggtgtttcttttttaaaaaaaacctagtcaacattagttttaaaacttaaatataaaaaaaaatacctagtcaacttaaatataatttttaaatcaattatgtactactaccttagtgtggcttatatatgcaataatatgtgaaaaaattcatgatgcatggcatatgatacagagaaggccattaatatataactacttaaaaataatgcaatggttatggcaaatgggtgtttcaatgtagatgagaattaagagccaaaaaactataaaattttctccaattggttcaatttagtccctattgacatttttttttctattttttgtttattttatactaatcttattttaagtcaactttgaaaaataatcaccaagttaagactgatataggttcctattgttaattaacagatggattgtgtgggatatgaggctacactaaatgtatgcatttgtagagtccaatgcgattggggaagtgtgggagacgatctattggaaatgtttaatgtggagtgtgcgaggctcaatgcatcctagctagtattaacatgatcagacgaataaatatagctgcacaaacatcactatttttgcaatgtgatgtattatgattgcttccataattttaatatttttctataaaatttatattttaatgctagaaatcatgtaactatgtatttctttttaatccagcctacacttggcatgaattaagtacatttatattatataatctttatgtgaagcctacaatgccaatccagttgcgataattatgttgcattccataaatttgtagaaagaccctagaattttttctaaataatttaagtgaaaccgatgatcatattttttttctcctcggatttctaatatgtttcctaacttttaagaaggggcaatgtgggtgcttatggttttccaaaaggtagatttagtggttgggaataataaaattgcaagacttatatatatggtctttagcatcacttatatggttagaattggaagactgatccatacttggagttgaaagtccttccacacatgctgagcaattggtctctcaaattactaatctctaattgcctgcacaaaccaatgatcaaatgttttacttttttaatttgaatttctaagttttttttctagttttaaaacaatgacacatggagacttaagagcattatagaggatgtttaatggttctttattacgtagaataatttaagatgacataaaacttatcatcattattttcaatgctttattgttatttggttgaggtgcaaaagataggggctatgttcaagattttcaataatttatataactatataaaaattaaaattagaatgttatttggtttccatgcaaaagaataggggtatatgttgaaacgacttatttgattttttttatatgagtaatataaatctcgagttatttagctatccatttgtaaaacagttcaaacaaattaaaaagcaaatataactataatttagctatgtaactattagattattttattattatgtcattagttcaaaattaggaggggtgaattaaatgggaggaggagaggaggggagagtggtgcggaaggagaaacatataaatgtaaagcagcagggggaggggaggatagtttgttttctttacatagatccaattggtcatccatttgagttgtctatttttaaaaatagatcttggttgtttttgccataggttcggatacaagatttattaaaaccgtgtatttctagtttcacaaatccatttatttatatccgcgattacattgatagcattcgaataaatcattttgttcctattttagatgaaacttaaattttttaaacaactataatttaacatgtaaatttcaaatctacaatggatcaaagatatagagctatgccaaacagatcctaatggttaaaataacatgcccaccattttaggaataaacgttaggtgttttttttctcatgatttctaagattttttatattaagttgttagttagaaaatagaatagcgaattaaatgggagaggagaagagtgaattaaataaatctgatgtggtgtttcaatttttaagtttcctgttttgattctgacattaatttatccatgtagtattatgtggatcatgcacaatctttaattttaattttgttggtttaataatctactccccccatctcgtataatcagactaatttaatgttgtagatgttgctatattttttttataaatttggttaaactttttaggtaacgaaacaaaatcaaagggtcgtacactatgaaatatgaaacggagggaggaataatctctcgagcatgcagtccttgattgttttggtgcattaatttgtggatcaagtgcagtcttgaattatctctcgatcatgcagttcttgattgggttaaaaattggagtccttttttttaaaaaaattagatctaatgtaaatcaacagttagatatttttcttttttatcagaattttaggatttattaaaacgccacgtggtggtttaggagcgtttatagtaagacacgtgtcgtttcaggagtgtttgtaaacaatttaataaatttttagtatataatagatagatagatttgttcttttttttaagccaccaaccggcgcagccaaatactatcctgctagttttatcagatatttttaagatgagcatgggttttaagaaggttgatggaaatgattgaagaaatattgcgatttatcgagaagagaaagtatatgagaaaattaaatggataatagtcgtgactaattgaaaaaattaaaggatatatatgaaaaaatagctccattttaagatatgatagctgctagaaatagataaatattttataactataagtaaacgtcccctaccaatagccacattatttgactggactataaatttttatatattttttttgtcgaatcttggaaaatgagtcacgctcatcatagggacaggatcctctacagttaaagtcatgtaactttgtcactgtcacgtgggtctaatgatccctagctcacatgttagtaacaaagaaaaagaaacttatccttgtcacagactcgcaacagcaggcagtgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcgtcccggcagcggcggaggcgagcagccgcatcatcctggtgcacggcacgggccacggcgggtggtgctggtacagggtcgccacgctgctgcgcgccgcgggccaccgcgtncacgcgcccgacctcgccgcgtcgggcgccgacgcgcgccggctgcgcgacgacgacgcgcccacgttcgacgactactcgcgcccgctgctcgacgccgtccgcgcgctcccgga

SEQ ID NO: 24745 - DNA, 10972 bp, Oryza sativa
  unsure (1)..(10972): unsure at all n locations
actgcgcgacggacgaggagcacgcaccgccgtcggtgctgttcgggccggagttcatgcggcggaagctgtaccagctgagcccggaggaggacatcacgctgtcgcggagcctggtgcgggtgagctcctactacgtggacgacatgcgccgccagccgccgttcggcgaggaccggtacggcgcggtgcgcaaggtgtacgtggtctgcgggaaggaccaggccatcgtggaggcctaccagcggcggatgatcgccggctgccccgtagaggaggtgagggagatcgccggcgccgaccacatggccatgttctccgcgccggtggagctcgccgggcacctcgccgacgtcgccaacacctacacttgattttgattgtactagctgacaacacgtcgccagcataacataccaaggccgtgtttagttagatacccaatttttttttgacgtatacggacacacattttaagtattaaacatagactaataacaaaacaaattataaattccgtctatcaactgtgagacgaatttattaagcctaattaatccatcattagcaaatatttactgtatcaccatattgtcaaatcatagcgtaattaggctcaaaagattcgtctcacaatttacatgcaaactgtgcaattgttttttccgtccacatttaatgctccatgcatgtgtccaaataattgatgtgacggaatttttggatgtttgaagaaaaaagttgaatctaaacacagcccaaatcgggaagagtagacttcacgctctcacaacagttctagttggttgcccgtattcccctagcctagctcatctctctcatctaggttaagtttgacctggctaggaagatacatatacagctattggttgttgcattggtctagccacgctagcatgaggttttgtttggttacctatacgatagatacaattgagaagagattttgtttggttggttgcatggatgtaagtgtggttaccttctcatatagttaggtgaggttacctctacaatatatataaaataattgagcattttggattaacccatttttcacgtagaatcggtggtaagaaaagaaaaaagatatttttcttaagttattctctccttttcaataccaagcaccaagactgcgtcgtggtaccaatccattgctgaggaactaagcggaagcaacgactgagaccaaccttgctgcgaagaaaagggcgccgccgaggaagatgtcgccagcgtcgctgtgaaggaagatgtcgccggcgccgttgctgatgaagaggccgccgcagctgccgctgctgccgaggaagaggccgccgtaacttctgccaaggaagagctcgtcgctgaagatggcgctgttgcggaggaatgatgtcatgacgaggaggaggagcgcgcaaacatttttgctgtgagtgagcgagagtgagttgatcgcgattggaaatagaaattcactccccagaagtgaggtacgatatatctatatttgggaacctaatctattgaaagataggatagggattctcttggagacgatttttgacaaaaaattcctaaatttgatgataaggaataaaataagtaagatgttggtgatgctcttaattccccctccaatccaccaaaattcccatgtctacaaaccaaacaaagcagctaacaatctcatccctttacacttccaatcccttctaaggctgcgttcgttagcctacgttcctagcctgcacagtgctcatggaaaacagagcagtccattagcgtgtgattaattaagtatttgctaatattctttttcaaaaatggatcaacatgattttttaaagcaactttcgtatataaactttttgcaaaaaaacacaccatttaacagtttaaaaagcgtgcacgcggaaaacgaatatgggttgggaactaggagcattgaacacagccctgttcctggtttctatccggaaccgttcgcacggaaaacagagcggtccattagtgcgtgatgaattaagtaatagttaattttttaaaaaaaatggattaatttttttcaagcaaattttcgaatgaaaacttttgcgtgatgaattaagtaatagttatttttttttaaaaaaaaatagattatttttttcaagcaaatttttgaatgaaaacttttttataaaaaaaacaccgtttagccgtttgaaaagcgtgcacagccaaactccccagaccaaacgggtcctctacagctactgtgccaaagaggagaaagaaaaaaaataaaaacacagtatttattcgatccttctcctggaaggctcccaagtttgtgggaaaaaaattctgtgcagaccggctgcaaaccccgcaccgtgcatacccgatccagattggtgacgcgtggacgagagactgatccaacggcgtgtctgcatggctccatccgcaccaggagaaggcccagcttggctcgctcgcgtcggctcccgctcaagcgatcagccggcttcgcttcgaggcggcaccgcggcagggatgccgtacgcggactcggctctagcaaaagcgaaatctttttccggcttcgtcgtcttccttcgccagattggatcgccgccatgcgcaccgcagccgccaggattccggtactttcttcacccgccttagtgaacgacacatggccagacagccgtttgtctcacctgtgcatgcggacgacgtagtcgccggggattgtagagccgatgagaagcagaaaacatatgtatgctcgccttgttatttgatagtcatatttcttcatactggttgatctgtgaccatatatatgttatagattacacagaacttcgaggggatgaccatgatcatgcatgatgaagttgcacaacaggtcaatgataaagctgaacaagctttgatcgttctgttagatagatctctctccccttgagcccaacggctcaagggggccttgaccgcgccctgatcgggggcgcccagcccaatggctggtgggcccccgtcacactgcgccatataaaaggggggtggaggccggcacggcacatggtacgagatttaccgncggcgncaacttcaccccacaaaaccctaatccgatcgagagggggcgcagccagtgacgggaaacgccaccgccgcattcacgttaaggcgcgacgacaacgacgatgtccggcgcctctttcttcacgatcttctcaacccggtcggtatctaaaccctcttcctttattctacaatggcggtcatcaaacccaaatagaaccacccgactagatctaacctaggtgatcctagtgcaaagtttaacaatgggatcagagcaaccttagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctggctcagcaacaacagttcgttgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctctcgaatggcttcatacttttacttcgagatgtcttttatgttccttctttgcaaaggaacttaataagtgtatcaaagttggattttgatggatatgattgccgctttggaaatggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtagcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaataaaatgaaaacaaagccatatgcgtcagctgtaggaagcttacagtacgcgcaagtgtgcacacgacctgacttggcatttgttaccgggttacttggcagatttcagagtaatccaggcctagagcactggaaattggtaaagaaagtgttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctcaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaaggggggtggaggccnccacnnnacatggtacgagatntaacgccgccgtcaactacaccccacaaaatcctaatccgatcgagagggggcgcacccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacacgttcctcaagttggaatggatttcgattttattccatttactatgttacttaactatactattttactatgttacagtactatgttttacttccatttgcagtgtgttacacttatgatcagctatatgttgtttgagaacgactggtctctggacatcatatttcagatttgacattcaagatttcagattacacaattttccggttttcatttttaaaggaaccagacagacaaaccacaatcttgtttacacattgatccatcacattctagattttggaatacccagtcgtaagcctttgnnnnnnnnnnnnnnnnnnnnccagctaaatgagcagcagatgctttgcataataatttttgtcagaatgcagtaaaccatctgaatatccctaatttagcactgctgctatggaagcctgtgactcagtttgtgatattctcaccaacagcctactcagtgtgagagataaatcgcatcacttttagcaaaggctaatgaactaatctggttaaactatagaaaaaccaaccagcaccctagctagcattttgacgaaagacagaaagacacgggcaaatgatcagacgtagcaactacaaaattacaaaatacatgtcacttccaggatttttcttcattgcttgaatggtgctccacttgcattgactttcggcggcgcgttgcagatcctggttcttccactgccttttggcttttgctcgccctcgccaacccagccgctgcggcctccaccaaaggcgtccgatgcccgtggtcaggagggacgaggaggggaacacggctcgtgctcgccttagccaacccagccatcgccgccgccgtcaccgatggcgctcgtggccagggcccaggtgggaggccgtgacggcggtagcaggcgagagaagtggccgcatcagttgttgaacggaggggattgtgggctaagccgatggcgccaaggaaaggcaatcccgacagatggaggcaagatggggaaggagatcgcggcggcggtggaaagggaagtggggatcgccgcagcagaaagaaaatgacgcgagtgagccgcggagccagtccatgcgcttctagttctggttgtgggagtcgacgcgagcaagccgagctgggccttctcctggtgcagatggagccgtgtgggcacgctgtcggatcactcgctcgtccacgcgtcgccaatctgaatcgggtgtgcacggtgcggggtttgcagccggtctgcacagaatttttttccaagtttgtgtcctttcttcttccaacggttgctctcctctcttccgagttccgactttcgaaatttccaaaaccctcgatcatctccacccagcgtctcagccatcgatcgatcatggagtgggaggatgatggggagnaggcggcgggctccggcggccagctcggcggcgcaccgctgtacgcggtgggggacgaggtcgaggtgcgcatggacgaccccggcttccacggcgccttctacgaggccaccgtctccgcgcgcctcccgtgctccggccgctacgaggtcatgtactccacgctcgtcgaggggggaggaggccgcggccgccgcggaggtggcccgctccgggagacagtcgccgcgtgcgacgtgcggccgaggccgccgccgccgccgccgccgccgctggcggaggacggggcggcgcctgggcgcgagctcaacgtgttcgacatgggggaggcgtaccaca

SEQ ID NO: 24746 - DNA, 5163 bp, Oryza sativa
aacttcgttttttttttttacctgtaggtgagtggtgacttgaactgatgacctcaacgacaacaatcaatgaattcatgtgctgttctaacactaggcgagactaggtgctttgtattgtagatatgagtgtcccctctagtttgctactagttcagaatctgagatatcaagataagaccaagtgatgacaaatgccatacttgtttgacctaattatcgtgtgctgagtttctatttacatgtgggggattttattgaattcaacaaagcagtaagtcattcttcgtccactggttagtatatgtatgctaagctattggttgcatccttgactacacattatgatggattggagaatgcaaattagtgttaatgagttccagtgagaaggcaaatacaaaagaattgtgcttccaaaacagtagcagttgaaaaattggttgtacaaacaaaaagaattgccatctagaatttaaaacaatgtcaaacaagcaagaactcctgctaaattttatgctaactgaatgaattttatcgtattctgaattgtcaaaagaataaaatggaagactaaatgtgtactccctccggttccatattaattgacgttttagacaaggttgatgtcaaacttttataactttgaccatcaataactttaaaaatatttagtttaaaggaactagaataacatatatagatttgtctttcaaagcactataataaaagtaaacatgcatttatttattatatatattataatagaaaaataaggtcaaaaatatattttgtagaccgtgtcgttgtccaaaacgtcaattaaaatgaaactggagggagtaggcaaaaggaactccgttttttcctgcatgaacacgaggcaaaacaaactccatgaaacctgatatccttggtgtaagcttcactgagagagaatgagacacggcaacacaatatttactttgtataactaatgtttgtgcttttgttattttgagtgcaggttccaagggtgccgcagtatgacgaagggagcaatgtggaagtcatgttggatacaggaaagcaccgtgcagcctgggtaactgctactgtcattaagatggttagcagtaaaaactatgttgttaggcttaaaaataaggaaggctcagttaacatcgtagattactgctatattcgaccacaacctacctttgacagaaagaagtttgagtatgaactggagccctctgcagaggttgaagtgaatctgggtggtgcctggtcgctaggcgtcatctcagatgttggaaagctgtggatatggggtaaggctaaaaggacatgatagctcagaggaagaggactacatgcttgtgttgcgtgctttactcagaccctactgcaaacaggatgatcaggaattgatgccttgtacagcaaaggtatttctccaactagtcatgttgttacttgtgatttgggtattttctcctcttctttcttggtactaccagtctactgcagtgttcatttttctgctgtgaataaaagtttacaatgttttcttgccgtgcttgtatgccttcttggaatatgtggtgtttgtcattttaatgtcagtatgccagcttagttgtccctgtgctctggacaagcaggtaacaaagttgaacaagctagagaacaagaacataaaagggaaggcgcgcatgctagtttcaaggaaactgcctaacctaggctgcacacggagtggtggtaaacaaagacacagcatgaaaaaggttgtcctgactccgttcttcttaaattgcaaacttaaattgtgtcttaaattgcaaatttccgcgcattcatacagaaaagcccgcttggcgctttcacaggtcatagtgcttttatcaatatatattttgaccatcaaatattgtgcttcagcatcttatgctaatgacatcatgtttttggtatacgctttcttcctccaagcaatgacattatcttatgctaatgacatcatcttatgctaatgatttagttctctcctaaactgtgttgtcatttggataattgttgttcaggaatttgcttgtacaagtttggatcttccatgtatctctgcacctaaagatgctgttgaaatcaagggcaaatctagttatgtcgatgtagtcgaaatcagtgacaactctggctatgatgttattcatatcagcgatgattcgagctgtaaccctagaagaaagagaaggcgacagaatctcctagaggaataactccattcccggcatacttcctatccgattcaagaatcacaatccaggctgaatatgtcaccagcacgaagtcctttgaactgtgacccgttgctagatgtaatgaggcatcctaaagtagagtcgtgcaaccatgtgttatcacaatcttgtcgccattggaaacaccacaggctcatttcaacaacaatgctgggcagctaattcctctgccaagttatccggtattagagaagttgccagttaaagtgcttcctgaaatgaatgaaatgaaagaaacaaatcatgctcatttacaagctgagttcttggcacctgatgattgtacagccggagaccaaaactatgctctgcctataaaagttgaggtacatacgtctgttatctttatttgagatgaaaattaatcccttcttgattgtctatctgttgctaactcacctcaacttaggtggagagctgggtcgctgatatccgcaagaaagaagcaggtaccggtctgactacctcaaacaactgtgagtacttgttataacgactttgtgttacattcaattgtaaaacctgtcttaactagaacgaaaatatcaccagcaatgcagacaattactgatagtggtgaagacaattcaagaaggccacgatcaggagattctgagataccaaattccagtaaattagaaccatattcatctgagcaacaaaggtttgaggccgatctgccatgcatgccagtgcctaacaatgttactattaatactcttcctcttgttaccagacatacgtttcaatttgtttctcggaacaaactggaagtgccagtgagacataagaaggcccctgatgctgtaagaccatctacgttttcccccctgttttatcttctgtttaaatgtatgtgtatttcccatccatgcttgatcatcttgatgctatttgtacagctggagatgaataccaattcggttgtcttctctcccaaggagcaaacacactgtaatttggagatctttagtccaaactgtaagtcttgccacaactttaagatagtaatttttgatgcattgatacttaatactggtctggctgatctgaatattatttttctgcagccaagaagatcattgatgcgtcacactatgaaagttatgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttggcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggatattcccaatctcaacaatgagaactgaaaagcgatcttattaacttaatctcagacgttcttagtttcagcagtatgataacctggagtgaacactgaactgaccttggttcttacatcagggctgcacgcgcactgaatctagaaaagcctctggagtagtactaattaattaactaacgatatatagccaatgactactggtgcaaaccttatacattataggagtgtgtaattaattaactgtgtgtg

SEQ ID NO: 24747 - DNA, 2115 bp, Oryza sativa
cgagacagggcataatgggtgggtgaaatgcacggcgttgagattgattaaagctaaaatctaatcagcgagacggatcgatctgcagccagtgataatcgccggcagcaggccaggtggtccggtgccaggatgggactcgactacgcaactaaccaaaagattaaaagcgatttagagcaatctgatcttctcctgtgtgtgtcgggttacttgacctgccactgatgacggccaagtggatgatcaattgttgggctaaatcgagctgcagctaacactacgctgacaattgtcaattgggatgaactggtcatggaaggagatgtgtgtgcgtgtgttcgatcatggagaaattttgggtcgatgccagtagcgattttgatggtggtgctgggtcagctcaattattgcattgtgctgatgggtatatttgtaacgttgacatgccacggttattcgattaacatggccccagtgttgtttgtccagggtatcttctcccccattctcttccgatttcactatccgcgcttggttggctaccacactttgccatgtttatttcaccacacgaggagcgtgtgtttgcctttctcctagcgtttttagcttttttttctcttaatatatattaaccaaacggtgggaggacttatgatcggtcaacttccctcgtatatatgcgatctatctgcttatcaaaaatggaattaacttttcaatcatctaaaattgtacattgttaagcctagaattgtgccatatgatgtgcgattttatcattgtatataattttattttatttatctaagtttgaatacttttacatgtaattttgtaatcttttataaactacttcctccgttccacaatataagactttctagcattactcacattcatttagatgtatatgtttagattcattaacatctatgtatatgtgggcaatgctagaaaatcttacattgtgaaacggagggagtataaatttatgttcaggttagaataattttatctaagaaagaaagttcgtaaatagtctttcccaccctaaaagctagtcaataaggtaagagactcccccacttatatattaggtccattgaccttacacaaccaatgtgggactattcaatagaaatagcgtcacttaaaaaagtaataagaaaattgatgaaaaccattggattgtcattcaagaaatgagaaaagtgatagaaacttttgaaatcttctcaaccatttgaaatatagacactccctaagaaaattattgtcttttttactggttatcataacttctttgtgatccagtttgttcacccaattgattccgaaatccccccctcaacacaacaacaaacacaaacaggcaaggggaatattttgtatggtccatggaagcatggacacctacatcgatcatttggcagcctcaggtacatccaatgaaactcatgatctctctcccttgagcctcaactttctcacatggtatgcatctgagaagaaaacattttcagctgaaaaaagctgctgggaggagcaccatgcttcattagttatcccctttttcttctctctagctaccaacatatataatgctcagctgggtcacacacataacataattattaagtttagtgtctgaagataactgataacccttgccccactaactggtcggcacacacataccagatgatgctaaggataggagaatttaagctagaggaggagttagctgggccctgtggaataatcagaagagtcaaacatatgtcaactacactacacacaccaaatgtcaaatacaaacagcatacatgtatatacacatggacatgtgtctttcagaagtcacccttttttttttgttctgatccaagcccctgtaccaccacttggtgatttgctcttacactgatcatgacagggtggtgccatctatcacacatgcacctttttatttcaattccagctattgtgattagtctcccataacaagttacaaggctcatgaagcaactagccatgagcctatatgactactcctattggctggcaaattagatgtgtgttagtccatcaaatgtagctgaaaagttg

SEQ ID NO: 24748 - DNA, 2157 bp, Oryza sativa
atatttaggctgtgtttagatccacgggtgtaaagttttggcgtgtcacatcggaatacaagttttggcgtgttacataggagtacggacacacatttgaagtattaaacgtaaactaataacaaaacaaattacagaatccacgtgtaaactgggagacaaatttattaagcctaattaatccgtcattagcaaatgtttattgtagcaccacattgtcagatcatggagcaattaggcttaaaagattcgtctcgcaatttacatgcaatatgtgtaattagtattttttctttatatttaatactccatgcatgtgcctaaacattcgatgtgacagggtgaaaaattttgctaagggaactaaacattcgaaagcaataaatatttatttaggttgtgttctttagtgtgagttcctaactccactttcctcgttttccgtgcacgcttttcctaaactgctaaacgttgcattttttaaaaaaaagttttataggaaagttactttaaaaaatcatattaattcattttttaaatagctaatactcaattaatcatacgttaatccgatgcttcattattcgtacagaaggtaggagttcccaactactacaaaagaactcacccttagtactttaacaaagctaaatatttatttattatatatattaaaagaaaaattatagtcaaagatatgttttagatgtttccttatccaaagtggtaggaattatcaaatgggagggagtacctgtaagaactttaaatatagctcaacttcattacacacagtggtggtcctacaagttaacattgctagcatatttttttttcatattaattaatttatatcaactagagcacacacatattattccaaaaaaaagacgtttaaacttgagcttgatcatagaatgcaaacacattattatatgtcacattagaaggtaaacgtttgtatgccttacaaggtttgtaactttcacaaacaatcagtgtattatatttggtcaattaatttttggtaggatgtgtttgtatgtctgtatggcttgctatatggtgacataatttttcattccgtgtggtttagctaaatcgcgtgtccttcacgaggaaatgcagatgagttccgagtgcttgttggatgttggagctttttagcttttcaagaggcttattgctgttggtgcatgaggactcaacatgtggcaaggctagtgtggtcacacgtgttatgcctccggagaggtcagagaaccaatagatgaaaagaaatcaagataatatttattaggagaaaatttgacatacaccactcttataagaggtaaggccggtttacctaccactcaaaaatataatgctttaatgtcattcagaagacatgcaaatctaccatttcgctttaaactcttttttttttatttctagcatggtccaacacatatcttggagtggcatctagagtgaaatgtcagattatctcatatactagtaatatgtttgtgctttataacaggtcaaacccatatgattttgtgattggtttgatgagtggattgaggataaaacacgttctaggcctatataattcaggatgggttggatgcgtggattgaattgaaaatgctattatggctatgcacacataaaaaagcacgcaatgagaaagggacggaagtgttaacaaccaaatttggtaatatcggcattgggaaagaagattagattgaagcgaagtcggaggtggagatcgagttctgaaacagagcagggatcggctggagtccagatcggctacgataagatcggctgagtctgagtcggattaggtaagccgatgtagccgatcctagcaatacaacttgatatgtgatgttgggttggattgaggtgcttcaaagtgattgccgcaaatggatagagtcctgaggaggcaattgtatctattaattaggatggtttatgtaatttccttagagatatgattgggcaaaagtctgccgcaaagacttatattatcttatagtttgctagagatagtagtcgtgtcccttatagacatatcttgtaattctcgggtataaatagacccgagccctatgttactttttacacacgttctatacaatgcgcatcgtcacctttttg

SEQ ID NO: 24749 - DNA, 1603 bp, Oryza sativa
attttgaacaaaggtgaccggatgtatatctcatatctatcgtttagatcccttctccaaaataatacgtaaatactttgcattctttacccttgcctttccttccactcccctcctctagtcgccggctcttactcaacagacatccaccccttttataaagccacttcaattagcacatctcaccctctcgaggaaaataaagcatataatagtgatacccggatacagattctctgcagtactgcatgtacagtcgtagtaaactttactgatatgtgttctacagtgagctgcatataggatctcgacgcagtgataccctatagtcaatccgcccaaccatagtgcatttctgttaagcctgaacactatgcaatgtatgcatgataagttcaatattgtgcaaacaatatatcaacattacattattcctctcaagtcttccattctccaagcttctacatgtattttcattcttgagctcctttataagttaggtccaagtccaataacctatcataacccccttttattttggcaattggaaggtaagcaaatacaggtaagtgcaactgtatgttattcttgggtcccgaaatgaaatagggctagctaccgacaatttcatcacggccaccaagttgcgccagcttccactctatatgcatgactgcatgctttgctccagttagctacgtactagcacaaccattccattttgaatatctattatatactaactaaaagtccattgaattctctataaaagctctcaagctgtcacatggcgttctacaaattaacgctcctaagacgtcatacagtgcttaataaacgagaagaaaatttctaaaatttatggtaaagaaaacctaacgattgatattcctttaaataggtagagccaataattttcacccttaaatctccaaaaaaatcaggtatccccccccactctcctcccctattttctagctaacacataatatataaaaagataatagttagatagcaaaatgatcgtgattctcaagttacacatacttttcttaatttatttgatttgttgtgttatttataattaaatactccctccatccaaaagtctaagacccattctattatttggttttctctaaaaatctagtcctatttgtagtcactatgtgctaaattaaattattaatcggaaccaataagtcattttagtatttattggttgtatgtttattggttttgtcacatgatgaatgagttagttgctccttggtcttggacttttggatgaagggagtacataattcaagatccatatttctcatatttactatataaaaattagataatgcagccgttctaattacaaatatttgaacaaaatttgcactttgaaaacgatgaaagaattcaaatatgtgagtctaaagttcaggttcaatcaccaccaaggagcttagaaccatgatgcatattctaggcctgaacccgacggaggcggaactgcaagacattattggtgaggtggacaccgacggcagtagcggcagcttcgacttccacgagttcctgcgcctaatagtgcgctagatgattagatgaa

SEQ ID NO: 24750 - DNA, 936 bp, Oryza sativa
aaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagagggcccatgcatatgtacacaaacagaatgcagctgccgtagtagctgaagctcctggaacattccccactagagaggggaaaccccaacttcaattcctcaccaatctcatctcatctcatactagtactacactttatctcccccagttgatgctgctcacttttcttagtttccacgtcgcagtttctcttctctcctctgacccctttgtgaccgtccaacgacaacgcatggaggccgggttagcttagcttaattaagtgctcctacctgctgatctgatctgatcactttcttgtgtgtgcccttatgactgacagatcgatcatatagtctgaatatatataattaggattgttatatgcataggtttgcattattgtacccatttcctgcccccaccaccatttgcatgtgtgcagcagaaacatcctgcataaacagggattagaacgtagtgcaagtccctttcgacgctaattaatgatgagtggttaagttaatttgatggtgtttgtgcatgcccccgtcttggcgcctataaaagggtgagatcgcaagtccacgaggtcgtcgagcaacaaggctttcactcgaccgacctcccagcttacaggagaccaggagtggacagaaatatatcgtag

SEQ ID NO: 24751 - DNA, 809 bp, Oryza sativa
  unsure (1)..(809): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcg

SEQ ID NO: 24752 - DNA, 1594 bp, Oryza sativa
tagaataataatattccactagtattaggtttactaaccttttgcaaagaatgatcataaagtagaggagaatcgacatcaactcagacgataaatcaatcggacgaaatcgagaccagacttgacttgtgtgtgaataggccaagaactcagaattgacacgatgaattgggcaaaaattcacaagtctacggaatagagcaatagaggaggccaccagccgaaattgggctggattgggccagccccaggttcggccgaacccaatcctggcgccgttgaatccaggttttggcatggacgtccaggattgcatcccaataatggttggagggcacttcggataattccccttccacaaccatcataactacctctatataaggagctcactctcttcacttcaacacacaccttaagcaatagctctctcatttctctcaagtttagtttagtagtatctagctagtggaatagaattagaataggagtcaggagtccggaagccttcggaagagttcgggtatggctgtagtagcttttctcctcttttgtaagctttgtacttttattagaatactcttctatatacatttatggtattgaaatactttcacctattttacattatgttcatgttatactgaatatacggctagcttatctagcagatgctttggtgcgggtataatgtttgcttatgcaattgctctatgtcgtgacgatgatattagggtagtatctggtagtttagacgtagtgtctagattacgggatatcattatttggggttatatattgcgaatgagaggtgggctgctgatggtgacagctcactacgtgtattcctccgcgcctatatataatcctaagttaatttcctggggaggatattcctccgtatttagccccggttatatggtcatgacgggctgtcgtaaggaactcggcagtcaggggtggcttctcgaagtaccaggagggcatcgaatagagggtattagctagtatatcagttaactagaatgtatatatactatgtatactagaagtatatgaatagatttcctttctcttttctttcgatttagcttagatgatatattatgaggatgagtagttaaatgcttgtgtgtcactctacccttggattatcttaaccactgcttagaatatggttatcacaagtaatatataaattattagttgagttctctatacatgatcttcccacgggataaaataaatacgatatccttggaatactctcgggtgaaatgctacaatggtatatccgtgcgattggggatgaactctgtaaccataatataccagaagtatttctgcgccattgctggaaaatatatttctagtaatgtcgttaagaaataccaacaatactcgacgagacgggagagggtagaggaggggtagtcggagaggaagtcgaggaggcaggggaggtgggggcgagcgcaggtgcaggggaggggtgcgccgaggagcgcgaggatgctggccgcggcggaggccgccaccgcaactcagaggcaagcccagactagtgccacatctatgacggggtcattcaccg

SEQ ID NO: 24753 - DNA, 7921 bp, Oryza sativa
  unsure (1)..(7921): unsure at all n locations
ttcactagcggcggcgacgcagacgccattcgcgtccgagagaagagaagagaagagagaggagtaatggagaggaggggtaagagagatgacgtggcatcctgacatgtggggccacgtgggtctcatgctgattcagccgccacgtagtacaaaaccggtgtcaaaaccaccgaaggacctattgtgaccggatttgattagttaagtgatgccggatatctggttttgtggttggggaatgattttataactcgatgacaagttaagggaccttcggtgtactttttcctaatttgtaagggaagcagaagaggggcaattgtcctcataagcactagagatattgaagaaatgttgaagaaatgatcaaatgatttgaattcaaatattataaaaataatttgagaatgatgatttaccatgtgtatgtttaattttagaatgaaataaattgtagatataattactactccctccatcccaaaatttttgacgccgttgacttttttagacatgttagaccgttcgtcttattcaaaaatttgaagtaattattaattcttttcctatcatttgattcattgttaaatatactttaatgtatacatatagttttacatatttcacaaaagtttttgaataagacgaacagccaaacatgtttaaaaaagtcaacggcgtcaaatatttagggaaggagggagtatatacttgcatgttgtatgttgaactttgtgtgcttaattagttcatgtgacatatttgcatgtaggttttaggagtgctaataaatagttaaatactatgcttgcatgttgagctttagattattagtgggtattagtcttataaaagaagagattagaacgcacgaatgtggtgccgtttcaagtaggtagaaaaacaaaaggactgcctatatacttcctccgtttcacaatgtaagtcattctagcattccccacattcattgtgaaacggagggagtagtattttacataaaaatcaccttacatatcttataaattccagaacattgaatcgctttaggattcaattttttagatattggatcttttattaatctggcctctatattcacatagcatatacacaaccaaaacctacacgagtcctttaactacaaacctcacacagaggaatacacaaacacacacaaaaaaaaaactagaagacttagctttaacctttatcaatgacttactctttccaacgcagcatgagaggagaagatgagaatcgaaactagtccaaactgcctgttatcacaaccaccatcttcgtctctatggaacacaaccaccatcggctgcttgttgttcgtggtcatcacggagctgtccagcatgacatgtacctacctttactgtcatgagcttgccggagatgctccacaatcgtcgatatctatccgcagctagaccttggtgccgacgctcactgggtagctaccacctctagggtactaccatcgaagagtgttcacagtcatcgtccttatctacatcaggcaagctgacaatcatctcaccatctccgacgaccaccttccctgtcctcacttggccatggtcagaaccgggtgacggagctcgccaagtcatcgctgccctaagacgccgctaccgagagcctccatcgccgttgtcacaaactgtcgtgcacgaaccaagcatccaccactgttgccgtgcacatcaactgacccgctgtcacgagggagggctagccccaaccactgtccgtggccaccaaccctcaccaccggtgaatagaggaagggacaaaggacttatcccataaccactacccaacaccaccgttactcgccgccaccacaaagggaggtggcagtggaggcggttgttgcaggtcggcctagcgctccagttatgtgcaacgaaggtgcgatggcagtgagggcgcacgatgtcagtgttcagaacaccaacgggcaccaccggtgccatcaccactatcgcaccggcaaaccattatcagacgccgctggcaccgcttggccgtccgctactggtcattgtcgccaccaccatcagcatcaccactgcgtgtcactctcagatacaagtgagcctcgctgggcaccaccacacctacatgaacaaacaccatcagatccggagcttcctcaggcagctactagtggatcctgcccttagcggcacgacggccatcaagccgccaagaaccaagccaccaccccaccgcgcgcaagcagggcccgtagttagcgacttgtgtccagcgcgatatataatggtttttatgatattattattatttatttagaactaaagtgtattgaatagaataatttgccttgggactatgtaatcgttgcttgataggaccaaggaagtagctgttgatgcggtcgtgtccggttaaacatggagcgatgcgttggaaatggaccaattggaaacggacgcagcaagtgtcggtccaatgtcacgcacgcggaagagcgtatcgatccaatgtcacacgcgcgggagagcgacctacacaggcccaacacgtgcgaaaccgactaaaatgaggagacgaaccgaaatcggtggaggagcactatgtaacttttagacagaatcagattaagatacggacgccgtaccaaagatccaacgaaacacccagtacatacgtagttacaaaactaaaatatgtagataaaccaacaaataacattattttcatagcagtttctacggaatttattgtttatatatgccagacttttcttcagctaaacagagcagcgacggacacatggccggccacctcactcgctcgccgccgccgccgcctgcagatcggcgtacctcttcttgcccgccgcgatgaggcgttcgagcggcggcatcgccgccttggcctcctccagcgcgcagaaccgctccacccacgccgccagcagcggcgtcctgtccgcgtccacgatcctgaccccggtcgtcggctccgacgccagcatcgccggcacgaacccgccgagcgccacgtcgacgagccccacgcgctcgccggcgaaccaccgcccgccgcgcgctcccggagcgcgcccttcagcgcgtncagcgccgcgcgcgttcgcgccagcgccccncgcctctccttcccggtcttcccgccgtcgtagatccccatccacccgctcagcagctcgccgtcgacgaaggcggcccagaagcgggcgacggcgcgggcgtaggggtcgtcggcggcggggaggatcgtggtggccccggcggcgaaggaggaggaggaagggaagccctcgtcgaggtactcgacgatgagcatggactcgcagacgggcctcccggcgtgaaggaggacggggaccttggcgtgaacggggttgccggcaagaagaggtcgctcttgccggcgaggtccacctccacgtactcgtagctgagccccttgaggttgagcgccaggcgcacccggaccaggaacgggctcccccacgcgccgagcaccgtcagctgctcgccgccgcctcctgctccatctccggcggcagccatcgatcggtgatctcttcacctgcagtccaacgagtacacgtacaccgatcacgcacgttggttttgagttctttgctgctgacctttaccttggtgataaggagaaacgagaatcagtggctgcatatatagtccctctgtatgattttataagttatttgatttttttagtcaaactttttaaagtttaaataagtttataaaaaaatataattataccttcatttcgtattttcattccgtataaaataaacatattatcaaaatatatttaatgttaaatttaacgaaaccaatttgatatcgtacatattgttattcttttttctataaatttaattaaacttaaacttatgatataaaacggatggcgtatttggaagtgatattatgtttagagtctggactctggacggaacggtgtgttgaccggtgatgtgtcatgtctctgcgccatccacggaaacatcaaacattttggtgttgaataatactcgtgtgactcatgttgtgctttcttcaagacgaagcagcagctagatttttacacttgcacggttgtatctagtttgaatactcgcatatgtgattttgtttttttaattactaatttgtttcattttaagttagaataatccattgtgtaattgtgttttcccctagagaatgagagaaatgataagagccactaaaattacattcgagggacaagaaaagtgacatgaaatataaacagagccatatatattttttagttctcttcgattgtttaggcatgcaccattatctaaacagggccatggcaatttgatcgctccaaacgctacatattcttccatgtctgatgcgccattatcaaaagtgatgtactcctgtggtttcataattcgttttggatatcgacacggtttacaaaatagatttttaaccttattttctattataatataaaataaataaaatatatgtttacttttattatcgtacttttaaaaaaacaaatctatatacgttggtctaatttctttaaagtaaatatttttgaagttaaaatagtcgaaattacaaaagtttaacattaatcttgttcaaaacataagaattatgaaccgtatatgtgatagcaatgtcataccacgtaagcagtccaccttccaagttgaccatggttgattcccatgtccctcgtagatgtggtttaatatgtagattgtcctgaacagaatgaacggtggtgatctctatggttgagaatgatccaggccgtctaatgtaaatggatgatttatgatttgtaatatcgctctatatgatctcaattgtccgagtaaaatcaatggttctgacttgttgaaagagcggtagcccctccacgacacaagcttcgaccgttgtggcaatttcccctcacccttgcacccttgatcaagcagtgcatagtgaggagcactccttctggtgcaacacagtggtgaccggtgaagttgttcatacacaggtgttgggtccttatgtcctacctagacttttccgtctatccctagacttttccgtctatctccgatgcaccatcgtcaaaagcaaagtcatgtaatagtaggaataccagatgacgtaagggtctccaatatccaagttgaccatggggtccacggttcaacccatgtccaattgtccaacttgtgagccgtggtttagaagcaattaatgaacatgtatctattatgaatgatcgagtttgttcaatataagttgacactccgcatggctccatgcgatcctaatcgttcgagtaaaatcaacgactctgattagttcgatcattgtgaccatttgtttccactatgttagaagagcattggcccctccgagacacaagctctagctatcgtagcagtttccccctcaccaatcaccattgttggtcgtcagcatagagtaaggagcactacttccagtgcaacaaggcatggccaacgaagttgttcatacaccgatgttgtccttatttcctacctagacctagatgttcccttccctgttgcaccatcatcaaaagcgaagttgtgtaatagtaggaatattggatgatgtaagaggtctccaacatccaagttgactatgggggtacatggttcacccatgtccaagtgtttaacttgtggattgtggtttagaataaatgaacacgtatctattgcaaatgattgggtttgttcaatataaattgattctctattcgctagtacgtctccatgtgatcccaattgttcaagtaaaaccaactactctgattagcttgatcaatatcttgtctatgtcctgaccgtttatttctattgtattagaagaatactagcccctccaagacacaagctccagcttggccaccatcatagaataggaagcactacttctagggtagcatgaacgtggtcaatgaagttgtggatacacaatattaagtccttacgtcatatctagtattgttgttttcgatgtgccattgtcaaaagtgaggctcccaaatagtacgaatgctgggtagagtaagcgattttcaacatccaagtttgatcatgggtccacggttcaccccatatccaactatctattttttaggtcaacgaatatgtatctattgcaaatggttggttttgtttgaaacaaacaggcacaggatgattcatcagtacagtttcatgcaatctaaattgtccatgtacaatgactcctattaggtggaacttgtttatatcgtgattatttgtttttgctttgttggaaaagcattagcccctccgccacacaatctcttgtcgtcgttgcaatttctccccccatcctcgttgtccgttgtccttgagtgaggcgtgctacttcgatacagtatatatatgcccaacgaagttatagatatgccaattctaagtctttacgtcataccaaggcttcgatattgttatctccaatatgtcatcattaaaaatggcgccccataataataggaatgtaggatgatgtggcggtttataacatcaagtgtacttctgccaaattggtctacagtttgtgagttgtggtttaggatcaacaaataatcgggtccgttcagtatanaacgaacgctttatgattcgtgcttacagctccgtgagatcaaaatcaacggctccaattatctccatctctctgtctccgtattgaccgttcttctgccttgtcggaaactgcctccatttcttcactacccctccgcgacacaatctccggctgccgcgctagttgattccccctcgccgtcgccggccacctcgccgccgccgccgccgccgccgccggggaggtccctccccacgccgttctctgcgcccccccagatcgaggccttgctcgatcgaagaccttagccggcgcagccgcggaggtggcgcgcggtgcctgattccccacccaaccaaaccctagagcccaaatccggagggcggggatttgcgccgccgcgggctggtgcgagtctcctccagggcgtggtccccctcatggcgcggcggcgcacgtgcgggtgagctcgggccaccaggccatggacgagctcaacctattgcggcagcaccagcaccagcaccagcaccacctggtggtgcgcggcctcggcgaggagatcgacctcgagatcggcccgggcgacgacccctccttccccggcgcggccctcgtcggcgtcacccccggcgcgcacgaccccgcggacgaccacaagagcctcctcatcccgtgctcgcagcccgtcgccgaggggcagccgcagccgacgccgccgcaggtggaggagcacgacgggctgctacggctgccggggcaaaccaagaagaagaagaaggtggtgaagaaatggagggaggagtgggcggacacctacaaagtgggcttacgtcgccgtgcacgacaacaccagcaggatcttctgcaccgtgtgcaaggagtacgggcggaagcaccgccggaatccctacgggaacgaggggagcaggaacatgcagatgagcgcgctggaggagcacaacaacagcttgctgcacaaggaggcgctgcggttgcagacggcgtccaaggagaacgcgcagccccctgagatcgagaggccggtatatgtcaaaggttggtgttgttgcctcaagccctgtgattatgctgcgagttcgcctgtggtcttctataagaataggggatgtgtaccaaatccgtgcttacaattagtactatggtggtgtttagttgtttggcaaaatgtcattttactgattttaacagtgaaaaatgtactgggtgaaatagat

SEQ ID NO: 24754 - DNA, 10276 bp, Oryza sativa
atctgcactgtttcttttttttgtctgtgaacttctgcccaaaattgtatctttttttttccaatagaacacaatcaaacaaagttatataaaattaggatgcttgctgtgctatatgtttatttaggatttcattattgagcactataattgaaagtagagtgctttaaattgatgtggaaattagaaaccggcatgaagcttttataaagcattataaacttatttcctttgatacagactctaaaaaatgctttgtcacaatataaacttggaggagctgctggagggagtgattttgatcccaaaggtaaaagtgaaagtgaggtatttgtgtcacattttgtttcctttggaaaatagtattttactgcacataaatctgaaaatgttctatttcagataatgcgtttttgtcaaagtttcatggatgagctgtatagatatttggggcctgatcaggtattcctatcagatataatatcattttttttagattatgacatttttctatattagaaaaatggaatcaaattgttttgatctaaatcagatgattttgcttaaaatcttactgcaggattttcctgctgaagatgttggtgtgggtccaagagaaatgggttatctttttgggcagtatagacgcctttctggtcattttcaggtataatagttgttctgcaatgatatgttattcgaaatactgtttgtcatcttctgccgttgccttttattttgggtattctgattctgactaattgaaaactaaggaccattaaccaaagggaaattagtgactaaccttccctagttagagagcattataacattatcttaaacttcttttcatgttcatcatgacgtcctactgggtagtgctatattatcatgctgtgcaactgtggaatcaaatattagttccatgatatctgaatgtagtcaagttcagatcatactacagggattgaggaaccaaaaggtggtattgctcaatagtttgttatagcttggttcatctgtcctgtatctggacatttctcttcattcttggtaaaatacaccatttagtagttcgggaagcgtgcgcacagagaacgagagaaatcttctcttgttcaccagctgcagaacgcagccctactttaaggctattggtttgcagtttgctttatatttttttgtcagtcttttctcttattctgtagatttcattgctatgcttgtgcaggggaattttacagggcctaaaatcttctggtctggttctagtttccgaacagaagctactggatacggactggtaaagtggtgccttaacatttcctgtgagcagaaactattgtatatcatgttgcttgctactatcattctttcacaacttaccctttttgctgcatatgtcaactagacaattgttcctgttgaaaagagtaattttataacctgttgcaggtattctttgcacgtgtagtgcttgctgatatgaacaaggaactcaaaggattaaggttttaacatagatctatttagtttatttgtatatagttttgtaaccatttgggacttcctaatgtgcatggcttctgcagatgtgtgataagtggttctggaaagatagcaatgcatgtattggaaaagcttctgtcatgtgaagctattcctgttacagtttcaggtataccatatacagattgaaaccttaacatggattatcttgctaggaaataacataaggtagtatgataggcaggagcatgacctagtttactaccatgatttcaccaattaattttgtacatttatcatgactaaaccttatgggtttgtctgcccccaagatgcaatgattcacatcttattactgctttttacttaacctagctcatgtttgatttcccagaattctaatggccttatttatttaatgacatatataatggtttctgttcttgttcctgtaacattacccttggtttttcccttaccggttgtcacattgtaacccaatcctaaataagaataattcgtctacttgtacaagaataattcgtctacttgtacaagcaattctaatcaacgagagctatcataaattatttttctcttactggctgtcacatcgtaaaccaatcctaataagaataatttggtctacttgtacaatggcaattctaatcaatgaaaactatcataaattattgcagattcgaagggttatttgttagacacggaagggtttgattacatgaaatattcagttctaaggaacatcaaggctcagcaaaggagcctcaagtgggtagatgccttaacttatccttagttcataaaggtttagattttgacatactattccatttaaccaaacagggaatacttgaaatcatatccaaatgccaaatatatagatgatgcaaagccctggagtgagaagtgtgacgttgcattcccttgtgcatcacaaaatgagattgaccaggcggaggctcttgcaataattaactctggctgccgtgttcttatagaatgtacggaattttgaatttgtccttttgatcacttcgttccatatcatctactgatttatttttggtcctactgaaggttcaaatatgccttgcactgctcaagcagttgatatcctacgaacagcaaaagtagttgttgctcccgcaaaggcaactgccgctggtggggtaatgcaaatgttcttatcaatccttctgtggtcaaaactacatgatcctagatgaattgtgttgctcgtttttctgctgttataaattaatttgggcgcactgctttctaagttagattgatgtatattccagctgagcttggtcatggtccctcttttgatcatgcctttgtttctctcgtatgacaggtagcagttggagaactcgaactgaaccctgagttcagtttgatgcagtggtcagtggaggattttgagaacaaaatacaggtataatctgctgctcctgcttgttggcaagctactcgtatttactaactagaagacctgctgaaagtcttctttttaaaaaaataaacaggatgcggtgaaacaaacatatgacagatctatcaaagctgctcaagattatggaatcatgaaagagaacccagagttagttttcttcttgtgctctgaggatgtcttcctttgtttccgcctggtttcaacccagaagctgatcgatctctctatgcaggtcgttggtgcatggtgcaaacatatgtgcgtttcttaatattgcacaagccatgactgatcaaggatgtgtctagtgaggctgctcaataagcagaaatggcgattgttgcagtcctgcaggcatgatctcacgggagcataggtttttgtttatacatgccctcaaatcaatttagtgttgaaagctttcccctggtaggaagcgaagcttgggcccatcgtagaacaatatagaagagccctttgttgttgtatgtagtctcgtagatcaccgatgtattatccattctttcttttttttttctttttgaactatgtattgcccactcttaccaacatcaatgccaatgggaggaggaaatagaagcaattctttttgtatctagatggtgtcatctgaatgaaagtaatttatcaggagttaatcatacacaaacatatctatgccttgaatggatcagcagaactctggttgcttcacgagctataaaccaatcatcctcaagataaaagcaaaccaaacttctacatgcttttgttttgtttgaactcgagcgtcaaatttgcagacttgcttaatgatgcagcattcacagcaagaaggtaaatgtgggttcaaaccgaccaaaaacacaatagattacataacgaagtaaattacgcagccgctgtatgttcatctttaatacactcaaatcagattgatgataacctctcgaaggtattcatcagcaggcaaaccaattcatgggaaaacgcacaaaatggtaggcttcacctataatattatataaccacattgtgcttccctaaaacatttttgctctcttctatggttttgaagccttaagcggccgacttgcctgactgttctgctaagtaatgctcaagcatgtcctcttcgtcatctgtacagattatgaaaccaggttattgtaaggtaagtttcgcttccaaactacacaaattgttgtaggcaagaaagaatatcctcgaagtaagtgaaaatttaccatcgaagtcttcatcaaagtcgatgtcttcctcttcttcctcctcttcgtcagcagtggtacttgctcctttctggaaagaaaatttcaaatatgtgagacttacaatcgtacaaagattcaaagatcataacaaaaataatataaacaaaatatactggtggctatgcatgcccttaactggaaaaggggaaaacatgcaatacatacagtatttaaaaaatctaatatactccctccgttcctaaatataaaggattttggttggatgtgacgtatcttagtactacgaatctagaccatccaaccaaaatcccttatatttagggacagagggagtaggattaagtaccattgtatgccttccactttcaaaatactgtcttcctgagagtttctttttcttcggagctgtaagagctgactctggcataagcctgcacatgaaaaaaaatttgtttatgagaacatgttttggcacttgaaatttcaagatcaaatgctataagaaagcctgccatttgtgaagatgactccatgatgacatcaagggaaagctaaataaagaatcttacttggcacgctgtagcgccaattcagcttcaaaacgatctctccaagccagaaagctctctacagtaacagcttcaccatggggcacaatgacctataaatgttccattataaagtacattgcatgggaaagatacatactgcagaggggcagaataataaatggctaacgatcttagattatataatacagaaaataacagtaaccgtggaatttgatcatgaagtggctcagcagtcagtacgacaagcataactaccgctctgagaaatgcatcctagactagctccagtgtgtgatgaaatatatgtactcttaattggaaaataattaatcatgtgcaaataagtcagtctgaagcttggccaaatattcatttcatcttcttatcacagatggtcacaaaaaagaaaccattaaacttgccaaagggaataagttagctatacctcctcttcttctgcctcattttcttcagattccccatctccagcattctgtccatatttctcacttaaccaatcttgtgccgatgtgacaagagtatagaccatagccatgccgagattttcagttgcctaaaccatggggataataaacagagcatgacaaggcatatcaggtgatttttaatgaatatacctgatagacaagaatagactccgaacatcgtctattcaatttaagcacaatatattcaatatcaacataatatctgaatgaatattcgtgaagccacagtgagcattttacaaatcctatatacaggcatgacagtggcagtagaagcaggtaataaaagtagtttgtagtagtaaatagtaaaaaaaatacaataactgcccaagtttatttgactcattctgaaacttttatcttcagatgaacttagcgcatactccctccgtcccaaaaagagtttaaaagactaccacgtccttcaaaatatgtggagaaaacgagaagggggaaaaaacgaggaggacggagtactattgattcaatggttagaacgagaagaaaaggatgtaatatttaagaggtctaatggaccactctaaaattacactcttttagggataaattcttaagctaaaactacactcttttagggataaattcttaagctaaaactacactcttttagggacagaggaagtaagttgttttgcacacagttgacagttagattgacaacaaacttgagccaagtacttgcatacctcttgctcaagcttttctttcaaggatgcaagatcttctgatttcattcctcgtacactgcatggaagttttgcaattcaactgtaagagttggaaagcatataagcacacatcttgcataaagataccatgaaatttaatggcgctaagcttgcttccaaccaatgctggatcaccaagttaaaaaacagaaccttttgacattcaaaagcggaggctcatccggatatttttcggtgtgtgcaaaaatcagagccagttggactgcaaagcaaggatggatgacacaattacaataataattgaataaatcaagaaatacagaacatctaaatgttccttttctcttattttaatataatattgattatgataaaattattctttacctggcacataagccgactcatcgaaatcatcatcctaaccaagtgaaaaggaaaagatcgttaatttcaccaaactaatcataagacaactgacgaaactgcaacatctcttcaattccaagagttcctattgccaactatactttaggtcataactgaatgaagaatcgaggaagtgatacatatggtaggatccccggcacaaacctgaggggagagcacgatctggaagcagcgagccgtggtgctgagcccgctctcgctggggtcgatctctgcatcatcatcatcatcatcatcatcaaattcccaattcccaggttaaattccgcaagcaacaagctatagagcaagcaaagaactagtattgtgcagggggaagattaaaaaaagaaaaagaaaaagagagagaacccttgatgtcgtccatgaggatggcctgcagggcctccacctccatctcctgctcctgctcgtaatcttctccggcgccacctccgccgccatacgcaggggcacacagacacacgacgaggtgagccatcatacaaaaacgaggaaaagcgcgcgcggcggagcagtaggagaaggtcgagtatttggggttcgtaccagccatgatcggtggcttcctggctcagctctcctgctttgctctggaggaggagacgagacgtcagtagggagggcagtcggcgacgtcggcggcgtcggcgtgcgtcaccggaagacgagcaggaggtagaggggggagttcgatccgatgccgatggattgggccacgtattggaccggaaccccaaataacgcgtgtgtgatgtactgatgtggtcacgaaaaccttttttttttatctcccctgtatatctctatcactactattataaaaattgaatatattttcgttaagattttggtacgttacccgtatttgagttggttttataaagatatagatttatggaataagttatggtatcacgaaacactatttgtatttaactcaaacatatgaagctagctacagggttttttcacgtttgtcacggcaattacagaacaccttgacgaaaaccgagtcagtctcagtatcaatatgcattgcaattacagaacaccttgacgaaaaccgagtcagccttggtgtcaacacatatacatgcatacatacatattgcgagagtaatttttcagttgctgccaaaaagttttctctgtttaactaaaaaaatatttgagcgtgttatttatttcagattgcaattaaaaaaaactccttcgtgctaaaatataacaaacgttgttacaaatatagctaaaaaccagcatgttcactccaaagactaggaattattataccacattaataaaaaagaaaaaatatacaccattagtagtagcactcttcccgattttaatttatctatgtcaaacataaaaattgaagatgtttccgccgatattttggtgcgtcatttgtatttgactcggttttcaagttcgtttgcttttagaaatacataaaaagtgatataagaaatcattttaaaaaactcgcatgttaacttaggagaagagttagactcctaattgcttcagaactcttgccaagtcataagaaagcaacacacaagatatgaccatcatcctaataaaagtttcaaactagatatcaatactatcaaaatgtataacgccgttgtctattcccacaatgtttgaccattcgtcttatttaaaaaattaatataaatatgaaaaagtatatgttcagattatattttatttgatgatacaacaattcacaacaaaatttatgatatttatataatttttttaataagataaatggtcaaacgttgtgcgaaaagtcaaaggcgtcataattttgaaatggaggatgtactttttagaaaaaaaattaacaataatatgattaaaatagcattcacccatcgcaacgcacggacatttttctagtaacctatacaataaatcccacttagagcaagtttaatagtatagcccactactagccccaaatcatctataaccaatgtaatagccaattcatacagtagttagttactatactattaatacctggtcccacctgtcatatacatattacgtcttaaagtccgtgctgcagctagctacagatctgtagcccgctgctcttctctctcttcctttacctcttcaaaatatgtttatagccggtttatagcctgctattgcacctgctcttagggtgtgtttggcacccctttttcccaacacatcttcctcgttttccgcgcgcacgcttttcaaactattaaacggtgtatttttttgcaaaaagtttctataaaaaattgcttaaaaatcatattaatccatttttgaaaaaaaagcaaatacttaattaatcatatgctaatgcactgctccgttttccgtggtagggttgggaaccagcgtatgcaaacacacccttagtttagttattaagtatcttctctcatgtggtgctttcacattacgttaattatttacgtccattggatttacacttaatgtctaagatcatcccaaagtcactttattttgtttctctcggatttctcatgttttattcatgtatttacttcttctcatcatgcacaaccatgcaaccttcaattaatcaagcaaacaataggccaccaaatgctatgaatgaacctaaacggtcttctttttaattttgtgaatagcataatgaacatatcacatactatataggatagcctatacatttatagttgtgtctctaaattacattaaagaaaaatgaactatatgacatgttctgttttgatcataaggcagttcaataatcgatcattcacggtatccacatattatcataatatctttttttcttatatgttaaagtttttctaaaaattatcaacctcatcttttcacttataattatacttatcagccaaaatttgagttttcaactttaaatttggagttgattttaggattcatagtttatcttttagcgtttgcttttagctagttaagaacatgtatataaaggttttattcacaaattatttttcatttgcaaatatgccgtttcgctttttcctcttatcagccaaacgatggggttgtataatgttttgtatttgtattttgacttaagttatagctagcatttttatatatacccaatacattctaaatttcttatcatcaaatttgcaaacataagttctatagcaattcacgcagcaacttacggggaatcatctagttaccaagaaaacatgttttgtcaaatacctacaacgccataattactgatcggttacaagcgaataacgataattttttaaacaatttttattaaaatgttaaaaaactttgggataattgcttattttactatgtttcgaaggctaattatcaatcagaccttaattttttctagtttgcttaattgaccctgtttttctgaatcgaacctatcgtttcaccctatttaaactacaccgttagggtttcatttagaaaaaagaaaaaatacatttattattcacgctaaccaaatacccttccttcaatcttatccatctcctacctcctgcccaactcttatctctctctctctctcctctctcggcgtgaacagcggtgtagggaggggcggtggggctggatttagcgcacagaggggggaggggcggtgacgacgcctacgtgctgagggaggaagggccagtggagctatcgacatgcggagagacggggacggcagcactggcaccggcccaccgagggaggagggggcggcgcaggcgtgccgagggtt

SEQ ID NO: 24755 - DNA, 1733 bp, Oryza sativa
  unsure (1)..(1733): unsure at all n locations
ggcgcgggagcggcggacagcgagtggcccgacggcgtgacggggcggtacgcgaaggtcggggcgctcgtgtgggtgcgccgccgcaacggatcctggtggcccggccagatcctcagcgccgacgagctcccggagaactgcgtcgtcccgccgcgctcctccggcacgcccatcaagctcctcggccgccccgacggcagcatgtccgtacacacacacctcctccctcattagtcgtcctccaatcccctgtctctttttcttctgattgctttgcttctgttcctttctctttgttaagagttcctgcatgcttagatgatccatgctgtagtctgttcttggtcttatggccatttagacctacctctgtttcgtgtcccactctgaatttgggcaaagaacactgtgatgtggttcttgatttgggaagaactggaagatagtgtattgtgcttgtcctgggtggctttctgaatttttagtatatgccttaagctcagcaaggctgctagtgccatgggatgtttggtgtgtttgcagttagcggtagttgttgttatctacggtggtgtagtgtattctagactataatcgtcaatggattttattttatttttgctcagcccctgtttttctgcatgatgagatatgggaattgggcgaggtaatggacatatcgattagtgtgacacgattatagcttttatcagtatacaccaaagacaacttgtgtcatgcttctcttgaaaattagaaggtaaattttcgattgaattcttgtgctctcttgatggtatttttatatcttacagatatggtatgaagtctgtgaatcttcccctgattttttctttttttcctgaagcttgctttggacttaagagcgaagattcatttatatggggaatcaatgtttttaggttgtatgatgaatcgatgactttaggttgtatggatgtcatcacttctagtaggtttagatggattttcttctaactgttcagcatgtccataaactaatgctattatgtgccttttctgaatgtgttacttcagaagagatgttttatttctattcactatatttaactatagttttgtttagcatgaattgtgtatgtgatgtattttctgtaccctaaatctgactattgtttttttaatcttacccactatttttaattaactttgcaacagtgactggtataatcttgagaagtctaagcgtgtgaagccatttcgatgtggagagtatgaggaatgtatagaaaaagcaaaggctcaagctcgccagcataagagggcctacaatgaaggaaagtatgtccgcagggaagatgctatcatgcatgctcttgaacttgaaagggctcgctttccaaatgaagatgatactgatgaacatgatactagtggcctattatttgaatcccaaaacagctattgtgcaaagtccaaaaacataaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24756 - DNA, 1199 bp, Oryza sativa
  unsure (1)..(1199): unsure at all n locations
tcagctatagctacgtggtgtttcctctgaacctatcacaagttcagaaaaggagattttttttttggtctgaaaattttgtagctgtctgtatctcccactaactcacattcctgaagaaacagatactgaatatacctcaagagttaggcacgcaagcagtgagaggttgcactctctgagtctcagattcttcaaatgagaatgagagggcgtgtgcaaaaaacgcaggcttcttgtaatgaccaataccatctatcaattcagagtgtcttctctccaccgttcttttaacctaagagaaccagataccaaaagaggatattttgtggcgatcctgaaaggacatatacaaaaagtgcagagatgccaaaagcatctttgatcctgtcccatgatgagctgccctcatgccaagaagctttcagaagttgtcatcccacgcaattgatctcccaaaatgttcagttatcttgatacctttctttcttcttctgctgctgctatgcaattgcacctttgcaagcatggaagtgatcagatatcactaagtgctcgtggaggtagaaaaggagattctattctagacattgcatacgcagcagaacaagcaactaacctgaattgaatgcactgtgttttgtttgcccaaggttattatatgatcatatgatgtatatatgggtgttttattctacgatgacaaggcaaaaggagcgcactgcggtttttccaatggtagaaggttgtgagaaagaaacagcagtggtgttgtcctgatagttccactgtatcttttgcatgaaaaatctcttgcaaagcagcaaaggagacatccatgattaaccaataattcgttgcagaatcgccgtaggtgcgacacaaccagatctggtccaaccaccaccagtgcatttgattctcagtattcagaaattatatccctatcactgcactcagtcacaaaggacaccccataaagcttatagaagtttttttttttttgaaactgatcttgaatttgctctgaaagacttctatgaaatcccttaatgatatgggttccaagccgtttcaaaaatgggtagaggctgaagaaacccaggaatcaaggtgtgtccagttttagtcctcttgcacacagcannnnnnnnnnnnnnnnnnnnnnnnnnnnnnnnnnnnnnnnnnnnnnnnnnnnn

SEQ ID NO: 24757 - DNA, 1220 bp, Oryza sativa
  unsure (1)..(1220): unsure at all n locations
tcctgaatcaaacaccagattatgttacattaattagcaagttaaacattgattttgttttcaggagagacgactctgatcgtttgcatgggatgcacattgtttgtttgaattaccagcttgttcttgagcgcgaagatgatggcgccggcgtgctcggcggcgttgccgacgatggggaggaggatgatgctgatgaagctgacggagaggccccatgactgcgaggtgggctcgatggtgccgacgacgtactcggagaggacggagatgacggcggtcatgagggcgagccagaagagcgcgctggcgaacccgagcgccggctcctcgtcgtcgtccccggcgtcgccgccgtccacctcctgcggctcgaacagctggcggtgcgtcttgagctggaagaagaggtaggcgacgtaggacgccagcatgacgaagctgcaggcgcgggagaggtcgagggacgccgcggccgaggtggcggagacggagtgctcgccagcggcgacggcgtagcggaggaggagcggggcggagtggcagaggacggcgaggaagaggagggcggtgctgacgtcggactggttgcggtcgtagggctggcgggcgccgaggttgacgacgccgccgcagaagagggaggtgccgaggacgaggaggaggttggagaggacggagcccagcagggagcacttgaccacctcgatcttccccttgagcagcgcgaacagcgcgatgatcagctccgtcgcgttcccgcacgtcgcgttcagcagcccgcccactgccccccatgcatacaccatcatcaacacaccacaacagcaagttcaattacttcatatacaatgcttaggctgtgtttggtagctcatttttttcttctccgtgctcatttttttcaaactgaaaaaattttgaaaaaaattgatttaagaaatcgtattaatccatcttttaagtttgttttagttaatatttaattaatcaagagctaatagatccatccgttttgcatgtgnccaaaccgtagcagacatnacatttgggttctctagcagaagaagagacangggtcnttgntcttnccctttggngaaaaaaccatcgatgcnncnnntngtgaaacaagtgccattttttgatgttaagaaagatgattccatccacgaataatatgaagtcttaaattactttcagtttgggactgatcgttg

SEQ ID NO: 24758 - DNA, 2687 bp, Oryza sativa
attccatccacgaataatatgaagtcttaaattactttcagtttgggactgatcgttgtgacttaccggtgggaccggtgtagagtgcaatctgcctgcaaaatttcagtagcaaaatgcaaaatttcagcattcgaattataaacagaatttttaaaaactggacataaaaattgcttctgtaacgagtagcttactctgtgaggaagctgactctctcggcgagagggatgaggcccagtaaactaagagcgaacacccacacctgtcaagataaatatttgtttcccaatgtcaacacatattggattaatgtgcaatagtagttaaaagtataagatgaagacatatcgacaaaaaaaaagggaaagtactgtaaggtaacgcattattttattttatcactaatttactagcactggatcagcaaaaatacctgcatcacaattaaataattagatgccacgtggaaggaataaaacatgtctcttccaactaatcaggaataaaacatgtctcttccaactaatcaggaaatgtgacagactgttggcctcaaccactaaaatccaacacttccaacctttactggaagcagcttcactcatcatccatgcatgatgcatgcagcagagtgtgaacttatctccaaaccaaactaaatctgttttcctttcgaaactaaaaatcaagctaaatctattagcacaacacacaatcaaaccccctgattcaccaagctccaaaacacaacggagattgatcactttctggggtagaagtacactcaaccaagaggcaaagaattaaatgggttggattcgtcatcgtcccagccgcttgtaccggcagaatcctgtcgtctactcagcaagcagcaaaacggcatgacgccgctaatttggcggatcaaagaggaatcgagtgcaatttgcaagatgacaaattaagttcagtttttgctgcaaggagacagatgggttttcttcaaagctcagggctccacggcagaatatttgtgtcccgacgaggcaaactaactggcaaagctaataggctccaccagcaagcaatacaaactactccacaaaatatgttttgcgggggaatattctactatcacagaggagggaggaaatcacaagctaacagttcataacagaaaattaaaatactgaataatgaagtgctccacattttaactcctaggcctgtatttcaggttacatctgggccatctggcagacatggatgcttattgcgtcatcaagcctaggaattttgtggaaattgaactgatgtatgagaaatttctgtaatttattgacttctttaaaagaggccataaatgtatgtactaagggtgtgtttagataatgagaaatgtgaggtgggattgagatttggaaatgaacgaagggttaggattaaatgaaagagcgaaaatgaatggttatgatttaaagatgtattctagtgagtgggaaataatttccatgtcctattagcctaacagcgcctaattttcaagtggaatcaggaagtccaccggaacgtccatggccagtttaacactagtactagtggtacaagacaacattttttgtatgtatactttttaacactgttactagtaccactttagacattgatggctaattctactacagttacgaaaattaatcctacaccataaataaaagtgtcaaagagagagagagagagaaaagaaacaggagtgcaaggacacagccctcgtgcagccgtgcagttgcccatgtggccttaccagcaaaaagctacagtactatatctcggtttatactagttaaaaaaaaacttaaaataggcgccgcagcggcctgccacctggtcaccgccgcttgcaaacgccgaactcgaaaaaaaaaagatgaaaaaaaaaaagatgcaacgaacaccaagcagacaagaggatggtcaaagcgaacatggaatggaatggaatggggaattgaattaacctggtcgaagcggaagcactgggcggcgatggcgagcgggacggcggggaagaggacggcgagcttggtggcgaggaagacctcctggaggttggcgagcagcgggcggagcggcgccacggggaccttccgcaccagcgcggcgtccgacttcttccgcagcgacgacgacgacatgttgtgcgccgtcctgctccgcccgtgcgggtgccgcgccgccagcttccgccccgcctccatcgccgccgccgcctccatcaccactagatcaaattcgatccccccctatgcgcgcagcgcgccgccagaattgcgagagatagataggcagatggatggatgtgagaatcgattgatggcgccgtgcgcgcgcgcgacgcgagagtcgagtcgcgagagctcgccgccacgaggaggttctcgtgatggtgtgtagttttgtacaggacgaggagaagcggcagcagtggcgagctcatatatagggaggagccgaggaggagaaacaaaaccacaaatgcaattatgcggtttcgtcgtgagcgaattattggatcatcaatgtaatgcaatccttcgcatcatcaaacaccagcaaattattttttttatataaaaaaaaggaacaaacacgtactaccgatctaccatacatattttacggattcagttcattaattcatt

SEQ ID NO: 24759 - DNA, 6208 bp, Oryza sativa
  unsure (1)..(6208): unsure at all n locations
ggcaaacgaagcttccgggaagcttcccgccgcacgcagcagccaccagccaagccaaggccggcaacgctgcttgctgtttgcggccttccgtttcggccttgctccgtccactccacctgcgccgcacgaatgtcgtttggtgagatttggtgtttttttgcccgctttgcgtttggctgtttttttttatgtgatccgtcggatccttttcagagattggtacggtaaattggtttagagtaaatctggaccgttcattgttaataattccatggtcgacaactcgagatcggccaagattttcctagtggtaatattgacacaataaaaacttttagggctcctttgaatcgtaggaagaaaaaaacgaaggaatagaaaaaacataggattctgacaggaatgcaagtataaaacagaggattacaaaacacaggaatgatcgtttgattggaccacatgaaaaacacaggaatcggatgagagagatagactcaaaggatttttaccaagagattagacctcttgctaaatttcctccaaaatctatatgcaacaagccattccataggaattttgttggatttagaaaactttaatcctttgaatcaaagagctacgtaggaaaatttcctataggatttcaatcctatgaaattcctccataattcctttgattcaaaggggccagttagatagagttgaagtgtgtgccataggaatcggatgagagagatgcgcggtaagaaacggcgtcgaggcatgtggtactgtcgaatatctggccaattattggaagaaggtgagaattttgttttggatacacaagatgggtccgacgacgaccagattgagttcatccctgattctgatgatgaaggcatcgagtactgcttctccttagatcaggagtttgtgcccgaaactgagttctaggattgtagggaagttgaggagaagggtggtgggattcaggattgtggggaggtgaacgagaagggtggtgggattcaagattgttgtgaagcgaaggagaatggtggtagattcaggattgcgggnaagtgnagaagggtggtggattttgtgcggcaagcaacatagtgcactcaaatgatgaatgcaacaagcctgcccagatgtggtgcgggcagcgggttcgaggcaagtggtttcatcgtgaatctggccgatgtttagaagaaggcaagaacgtgatctttgatacccaggatgggcccgatatggatgagtatgagttctggcctgatttggatgatgaaggaggcgacttcgtatttgaagattggttcattgacgttgtgcccaagaaaaagattcacgatggtgttgaaatgaagaagaagcgagccggtaaaattggcaagctgatgagctccaatgtgacttatggcatgggacgacccagttctaccattaccaaggcctccttttcgtcgaatgcttcttatccgcagggaggtgacctgtggcaggggacaatggccaaccacagtgctgaaccgagcaagcacttcgtggtggagtcctccaatatcagcgagcagagcaaggtgtgtgctattaatttatttgagtcaactttgcataaaaaattgaagatatattatttaatagctatggaaacttacagataaactcccgaggagcctgctatgtataatatatccatatacttctagctagtaacaattaggtaaccatagatatttaatcactctaactttaatgcattatgtaatgtgcaaccaaagccacaagttagtaagcagtatagtgccatatagctggaagacttgatctgttcaatggagagtcatgcaccatctaatgttctagccgttaccacacaggatctttattgcattccatttaatattgttttgccatgataagagtcctgcaacgcataacatctgttcgtaaggtagcattgatttgttgtcatgctaattcagttatgtatttaattctatctttagctctatttaagttctagtgctgtacaagtaatttttttcaggtacttaatacagttcttgcttattttcagtagcaggtcaacaggaatattgtgtctgggactgggatctggagttaaggatgcttcacaattcaaatttcacaagtatgtgaccatctaagcatgattcaatatttcgcatcataaacacgtgatttgttgatgaatattaaatactaaaatttggcaagacgtgtgggttcttggcaataaattggttctttgtactagcaattaacaaaatcagttagtaaatattgacatcgttctgctcaccaataggttgtgcctgttaattcttccaacatgctgtggccatgaccaaagttacttcctccctaattcgatgttaggtaacaatgtgctatttacagttcatttgttttctctatcttctgtaaagtccagatgctctaggattctgaaaagaaatggttaaatgtgaactaaaatttcatactaggctctgaaatctaatctatttgtttgccaatgctttaatctatttgaaaccatagtgacatgtcttgagttttactctctatgattactacacctgttgtctagtttctaaagtgtcttctgatacatgataatggaactagaagaactaaactctgcaaaactgtcacagtagcaaccttttgttcttttcagatcgtgtgtgtgtgtgtgtgtgagagagagagagagagatagagcatgtgtgctgatgagggggtataatctgctgttgcatgtcatacaacaccataggtttttagagctagatttactaatgcaatcaacatgtactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaatgtcatctacctagataacatgccttccaggaacttcttcttctagattggcttgtgcttcattgaggtcaggtaaagcccctccatcttcctcttcttctgctaatatgtttagatctatagccattgtgatgggtaggtgtggagttggtttgtaggatgatggatgaagtgataaaaggcttgtagctgcctcgctgcttgaggattatggagggtacccttgggcggcaaagcaccatccatggagtttttgaatttgattagaccagttggattattttaagcccttatgttttggcgccatatcactcgaattaggtgtataacaccaatctgtagtgttgatactagtagtagcacccaacattaattggatgcttcaaatattccttttgtacagatgtggcagtgtacttgtcgtactcctactaagcattcaaatgattagccccaatcctataaattgagggcaaaatggtcattttcacacaacactattttttcctaactaacctagaacgtcctcctttctgggacggagggagtaatttgctacaaaacacactaagactattaaattattatttccattaggatcggagagagaatttaactaaaatgactttggtgccccggatttcttccaaccatccattcctctcacgcgtagtaaggctgtgttcgctccagcgtgttcccaaccggaacagtgcgtacggaaaacggaacggtctattagcgcatgattaattaattattagctttttttaaaaaaaaatggatcaatgtgattttttaagcaacttttgtgtagaaactttttgtaaaaaatacactgtttagcagtttgaaaagcgtcacgcgaaaaacgagagagatgttttaggaaacctgggggtaagaacacagcctgagggtgtacggtgcgaggaccggcgatgcgactgtatggtgtggcggtagcgactttgtagcgggtggctagcggtgtaacggtgaggactacatagtaggccaacacgatggcagcggccttgagggagagggtcacatgagtggactgtgacatggagcacagcagggagtgagcacgtgaggagcagcatcacgactaggtggtgcggcgggggtagcgcgctgcgtgaggagaggcggcagtgacctcacggtgggggtggctgcaacagtgatgatagcgtgactgcagcgaccttgctatgagacatgggtgcacagcgcttgtgctcacacgaacgtgagtagtggttgcatgactgcacgggcggcagcggcaaataactcggtgccggagaaaaactgaaagaagggagaagaagataagggcaaaattcatattttatgtggtttctctcgtattaattggatggataatatattttaatgcgtccgatgttttgtgacaaattaacatattatcaaacagattcacattcttgtggtgtctattagcaaataccatacttctcgagtgttctgcaataaattttgtcataaattaaccagttgtcgagactcgccttaattatcgaccgaatgccggataaatcctatttttttgtcaaatttcgatttcaataaaatctattgtttgcaatatgatttctcaaaaatcctccgaatttttcaccttttttagaggttcaaaattttcacttggaatccactttcgtctatggcgtcgaaattaaaccttgaaattccatgaatttattttatcagttttcattgaaaatgtgtgcttactaccatcggatgaaatcatgtgacgtttcggatagtgaaaatggcttacacatagtattttagctctcagaagcatcagataaacctaactagagggagtaaagggcttaccttggctccgggctgggctgcagcatcaacaccaacaaagacgccatctgatgctttgtccaaagaggatcgagatgcaaaggtccggttcaagctggcacagatggtggagctggcggcttctactgcttcaaggccgatggctagtcatccccggttgcagttggcggcgaggacgcagctgaaacttcgtcaggttctcgtttttcagttttgtagggtgtttctgaagatgaagatcatttacacttggagccggctacgaagccttggagtggtcctcttcttgcgcctcgtcgatcgccgccaagaacgattggaggtattatcaaagcagcgattcagggtaaagtttttttgtcgtttccttctacaattcagagtaatagatgttctccggtagtctcttccgttccggcgagatctcggtctcctccggcggtgagtccggttcctcgatccgatttggatgcgtttccaaaactttcgggtgattcatctatttcgaattgtgaggttttggatgagtttttgccgcaattgccacataggcccagtattccttttaggcccacacctggtcttgtctctctattcgcaaaaacggggacagtgcgccagaaggttaggtttacggatcgatctgtgccgcttccttcgtacgccgctgtagttcgtcgttcaatgaagagaaagaaccagcgtcctgttcatggagggggaggacaaggcagctttgctgctcgtgcaaactttcatccaggtcatggcgagggaggttttcaaggtgctcgaggccggtttggcagaaatcgctttggagctcggaattttggtggaggccggcaggggcaaggtgaaagaggttggaacggcaatggtgggcaaccaaatgctggttcccatggcggagnagatggctggtttggacaggaaaaatttagaaataccgaaggtggttttggtctgcaagctaggccaatttttgggcataatcctgggctaaggtttgggcaatctccaacctttagctttggattgcagccggtcccgttgccgtttggtcagtttcctccggtgccggctggtggtggcgacgcatctctattggctgccggcagtggcttggcacaatttggaggagcggctgcacagtttggtggcgggatgattgcgggtggtgttgcgcagggatcgacagcagctcaacatggtgccgggttgacgggcgccggtgcacagactagtagcaactctggaggcaatggttctgtactggctgggattgctccttttggtgataatgtgcatcttcctggcggg

SEQ ID NO: 24760 - DNA, 1446 bp, Oryza sativa
aggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcgggtggttcaatgttaggtattacaaaaatggttgatatgaattttactaggagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctgggaggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactggttttcctgaaaa

SEQ ID NO: 24761 - DNA, 8686 bp, Oryza sativa
  unsure (1)..(8686): unsure at all n locations
taaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcatactcctctactcctgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaaagattcgcagactaagacaatttttaagaggttgggctaaacaaactagtggtacctataaaaaggagaagaaagccctgttagaaaaacttgatttacttgataaaaaagctgaatcaaccttgttaactcaggaagagcttaatgctaaacattatatgaggaataggttagcttgtttgcttatagaagaggaaattaaatggtatcagcgggctaagaccaaagatattttggaggtgactcanatactaagtattttcatttggtagcaaatggggagcataggaaaacaagaatttatcaattacaagatggtgaccacatcattaatggtgatgcaaacttaaaagcacatattaccacatattataaaggtctatttggtccacctgatgagtcttctttaacttggnatgacagtcttataggtgatattccccaggtgtcttctctagaaaataatcgttagttgatgaatttactgagaaagaaattaaagatgcagtttttcagatggaacataataaagctccgggtccggatggatttccggttgagttttaccaagtgttctgggacgtaattaaaacagacctggttgagttatttaaagattttcatagtggaagcttaaatcttcactctcttaactttggtactattattttgctgcctaagtgcaaagaggctataaagattcaacaatataggcctatttgtttacttaatgtcagttttaaaatttttactaaagttgctacaaatagaatcactggggtagctcagaaagtaattagtcccacacagacagcttttatacctgggaggaatattatggagggggttgtcattcttcatgaaactattcatgagttgcatcggaaaaaaaatgagtggtgtcatttttaagattgattttgagaaagcttatgataaagttaaatggtcttttgttcaacaatccttgagaatgaagggcttttcccaaaaatggtgtgattggattgcttcttttatctaaggtggtcatgtgggcattaaagtgaatgatcaggtgggatcaaattttcaaacttacaagggtttaaggcaaggggatccattatctccaattctttttaatatagttgttgatatgttaactatattaattaagagagcaaaagatgatggtcagagatctctggcttggtcccacatttagtggacgatggtttatctattttacaatatgctgatgatactattatttttctagagcatgatttagagaaatcaaaaaatatgaagctgttattaactgcgtttgaaaaactttctggccttaagataaattttcataagagtgaattattttgctttggtcaagcaaaggagtgtcatgagcaatattcaaatatttttggatgtaagctaggtgattttactgttagatatctcggcattccaatgcattttagaaatcttagtaataaagattggataacaattgaagaaagaattgaaaaaaaactcagtagttggaagggtaaacatatgtctgttggtgggagattggttttgattaattctgttttgtcaagtctagctatgtttatgatatcgttttttgagattcctaaaggggttcttcaaaaaattgattattatagatcccgtttcttttggcaaggggatgaacataaaaaaaagtatagattgacaagatgggatattatttgtcaaccaaaagatcagggtggacttggagttcacaatttagaaatacaaaaccaatgtcttttaagtaaatggttatttaaattaataaatgagcaaggtgtgtggcaagatttactgaaacaaaaatatcttactggtaaatcaattactcaggttgagaggaaacaaggggattcccatttttggtcaggtctgatgaaggttaagaattcctttttaaatatgggttcctggattattaataatggtgaacaagtaagattctgggaggataagtggctagggaactattctttgaaggaaaagtacccctcgttgttttctatagttagaaggaaaaatgcctcaattgctaatgttatgggttctgttccgcttaatgtttcttttagaagagctttagttggtcagaatctaattagatggcataatttgtgtgcttccattgtgcatattaacttaacatacgaggatgacatttttagatggaattttcatcaaaatggccaattttctgttcgatctatgtacttagctttaattaataatggttacatagaaagaaataaaattatttggaaacttaaaatgcctcttaagattaagatttttatgtggtatctccttaaagggattgttttaactaaagataatttggctagaaggaattggaatggtagtttgagatgttgcttttgtatgaaaaatgaatcaattcaccatctattctttcagtgccatttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaaacttgagacgacaattatgcatctatttgccaacttcgggtggaggttctctattagaattcagtagttaggggatctttttcttttgttggtgtctattagtttgcttagctttgtttctgctatcgtgaactttctgtgtgagttccataataattggctgtaactcttagagtaaaggccggaatgttacattccattatctaaaaaaaactagagggagtaactgggaagatcaacagcataccgtacgcttaattactctacacgcatgtaacccagctggtatatagcttttccacatttccagttactcgattggaatgcaatgcttttgagtaaaggccggatattatatttcattatctaaaaaaaatttaattatgtctattcttaagctatgattgagcttgtcttacgggaatattttttcccatgaatagctaaatgattttatgataactatttatgtacgagtacaaataaaataaattaactattataagattttaaaaatagattaaaaaacaatattactaagtcgtatatatttttatgcgaaaatcacatcgtttaattaggagtcggaaaacacatgccatagtttttataattccatcattatatacagagatgcaaaattatatgaatcaaatggtcaatttttcgtctacggctattaaaaacctcgaacgaaagtcaaatcaagaaagaatggggatttatcattggttagaggatggggtgtcgattgaccgtgatggctgtccacaacagattgtcgtatatgtgcatgcttgcatactcgggcgtacggtacgggtaagctaaggctgcgtggaatcacgctgtacacacatacgtagtatagagtaggatttggatggccattttcatgaacaagtagagagatatagatagatgtggcgaccattaattcattccttctgtggctttagcagtgtgcacggatcgcccttataagtgacactactttaaaaaatatatttttcatagcaccactcttttatttttttttcctcaagtttaataaacacacgcttgtaaagataattaagagggattccgatcaccaactgccagtgaaaattagttttcgttggttgtcgcttaagatatctgcttgcaaaaatagaggtatttttacaaacggttcctttaagcgacaaatttcgctagtagcggctaaggagtaccaactgaaaaaaaaagcaaaaaaaaaataagttctctatattaaaatttccactgatcttatatccccttctctcactcagactctccctcctagctcttccccccacctctccctctccctcccccacccctggctctcctcctctcggcaaccacggcaggctagcaacggctgacgcggagcacctgatgcagacttggcacctgacgtggggctgcattggctttcgatctccggcgaaggggtaagtcctacgttcggccggccctaccaattgtatcgactacattggtattgttcaaagctacatcgcttcgacctcttggatcgctctggtttggttggtatacttgcatacatatttatcatatatcttagtaatctagttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcgcccgcgagtccactccgccggcttgtcctcgccaccgccattgctgatagcaacaacgacttcaccgccggcttgcttccgtcgccgccgaccggtgtcatcgcctatacggttggtcggtcacaccaccgttcatgggcgtccatgtcttcaccgaccggctggccttcgccgccgccgactggtgtttccgcctgcacggctggcctattatgccgccgccgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatcctcaccgttggctcaccttcgctgccgtcgactggtgtttccgcctacacggctggcctattatgccgccgctgttgggcgtctacgtcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgaagaactcatgtcactcatatgcatgtttgggaagtgcttaggccgactcccagtgcttggtggctatgactagttgggcagagcgtttaaacgtaatgagtcatctgctccgggaaatcaaaattgacaagaggagaaatacatatttataaatattttaaaatacttgattttttctcgagtattatatttatat

SEQ ID NO: 24762 - DNA, 8107 bp, Oryza sativa
tcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcaacttcatctttattatcttcggcactggcaaactctattgctgctacttcgcaagttttactacttcaccaaccacgacgtctttgtgagcctcgacatctcggcatgcgatgccatgttattttactacaacaagaggctctccaatattcaggatttctacttatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcagccaatgagtcaactccaggagtcattatcttcatctttgcttcggaacagacattctacttcaaatatttcggtttgaacgagttggacaacaacatcaactctcctccaagtgaagcatctacaacagctataacattaatttgatggattattgtcactgacatcatcaccagcacctttgcttcatcgcccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgccgccgactattttcttcatcttcatgattggtggatttcgtcatcgcctttgatgcgtgtctacatcttcaccgtcggcttgctttcgtcaccaccgaccggtatcctcgccttcatggatggcttattatgttgccactaatgggcatcttcatcttcttcaccaactgcatcgtctgtcaccgactgattatttcgctgccatggctacacaactttatcgctgggcgctttcatcttcattgctggctgacctgactgttgccgactggtttcttcgcctccatgggtatgcaacttcattacctttgattggtgtcactgtttttactaccactgacatcttccgttacttctgatgagcaatttcgtcttcatgttggtcatttcatctccatgccgactgcgtcagctattgccaatatacaattttgactatgacagaaggacaagctatatgctcaggggctcatcaactcaagcgtgaggattatatctccaatttggacttgttccggatacatcccacatggattcaaagtcatgagtctattttctatgctcaaagactggaccaattattattccccgtaagggctatcaaccgaatacttgcgccagtcgggattcaattattatatttattttagagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatatttttaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttccttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacaagcattttcggttaaataatttttattggcatctattgctgtcagtagtgaagacagcaacggtagagcctggccgcctgggcaatcgtccgacctacccggaagccggctccatcagttcttgggaatgcaggaaatttaaaaaactattttagcataatttatttcaaatatttcaaatttcctccaatcttaaagaggtctctaaatgtgtttataaaacttagggcatgtatctggttttctttgtttatacaaaactattaaaaaatattttcggttattggcaagaaccagttaatatattttggcaagggaaactcaagaaaaatcacaccaagccatttccacttattagatagagtttttaattagggattcattctaggttaacttaaacaatttcgtttggtgatttattaaatgcattaaggctaggaaagggaaacttcatggtgtgatagttaccgaatagaagcaggccacggttagctcatttaaatcaacacacatacaagatggaccaaaaacatggggagacaatgatttttttttccgaaattcagattacagggatctactctcattgagcagctccagagagctaggtctcaattaactccttgcctcacttgacaaacaactaggaagaagtatttagcctccaagcaaccacctaggtttccctcgattttaagcgaccaccaagatcatagctttaacaacgagttccaaccaccggtgaagcttgctctacaaagataacttcctagcaaccacctcgaaattcattcaaagttacctcttttccttttgaagatgaggtccaccctcaaaaacttgccacagaaaatccacaccttgaggaagcaatccacaccttgaggaagctcgcggattattcctaatcatctaggaggtcagtctccaagagcaataagcacaaagcagttgaccgatgatgatccccaagttctcaagttctcctagctcgctcagaaacataaatcctcaccaccatccatgcaagcactctcaaatcaccttgagagctcaagaaaccctacaagaagctaggagacagaaaaacaaaagtggaatggccaaagttgcactagagaggaaggtgagattatatacccactcccttatgtaatgtagctgttactcacataattgaacttgaaatatgccccaaagttctagccataagtgccaagaacttgttagcacttaggcattggctgaaaaataggggctcggaagttccggcccaaaccactaggaacttctggcccacacaatccgttgacacaactgtatctctcatctagaaggattgaacttcgggaactttgatatagatgcaagaaaccatttggtatcctctggtagtacgacttttctaaactcaagaccaaaagatacaaaataaataaataaataacacttcgagtcctcacgacgctttgcattctatttacagggtgactccatgtaagagtaaacaccctaggactaattatcttcacacttcttgataaatcattggttccttaaccattttgtcaatagcccaccaaaactcgcttcggagactagatacactttcaccaggcaatgccaatggcctagggatgacatggttggtgtggcggagaggaggttgccgaccgatccacaacaacggtggcctagagatgatggggccggcgtgctatggctttggctgcaaggcgaagtgctggagtgcaatgcttggggataaagctcaccatgacatcgatggagcccgcctgcagccgtcgagcatgagcgatgccactcaggtcctctgccccttggcctgcttgaacatggcagtggcacagtagcaatgacatttccttctctctctccacttcgctgtcttgttcatttacactgctgcgataccaccgctgatggtgctagatccaccatcaccgtgagacctcgatgtcgcagctgcaagatttcaactatcgaatctatgccacaacttttgtagttgtgtcactgcataacctaggagagtagtcgctatcctaggaagggcccttctcctccttccgaagcttcaccaggttctgatgagctctgttgccgcccatctacacgggaagtcggcaatgtgatctctagcccaatagctccttcgttccctctgccttgagatggccaaggacgctgctggctacggaaccaactgcaaccacaaggccactgtccatcggcccaagtttgtgatttggtttgttatgtgagggcactttgggtatttagaaaaaatggatagggttaactgatggcgatggtatttcttagataaatttgtttgtatgatgatatttttctatagttgatatttgttaatggcaaaacatagaataagatgtgcatttatatatatatatatatctcctgaaagattatacagacgataatatgtgaattgtatattaaataactagtttgtactctatatatctaagtactgtagcctgccattattttgttccttttgtaagttgccccactttgccagagcatccaacatcagatcatcaaaaatacatttgtctgtacgaccacgccgtacccaaagtgcgagtcgtctaatatcttgacccaataattgatgcaggcagctagttattgtagtgttcagcttctctctgtttgttgcttacacacaacttgaactagagtatgggatatcaacggtcacataattaatgtgtggtccctagtacgacttgattaactaattaatactacctccgtcctaaaattagtgcagccgtgggtatacatatcgtttgaccgtccgtcttatttgaaaaatttgtgaagaaattaaaaataataatcacacataaagtattattcatattttatcatctaataacaacaaaaatactaattataaaaaaagtaaataagataaacggtcaaatgtcggataagaacaatataaaactatacccctccgtacttataaaagaagtcgtttagaacaatgtttaagtcaaaccttgggaatataaatcatgaataacttttaagttgttgagtttaaaaatgtaaaaattatatgaatagatttgtcttgaaaaatactttcataaaagtatacatatatcacttttcaataaatatttttatagaaacaagaagtcaaagttgtgttttggagactgtgtcgctgtcctaaacgattttctttaagagtacggagggagtacttattttggaacggagggagtacatgtcataactaagttataaaatagtgtacagccattgcaaagcagttcagctgatgtgattatgttaagtgatgagtttggtccaacacatatatattatgctactctctggttcatatcatagtttgtatatattatatatgccatatataataatttctcatttcaataattttttcaagtgtgagcaccaaccatcaacagggaacaaataaaaagatttccaagatagacacaggcagacagcacagccacgagcacatatatatgtgtgaatggtttaggcttggcgaaaaacaaacttatagaagcatgcatgggcaccacgtgagattctctttttttgaagttcctttttttttttttgaaattcaccacgtgagattcgaattcgctaccaaattaacggtgtgagcagaaagaatttaaagaagcaatacgcgcggcatgcattcttgcatatgcatgcatgtgtgttgtgtgtgtatgtatatatgggtggtcgcatttcagcgtcaagaacataatcccgttagccgatccgatcgatctctaccagacatatatgcatgcctgcctgccagcaactaaggctatgtttaggaagtttaaagatttaaaaaacagctggtaacaatctggagaagagcttttaatttattttctgaattctacaactactatttttcataatctaagtaaaattctggactgagtttctagcggtaatagcttctagaagaatctcctgctgttagaaactcctccaaaaagaccctaagtgtcatctgtcattttgcttgatattaggccatcgttaattattaacgatttgttcttttctgattaaggaattaattagtcgatccgtgcacaccaatgcaaagtggttgtatacttgtgttagccagctagctagtcctgtagcttattagctgcatgcatgtatacagtactccctccgtcctaaaatatatctcctccgattcacaatataagtcattttagcattttctatatttatattgatgttaatgaatctagacatatatatctatctaaattcattaacattaatataaatgtgggaaatactagaatgacttacattgtgaaacggagggagtaagtatttttagacttcgacatagtcttcgagatgttactttgaccaacgatatatataaaagtaaaatgttttaaataaaaagagttatatattatgatagtttatttaatgataaatctagtaatatcaattttacatgattgatctttttaatttttttttgctattaatagtcaaagttacgaatatttgacttggtattatgctaaaagtgtttatatttttagacgaatatatatatatatatatatatatatatatatatatatgtgtccacgcatggtcgacagtaatctgatcacgagctagcacggtacgtaacgtaggatgtgtaatcattcattcgatcagttcgtgtcgggtggggctaaatttgttcggaacttcggatcaaatctgctggtgcatggcatgcatgat

SEQ ID NO: 24763 - DNA, 3423 bp, Oryza sativa
  unsure (1)..(3423): unsure at all n locations
tctcgcgtatatcctagtaccaacgatccccatactatgcaaataccggaatcgcgacatcaaacgtcgatagttgtcaatggtggtaaaaatttaataagtagtcccctctgaaactcatcatggtaacatatttgcatttagctcctctgctgtttatctctaacctaactcctctctactccatttattatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtacatgaggaagaagagagatgtatgggtggggaaaaatgtggtggaagagaaggaagaaggttagcagagactgacatgggtcccatttgtcatagacttataatggagatggtagatggagaggctgttggagcgagtaactagtttgactagctaaatcagatggagagttggttatatgggtgtttggagagtttgatatggagatgttgttggagatactctaaaagtacggtgagggtaggatgatgtgaagtacagtgagagtaaggtgtgtaggaaaaaaagagaggtgtgggtcatgtggcatcttttcgtcatcatcgccatggcaagtagatcgtcttttttttttttacttaatttcagttatgtttttcctacgtgggtattctctcttatatgttatgcaagtatgtttctatctcgtatcttctcttccaagcatgtatttcctccttcatattataagactttctagcattgcccacattcatatatatatatattaataaatctagatgtatatgtgtgcctagattcattaatatctatataaatgtgggaatgctagaaaatcttataacatgaaaggaaggtagtagtaaattactttcaatcctaattcatttgtacattgtgtgttagaaaaattacaatgcaaatattgttttatagcgtaagttttgaaatttactgtctaactataacactatacaacggcaggtaatttagagtctaaaacaatttgattattcttttagaaaaacatggatctataaatatatttataaaataatcatataataatgtattaggataggaggagaaaatgtactattctgttaaggtgattgagaatggtaaaatccatttccttctggtgagataatcccaaatttctactctgaaccccaaacgcataagccggcgaggcggcgagccggagaaggatgaatccgccggagctgatggacgccctcgtcgacgagatcttcttccgcttcccccccgacgagcccgcttgcttcgcccgcgcttccgctgtttgcaagcgctggcgccgcctcctctcggaccgggctttcttcttccgcagcagacgccgcgtgccgcttcccttgttgggtttcctccacaacctcgacaacgccgaccaccccgaccgctttgtccccaccaccgccctcccgatccccccgccgccacccgagctccactgcgggatggccctcgactgccgccatggctgcgccctcctcgacgcctacccctccaggatcgacctcgtcgtgtggcaccccatgacgggccacttgctgcggcggcttcnccgcccggacgtcccgtacctcttgtactacaacgccgcggtgctgtgcgccgccgccgccgccggctgcgaccacctcgactgccacgagggccccttccgcgtcgtcgtggtgggcaccgaggaggacacgaggcgtgggcgaccgtgtactcgtcggagtccgacgagtggagcccaccgacctccgctcgcctcgcccgaggacccgagttctgcgtcgagggcaagcccgccaccctcatcggagattcgctctacttcgccctcgtgtttggtatcggagtcgtcaagttcgacatgaagcgccatcgcctctccctcatcgatccgccggctgagctcgacgatggcttcgtgctcatgccgctggacaacgatggcgtgcttgggctcgcggccgtggaggatcacagcctcctctctgtgtggtcaatggatgtgagcctggatcatggacatggtgtggcaaattgggagaagtgcagggtcattgagctagacagtctgctaccaaatcttgatcactctaccccagtgctaccaattggatttgtggagggtgccaatatcatcttcctgagaacagatgcgggtgtcttcacacttgagctcagatcaatgcgtgtcaccaaggtgtgcaagaatgggttcttctacgctgtcgtgccgtacacgagcttctacattcctggtgtccatctccagcagcagcacagcggacctcagatcagtaatggccgggcatggggatcgcaggctgctaacatgaggcgtggcagcagtgagcagccgagagagcgtgctccactgcatcagcagcgacgggcaggacggccggtgaacagccaacgtcctactggtgatatggtccgttcttcaggccgtgctagcagattggcatctcaagtgcggcctccatggagaccctaatgattcgcaaggtggcaatagctgacaataatgtttaatctatcgtgcaatttacaggtggtatattgctaatcgtcggttttagtcatttgtgcgatcaagaagaatatcttatggttttgaatgcattgtcagtacagaatatctaaacatggaaagagcagattaactgagaggagtgagagctctatctcgtatccgctaactgaatttccagttataacatccaatttgtttatgggctttcccattgtcatactgcaagtctggtgaatgtttatttcaagcattgcacacacttttctttcttgactaaaaatattacattctccttatgaatcgtgctgctcgaaagggctctgaattgatccaaaaaaacgcaggttttttatggatggttgtatggaaccatgcatttaaatatgcagaatatgacaggctgaaactaacttagggaatccagtccatgtagactactgcagccaataacctaataatatttt

SEQ ID NO: 24764 - DNA, 1147 bp, Oryza sativa
caatgaagttgactcctgaagctgcatttcgtgcaacaatgggtaccattcagaactctgatatcatcattgtggtgtttcacaacatgaagcaagaagaattgcttgctctctagcatcctctggtttgtcaggcttctcaaggtaaatgaaaactagttctattctgagccttacaaatttaggcacatttactctctaggcaagaacatggacagatgtttgaaaaagaaacattatttaagcattatgtttttaaaagaaaaactttattctgttccttacgagctgtacatttatatcaacatggaaggaaatgaacagaatgttttcatcttgataaaaggagatgccagaaaacaaaacaggagttttcagtctcaattcatagaaatggtgggttttcttaggcgtttcttttggttgtcctaatcttcttttttgttacgctgcttgaaacctcggcagttgtcacttcattatcggatcatggtgaaaaacattctagttttaagatgaaatagagaagtagagttgcagacataaacatgatctgctcttacatcatcaccctgttaggacttaggagagcatagatttgtaccgcaaatactatcttattgagagctgcatagatggaacaaatgtgctcatgtacactgggtataggattgggcacaaatatatatggatatccttattgcatccttatcctataaggattagtaacaccttgacatgcattccgtgcaacttccaatgcatcccttcaggaaactctgatgatcatgatgatctgtcttgctggcacatgaagagctaccctcccaagtgacttgacagccaaggtacattgcttgctgtcctccatgttttgttcaggagacatcttgatctgaaatttttcccatgcatcagatgcacattatggagctggaaatcttattactaatagtcttgctcatttgaaggacaaaaacctccatgttctcatatgaagataactgactggacatagttaagaattgtgcagagtacaggtggttagcttaaattaagtactattgcactacagtacagctctgctctccaagagtaaaaacactctgttccaaaaggttagtatatagtttaataccaatgaaag

SEQ ID NO: 24765 - DNA, 682 bp, Oryza sativa
ggccaccaccgccgcccatgtccaggcacgggaactgcgcggtgtgcgcgatccgggcgtgctcggggcggtcgtcctcgtagagctccgcgcggtgggcgggcgcttgacgaccccgcgcttccgcgccggggcgacgagcacctggaggatgtggacgatggggctcccggagctccgcttgtagcggtacctcctggtcccggagaggaagacggcgatggcggcgagcatggcggcggagcagatgccgtaggcccagctccggccgacgtggtcctggacgtagacgagcacggtgacggcgagcagcgtgccgaggctgatgaagaagaagaagcggttgaagaagaggcccatggcggcgcgctcccggccgtcgcggtcgtcgaactggtcggtgccgaagccggagacgctggacttgaggccgccggtgccgagggcgatgaggtagaggcaggcgtagagcacggccatctgcaccggcgtcggctgctccccgggcggcgggcggaggtgggtgacgagggtggaggcggcgaggagggcggtgccgatggactggacgagggcgaagacggcgatggtgaggtagcggccgacgaaggagtcggcgaggaagccgccgaggaggcagaggaggaaggaggtgcccatgaagtcggtgacgacgttggcg

SEQ ID NO: 24766 - DNA, 504 bp, Oryza sativa
tgatataaagtagtatcggagtattagccgattcatgctagatctatctgatcggttatgctataaacatatatagtcctgttattaatatatatttcggtctaagtggtttatactgtctcggcatggcgaccgatctatcccaatcacttgatttaagtatatatcgatataaggagtatatatcgttaacatctacagccgatcaagtagatttagttctttcttacttattcaagattgccgatcgatacacatattacatcggctcagagataaatgatatgtcatcggcacttagccgatcggctatcatttatagatttaaccgcgatttctttgcttctacttcttgttggttacatgatcaaatcaactggcacgctagcacacccgtaggcgagctttggacctgcactggagttaagcagatcttccaggcctcgtgttttctgtcaacaggaaggaagacgactacattttttaaatagtagagataaaaat

SEQ ID NO: 24767 - DNA, 553 bp, Oryza sativa
  unsure (1)..(553): unsure at all n locations
nnnnnnnnnnnnnnnnnnnnnnnnnnnnnnnnccacttctgtgatgctaacttacacaggcattcacatcacaaataccagcaattcttgggacatcatatattacaaaagaaatcccagttatcagctaggtgaacatcaagctgggttggttggttgagacccttcaaaccaatctgatagccttctaggagcagttcttggtggagcactggaagaagcaagaactctcctcttttggggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttttttcttccagctcaagac

SEQ ID NO: 24768 - DNA, 7637 bp, Oryza sativa
ctgggattaaaacttgaacagtctatgctaggttttaggcttaagaaaaaaaattacaaaccttgctttgcgcaaaaagaacaaaagccatcctttgaattcctctgtcatgtgcaccattcttgtggtggcttgcaaagaacggttggtactcacccctgcaaatataaaattaatcagaaccaggagatgaagcctcgaaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattcctgttataaaaacgggggtccacagagctggtatcagagccatatgactgtaggaaaagaccaaaaggcgccccaccccttttctaagttggccaagggagaaattcccatttagtaatactttcaaaaataaaaacgctatatttacaaaactcggtacaattttcatcttactcttaactattttcttcacaaaacaagttttactctcaattgactttgggtttttcttaaaattagatggcagattcggattcacccgctacctgagagttgagcttacctcaatcagaggggtatgtcattgagctgcatcgtatgttgaggcgtctgcgatactctgggttcccgtcataccgagtgagacagtgtggctcactttgggaggctcgggtcgaggttcacccccgagtcccttccgagttggactacagctttcagacacgtcaccaccgagacctgccagataccgcgatgcaggatgcagcccgggaggccttcctccgactcagctctatccaccgagctgagttagtgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgaccaccagagacgtatgggagagctggagactgagttgactgacctctcagtgcagcagcttcagttggaggaggagcaccaggcttggggcagtgagatagacttactgaaggcacagctccaggtccacggcgaccagttccagcagttatctgaccagtacaacgatcgccgcgggatgatggatactcttgaggagcagctgagagagagtcaggagcacgtcagccagctggaggagcagcttcgagtagccaagatcagcaccacaggggcttctacttccacagcagtaggccgtgaccgctactttttcctcaccccgccgtacccaccggcgttccacgctcttctgggagaggctagtatgctagctaccgagtcagcaccttacatagtggacccgacagcagcacagccacctgtcccggagatggtgcacactccactgatccctacaccttctccgcagctgggttccagtttggagactccgatctaggtcgactccgagacagaggggaccgacaccgagccagagatcaagccagacatcactgatccttcagaggatgagacccctgttccccgcatcaccttccttggaggtcctcgcaccctcagcactactcgcaagagcacacgacctccgggcaagaggcccaagccagatccagaggccactacttctgagccgtggggactccggtttgcgcgtgccagcgaccaccctctacctgccccaggatcctgcggatggctggaggactagactgacggactccttgcagcttcgatctcgtatcagatggtttttggatagtatgcgagacacccccctcccttacctagattgacgagtagattgatgattagtttgatgtatcttttggatgaaccttatttggactgcgtatgtatgcagtcgattgcatcatgatttatgtgccatttgtgaaactctgtgatgttatttatgatatctattgttgctgtgttataaatgagtttattccaccatgcttgcaaaacaaagttcacatcaaaacaatctcccctaatgggataaagccgtaaaagatagctagagaattaggatacttactcaatcaatcaacctgcacagatggcaagccgacgtcgggcaacaaccagcaatgacgaaactcagacacccgacttagccactctggccggagttatggccacccaaactcaacttctgcaagctatcgcgaacaaccaaggcaaccgcggagggccaagctttggagagtttatgaggaccaagccacccacattcgccacagctgaagaacctatggatgctgaagattggttaaggatcattgagaagaagctaactcttattcgagtacgtgaggccgataaagtgatctttgcggcaaaccaattggaaggaccagccggagactggtgggacacgtacaaagaatcccgagaagaagatgctggagaaccaaactgggaggaatttaccacagcctttcgtgacaacttcgtgcctgccgcagtgatgcggatgaaaaagaatgagttcaggagactacggcaagggaataccacagtacaagagtacctgaaccatttcactcagctggcgcgctacgcgactagagatcttgccaacgaggaggaaaagatcgacaaattcattgaaggcttgaatgacgagttacgcgggcccatgattggacaagaccacgatagtttccagagtttaatcaataaggtcgttaggttggagaacgaccggaaggtcgtggagcacaatcgtaaaaggaggcttgccatgaaccgcccgcctcagaccgcaccccagcgtcctaaagggacaacctcctcggcatggagaccaacagtggtgacaaccagtcgacctgccgcctccagtaatttccacaggccggttaccattcagaaccgcgctcctgcaccgaatcaggccgccactggatcagtaaggccaggaagttgtttcaactgtggagagtatgggcatttcgccaataaatgtcctcatccgaacaagacacccattcgcaccggagctaatgcaacggctattcacgggactgctacccctgctgctggacgaggtctattcaggactccgcagactaacaggaccgctaccgaatttggacgcgggcaagtgaaccacgttcgagctgaagaggcccaggaagaccaaggcgtactgatgggtatgttttgactcaactccactccagttaaagttctcttcgattcaggagcatcgcattcatttatatctttgaaagcaagtcaacaacacaatttaatcagagttaaactaagacaaccaatgttagtacattcacctgggggtgagatagcagtggatacagcttgcattgacgtacccatccgccttcgggatgtggtatttccctccaatcttatggtgctaataccccaaactcttgatgtcattctgggtatggattggttagcaaagcatagagggataattgactgtagacgtagagaagttaccctgaccacaccctggggatcggatatgagagcaaccatggatcaagatcctaggctaaccgaacgtgccggaggtatatttaccatgctacccctaaagggaatgcccgtagtgcagcgatttcctgatgtgttcccagaagatttacctggaatgccaccagatcgagacacagagttcattattgacctgatacccggaactgcccccatatccaagagaccatatcggatgccggtcaatgagttggatgaacttaaaaagcaaattagggagttgcaagaaaagggatttgtacgccccagttcgtcaccttggggagccccagtgctattcgtcaagaagaaagatggtagcatgagaatgtgtgtggactaccgctcactgaacgaagtaactatcaaaaacaagtatccactaccacggattgatgatctttttgatcaactcaaaggagctaaggtgttctctaagattgaccatcggtcaggataccaccaattgaaaattagaaccggggacatacccaaaactgcgttctcaacacgctatggattatatgagttcaccgtaatgtcgtttggtttaaccaacgctccggcatactttatgaatcttatgaacaaagtgttcatggactacttggacaaatttgtggtggtattcatcgatgatattctaatctactccaaagatgaggaagaacatgcggaacacttgcgattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacagaatggaaagcacccaaatctgtgactgaaattcggagttttctaggcttggctggatactaccgacggttcattgaagggttctctaagatagcccgaccaatgacacaactactcaagaaggaaaagaagtttgtgtggtcagaacagtgtcaggaaagctttgagcagctcaaagaaaagctgacctcggcgcctattttagttcttcccgacatcaggaaagacttcgttatatattgtgatgcgtcaaggcaaggactaggaggagtactgatgcaggacggaaaagttgtggcctatgcgtcgcgacaattgcaaccacatgaggaaaactaccctacccgtgacctagaactcgcagctgtggttcatgcgctaaagatttggagacattatctgattggaaaccattgcgatatctacactgaccacaagagtctaaagtatatcttcacccagtcagatctcaacttgaggcaaaggcgatggttagaattaatcaaggactatgatctagaagttcactatcacccaggcaaagcaaacgttgtggccgacgctctgagtcgtaagagccattgcaatcatctgagaatggaagggatgatccctgagcttagggaggagatagctcagctgaacctacatatagtacctcgtggacagataaacaccctggacattcaacctcttttgagaacccaaatagaagaagcccagaaggacaacgaggaagtccgagaggtgaaggaacgcttagctacaggacgtgcaaaggaattttcaaccgacgaaaaagatgttctatggtataaaaagagaatttacgtacccgaacagggtggactgaggggattaattttaaaggaagctcacgaatcggcatattcattgcaccccggaagtaccaagatgtaccaagatctgaaggaaggatactggtggcccaacatgaaaagagatgtggcggaatacatagcactctgtgacgtgtgccaaaaggtgaaggctgagcatcaccgaccggtaggcttgctgcaaccccttaggattcccgaatggaaatgggatgagataggtatggattttattgttggattgcccaaaaccgcaacaggatatgattccatttgggtgatcgtggatcgactcaccaagacggcgagattcattcccgttaagacaaattatagcagtgctaagctagccgagttatacatgaccaggatagtatgtcttcatggtgtacctaagaaaattacatctgatcggggcacacagtttacctcacatttctgggagaaagtccatgaagccctaggaagttacctcgcatttagcacagcttatcatccacagacagatggccagacagagagaaccaaccaggtcctggaggaaatgctgagggcttgtgctctggattttagcaaggactgggagagatgtttgccctacgccgaattctcctacaacaacagctttcaagcaagcctaaagatgtcacccaatgaggcattgtttggtcgacgatgtcgtaccctgctaatgtggtccgagactggagaacaggcggtatttggacctgacattattcaagaagccgaagaaaaggttcgcttgatccgtgaccgtctaaaagtagcacaatcatgataaaagagttacgccgacacccaaagaagaaacctggaatttaaggagggagattacgtttatctaaaggtttctccgatgaggggaacaaaaaggtttaaggtcaaaggaaaactggcaccaagatatgtgggaccattccagatcatcgccaggcgaggagaagttgcatatcagctacagttaccagagaatatcgcggatgtgcacccagtcttccatgtgtctaagctaaagaaatgtttacgagtgccggaagagcaagctccgctggaagagtcacattagcaaggatctcacatatccagaacacccgatccggatattggatgaagccgaaaagaggactaagagcaaagtgtggcgtatgtacaaggtacaatggagcaatcacactgaggatgaagccacctgggaaaccgaagaattcttgagtacggagtacccgcatctattcgaaaactggtaagaaatctcgggacgagatttatttaaggggggtaggtttgtaacaccctgaaaatttgaccgacaaaatcaaaactataaaaatacggattttcaaaaactttttaaactaattgcatcatgctgatcttattcgtctattttatctggatttgatctcgaagattattaatcgtgagtaaagaatagttaattaggaataaaccttaaaaacaaattggtaaaataaatacaaattaaaataaagattaggtggggatagaaataaataaaatattatcgcaaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaatcgtggaatcaaatttatatggaaaatacactaaaatcgggttaattagaaatcggcactgttcattgcacctaaggtgttcgacggggtcccctaacccagctccttcttttttccccctctctctgtcgccatcccgtcgccgcgtgcgcgttccatcgccgcctcgagccttgccgctgccgcgccgcgagcccgcgccgcgccacgccgcgtcgtcctatcgttgctgtcacgccgtgccgtcgtgtcgccgcccatcgcatcccgccccgagccgcgcgccaccgctgtcgccgtcgccatcgatgtcccgtcgccgcgcgcgtcccatcgccgctgccgccgctgataccgcgccgcgccggccgttccatcgcctcgcgccgtcgccgttcggccgtcgcgtcgccgatgccagtcctcgcgccccgcgccctgccgcgccgcgttgt

SEQ ID NO: 24769 - DNA, 17262 bp, Oryza sativa
  unsure (1)..(17262): unsure at all n locations
nnnnnnnnnnnnnnnnnnnnnnnnnnnnnnnnnagaggagagaaaaaggagagaaaaagaaagagagggagagaaaagagagaaaaagaaagagaggagagaaaaagagggaaaatagaaaagaagaaacggagaaaatagaagggaaattgggggagaaattaggaggatttaggaaataaaaatggtcggggttaatcatagattattttcggaaattcctcgagcgtaatagtatttcggtcgaaattccgagttaattataaaaatatgtttcttaaacagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactgaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgatgaacatcctacttgtgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgcacttctcatatgggtatagacctagcggattagatagccgaacggaggcagtatccctgcatagatggttcacccctgagtgaggcaggtgcgctatggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgttagaaacatggacgcctagagtgcatgaggatttaagttcatggagcgggtactaccaatgcgaggttatcgaaaagctttgcggtgacgcgtctcatgtgttgggacgagactcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgagggagtcacttcccgagaggagggaaggtggacatcctcagaaaaccatgacgattcaatggcgggaagctatccttgggatcacaatggatggtggatagaaccgtcattgtttaatatgaacactggtattaaaacttgaacagtctatgctaggtcttaggcttgagaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgccggtggcaatggcatgccgctgcttgaattccgctgccttatctatttctgcttttgggctgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattccagttataaaaacgggggtccacagaatactacatattcagtaatgcacagcaggtcattttgtgatggatcaacattactgtcgatgctaggaatccgcaatatgaaaagggtgtagcgcatgagaactaaagtacgtgagttggatgacaaaagatttatacaagtttacgaccttatcgagaggtaatatcatactcatgatgttaagggatttgtatatatgaggtgctgtatctcttcttcctatatagttggtacccactagagaagttattactataaagtttgcaccacgttgcgccacatcatcatttattttcagccgttggattggactgcatgtttccagatgaacgatgttgatatcttgggccaacttcccatcattttttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttggacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataaggctgtgaaaggctgaaaaaattttatgagataataaagaatatatactcagatacatcgactagatacaccttattaggtgtagccctccgactatatggttagttggacaaactaagtatatagtcaaggaataaataatctaaccaaacaagtggtttttgataattatagtcaaccaagtgacttaatactaatatatagcataggcggtatgaatcctcaaacaacatgatccgagtgatatacctactacttattaaaaagtataatgtgcatagccaaaagccaactgcatctttaaaagtcacatagtaaatgatttaataaaaagcctttatgcagtgagtaaaggaattttctatggttgttcacattgtgcgcatattgccaggacaaatatgtttatgtccctataagacacacaacatcgccacagccaaaaatatatggcatttgtagtgtaaaatccaagtaaaataacactaacgaatggatttaccaactgcctgaaaatgaccaagatatattattagactacaaccataatattggtcttttagaaaaatgcacacataagtggccgaaagcaatgataaactaacatcaatcaattgctttataaaaagcaaacatcgtcttaacaaccatacgtaaagctttacttttgccaccttttaaattgtattgtgccaactactgaaaagttgtgtatcagatatataaaaagatttaaggtatatattagacacttgagcacgcatgtattgccaagagcaaaaatgcttaatccctaaaggtacatgacagaacacaactgaaaatatagtccgtgaactcttgatgggccgtggcccgataattccacggatcgataccctaaaatataaaactgactaatgaggcctccacaaactgcccacagccacaagctgtctgttgcactgttcagcctaacgaggcctcgacacagaaaaaaaaaagaaaaataattaaaacgcacaggtataattgctagtagtaaataaattacaataaatcaattctaaaccattatcggtaccaatcaacatatatacacccctagaatgacacgtcgctgccacattcgcagtgccgccttttatgaaacattccagagggattatgcaggtcgagatacgtcggtccatcaaagcaagcgacgaacaagtcagtactccctccgtcaagtttacttttcatgcactaatctcacacgtaacaataatacgaaaccaataaaatactgcaatactactattttatcaaatcataatacaactatttctcactttatctacttctattattattattattatttacttttacaaactccgatacaataattatctttaaaaaaattatttaggataaatgagaggagcctaaaaatatggccccattcaaaacaaagaaaaaaacataggaattccaaaggattttatatcctatgggatataatcctgcgtgaccttttgaaacgaagtattgattcataccaatttatttggaattcctatggaatggattattgtagaggaattttggaggaaaattagcatgaggcactactacaaaaaggacatgtagagacatcccgtaagagacggttaagcaagtcgtccctattaaagcccatctcctacattgcctcttacgtagatacactaattagagacaggataatagaccgtctctacgatcacattaatctatttggtaaattttgaagttgactgagagaaaaaataaatcctagacatggccgtctctacatcacataaaaaccgtctctaggggctgcttctactgcagtgaggtcttacctcatattttcttcttcctatgtcttgaattcctatattttccttgtgtgactatatgcaaacggtagttttgaaactttcccgtgttttcgaatcccgtatatgaatctaatgaatatggcattctattcttatatttcttctattcccatgttttgataatcgtatatttgaaagggacggaggaagtagctagctagcttaattaatttggtcacgtgtagggtaatacacttccaagagaacatccacttcacaagagatctcctactttcgttggccctagctagcttagctggaaatgttagaccatatattgcggaggttttaggattatacgatgttgatgtaggagtattctagaagtccacgagtataccttctgtcttaaaaaaaaagataattctacctataaatttagatatatggttaaaaattcgtttttttaagacggaatagtaagtatatgcatatcgctacttttgcaatagaactaacttctcgctgcacactaaggccctgtttgggagaacttgtcctagctgcagcttttttctaaagctgcttctgctagaaaatgccccaaacagtccatagtttctgagaatctgtagttatagattctgaaaaatgaactaagaagtcagaagctggagaagctggatttcaaagcttttccaaattcttaaaagctagctactaaatagctgtttctcagaatctaaacctccctaatcaggccctaattctaggcgtgggcggaccgcatgcagcagagctagctcgatcgatcggcaacagctgcaccccatccaagccgtcgatctgtatgacgacaaaaatatacaaaatcgatcagatataacagctgatgatcgatctgttttttttttttttgaacatcgatctgttaggatgaaaattaaacagctcagaccctgtcgaaacaccggttggatctacttggatgacctgcatatcgaccaaacgaaaggtagaagtcaaatttgtatgtatgaccgtcctatatatagtgtggactggggaggacgaagatggttttcactagagttttattatgaatactgatttccgttagatatttaatttgcaggagatattttgtcctagacccgtactatgtttgttcaaatgacattttgccttagaaactggatggcgactctcatgcttattgatactattatctatatatctattatattattaggatagttgggttaataattctcacattaattaaagataaaaaaagattttaagtagaaatataatttaaaaataactgaaacccgaaattaaaaataagcaatattgaaagaaagagtccatatcaaaatctaaaataaaattaattaaaattcaaaataaacattcgctgtgccgacttgtattaaacattccagaaggattatgcaggtcgagactcgagatacgtcggcccgtcaaagcgagcgacggacaagtcagtactccgtccgtcaagtttacttttcatgcactactctcacacgtgacaatacgaaaccaatacaagtctgaaataccactattttatcaaatcgtaatacaactattttttactttatcttcttctgatacaattattctttactttcacaaactccgataccataattattttaaaataaatttattttggataaatgagaggagcctaaaaatatggcgcgctttgaaacaaagaaaaaacatagtatttccaatggatttatatcctatggaaaataatactataagacccttggaaacaaaatattgattcttatcaattcaagattcctatggaattttggaggaaaattagtacgacgtcttacctcatatcttcttcttcatgtgtcttgaattcctcatttttcccgcgtaactatcaaatggtagttttgaaactttcatatgttttcaaatcccataggaatccaatgaacattacattttattcctacattttttctatttctgtttttgacaatctagcgtttcaaaggaacggagaaagtagctagctagcttaatttggtcacgtgtagggtaagagtatatcggatacactccaagaggccatccacttcactaatttggtcacgtgtagggtaagtaagatctcctactttcgttggccctagctagcttagctggaaatgacttactacctccaattccaaaataagtacagccgttggtatccgtatccaacgtttgactatctgtattatttgaaaaatttatgaaaaaatttaaaataattagtcacacaaagtattattcatattttattatctagtaacaataaaaatattaatcataaaaaatttttaaataagacaaacggtcaaatgttggacattatcgatataaaactgtacttattttgggacggagggagttgaccatattgcggaggttaggctagaattggatgttcatgtaggagtacgctacgaagtaactccccccgtctcataaaaacaaatctaagattggatgtgacatattttagtattacgaatctgtacatatagaagtatgtgttacatctgatattaattagttttctatgagacggatggagatgcatatcactactagaacttgttcttaaaaaaaaaaaggaagagtagagctaacttctcgctgcacattaattctaggcgtgggcggaccgcatgcagcagagctagctcgatcggcaacagctgcaccccatgcaagccgtcgatctgtatgacgacaaaaatatacaaattaatcgatcagatagcagctgaggcgttgattaaacagctgatgatcgatctgttaggatgacaattaaacagctcagaccctgtccaaacaccgcttggatctacttggatgacctgcatatcgaccaaacgaaaggtagaagccaaatttgtgatatatatatgtatgactgttctatatatagtgtggactggggaggagtggaggacgacgatggttttcactagagttttattatgaatactgatttcagttagatattttgccctagacccgtactatgtttgttcaaaagatattttgccttaaacactactccagatgacgacactcatgcttgttgatactattatctctatgtagtatactattaagaaaattataaaagtaggtatcacgatagttattggggctacaaattcccacattaattggagataaaaaaaaatagaagattttaagtaggaataaaatttaaaaataactgaaattcgaaattaaaaatatgtaattatcaaataaagagtccatataagaacccaatacaatattaattaaaattcaaaataaaaaataaaataagatctgaaattaaaaactaagagagttcaagtaagaatatagttttgaaacaactgaaattgaaaaataaaaaattaggaattttgaaagaatactccatatacagcacaatacaagattaattaaaatttgaaaaaaaataattaaaaaaggaaaatagaaatacagtttataaatactgacattcgtaataaagagaagataccatctgtaacacatgacgagattattaaaattgggaataacgaataaaatagtttccaaaaatataaaaataatataagagttcaagtgggaatattatttttaaataaaaaatattggaatgagaatatgaaattttaagaaaacaagttcatctagaacacaacgatgacaaatcacaataaagaggggagaagcaacacgctcgcagtgggtgttagaaattcccacattaattggagaaaaagaaaaatagaagaagagtttaagtagaaatataatttaaaaataattgaatatcagaaataaaaataagcaatatttaaagaagaaaccatataagaacccaatacgagattaattaaaatttaaaataaaaaataaaataaaatccattagaaaaatgattataaaagttcaactagaaatataatttataaataactaaattttgtaataaaaataaagattgtcaaaaaaagacaatctagaacccatgatgagattaattaaaatttaaaataagaaataaaataaattccaaaatagaaaaataaatataagagttcaagaaaaaaaataatataatttataaataaaaatattggaataaaaatatggaattttcaaaaaataatcatctggaacacaacgatgacaaatgacaataaagaggagagaagcatcatgcctgtagaggagtagagtggtggcggttaatgggttatctgaaaattattagcaaaacctcaaatagaattccaataatgattaaaaggagagacggcagatatgtcgttaagcagtacagtcatggcgattgcgggacttctgaaatgtaaaaaataaaccccaacaaatatcatgtttgatttttaaaatctcaatggcaataaagaggggaggcaggtaagtcgtaaaagagtaaagtggcaaagacgctgacggtttggcgagatttctagaaaaataaaaaatgaacccaaattattattatgtttgattcttaaaatcccaatgataacaaagagaaggaagcggatgggctgtagaggagtatagtgacagcatttggcgagacttctagaaataatgaaaacgaaacccaatgacaaaataaactcaaaaactacgatgttcaatttttaaaggttataagaaaaatgaatagaagcagtggtagaccgagcaagcaaataaaacaaggggtcacaaagaagcaaggaatagcaaccagcgtggcatttaaaaactgtaaattaattttacaaacatgagcattataagatttgttctttcgatgtcttaagataacgagttagctatttaacaaattataaataaaaatataaaaaatatataattttgtatgtgtgctagccgtgtaattgcgggggccacctagttgtattaaagcactctacttttcaagccccagatggaacgtactgtttctctaagagaaatcaagtcaaagtcagttagaaatcaagtcaaagtcagttagaagacacgacaacagacctggagtaacgtactactgtactgtactccctccgtctcagaatatagcaacctagaaccggattagacatatcctagtactataaatttagacatgagacatgtccagattcgtagtactagaatacgttccatccggttttagattgctatattttgggagggagtactaaagtcaaagtcaattcaattcttgatcgactcgtcgtgagctttacgtacactaattatttcacacgtgtgccatgccagcttcgttttccagtcgtgttacgttttacaactccacagagttaggaaacaaaattttaatatttgtgacaactgtaaaacaaaattttcataactgtcaatacaaatttgtgatgaatatatcagtagtacataaaccatttctacaaacggtcaaaagcgatctttgcatacggccatcccaaccaaccaaaaggtctgcgaaaatattttttttttcatgtggccaaccgcatgccaaaattccatttttttcacgcggtttcctataccggctgcatacaaaaataaattcggcgagaaaaaataaaaataaaaatagaaaccgggtgaacctaggcccgccaccatcgtcattcggatccgccgcccgccgccatcgtcgttagtgccatcggatccgatggtcccacctccctctgttgtgtcaccagcactagatccacacgagaaagacccccggtgctagatccacgcggccgagaacgggccgtcgccgcccgttcccggtcgccgccgtcgtcgtcggtgccagatccgcgaggggacgagccgctgccgccagctcctggttgccggcacctgacgctgttgccgaatccatgtggggtggccccactcccagccgccttgtcgatgctgctcgccgctttcggccgcctgctcccggttgcccactgtcatcgtcggatccacgcgcgccgcctgccgccgagcgccaaaccccccgccgcctcgcaccgagctgctacctagggcagcagatccggccctcccgagggtggcgttgccaaatctgccgctgccgcccggcgacggcgcgtcgccgcagccactcctggtgcccgctgtcatcgtagccgcacctactcctacccctctcggccgttggctcctactcggatagagagagagaagagagagagcagacgagagagaggaaagtaaataattaggagaggagaggagaggagttcaaaaaataaataaatgatgagagggaaaagagagtggagggagataaaaaaaatatgtaaagggatgatatttttcatgcggatcacttaagaggtccccttttcgcatatgtcctcttaagaggaccgcatgagaaaataggcttatttttgcatgaggctccttaatagacccgcatgcaaagagaaaattgattttggcatgcaggtcttataaagagctactcccttcatttcatattataagaatttgtaatattgcctacattcatatagatgttaatgaatctaaacacatatatacgtctagattcattaatatatttatttgtacggacaatgctagaaagccttaattataatatgaaacggaagaagtatatgcgaaaatgaagatcagtttttgcagatgtcgccagttacgtacggtctctttgcaatctaaagggcttcttgtaaaaaaataatcgtttttatagtgtattgggatgaatttctagtggaaacagtacgggacaattagaaacgtacgctataggaattgaaacttcagattgaaaatcggaaaccgcgcgctatgatcaggaattcccgtattgtttttcacgttatagcatcacccacacaatagcctatagaaacctggatataggatgatccaatgagaattgaaaaccacagctcatgtgctctttaatgtaaaatccgaagaagtattcatccgagaagcgcgcttattagcttttttattacaacaggtgctcttttctaaatatagttcacatattgctaccaattgttataaataataaaataaagttgtcgctgaattgtgacaaagaaaataccgatcaatgtttcattcatatttccaattatcaactgtgctctaatttgtttatcctaaataaaagggaatagcacccctgattatcaatatgtatcaaaggtgaaagactaaattaagtacatatcgggacaaaaattccatatttgttcctaaacactcacatattcgtgaacgcacagcaggtcatttgtgatggatcaatattaccgatttcaaatggctaatatctaacggacggatctaaaagtagcccgtacgtttgatatatgcatatgtggataccagtcatagaagattagaagtgaatccatctataatgggtgttagttgtgacccgtcatcaaagatgacaggacatttctaacaagtgtggtagctacagatagggctgtcaatctgtttgagtttgatttgttacagcttaatttgagcacgactcgaatgctacagacaagccaaacttaagcataggttgaggttcgcaaacctagtgagctcgagctcgaatagcttggtagggtttgattagcacaggatgcattgcatgtagaaagatatttttatgggtcaatatatacttgtcatcgtgcttgacctactcaagtctcaagaccttatcaatgcttttcaataaagctattatctgtctgctagtaataatactactgttcctagtagatgtagacatgtagtagctagctttttttaatttcaacgttttaaaaccatgaattcatgagagaagctgcaggcttcattcaagacaaaaggcaccaatttagttttgactaccgatagtttgtattgatatcttttatacaagaggaagttttggaattacaccaagtaggctcaaagctcaatcgggaaagatcgtagatttatggttagtgatgcgtgaccacgactagatacctagtaaaatttaaaattcttttagggatttttggtgtctttaaaattaaaaaaaatcatgactagtagtgacggtacataacttatacgtatagatgacttatggaatccatcatagataaggttttctttgtcactgacaaatgagaatagatgggacatatacccgttacagatgtgggttaccgcccatcatatatgaggggttccgttgtaatgaaactacgtgatcttggtttgaaattcacttgtgaaatcatttagtaatactttgcaaactctcaacatgatccgtactttatctttagactacaccagtcaagttttgataatgtggcagctgggtggtgaagtatagttagtcaaaaaagtgataaagtcattatgaaatcactaataaataaaaaaagtaaatccatattaacttggttttttttaagagtctctttgtttaggcttagacttattattggcttcggtttttaagtcagtttttttggtttatataacttataagccaatggatataaagtattaagtttaatggtgtggttatacatgtaccgcacataagataaaaaaacttctccaacctagcctttggattaatagtgtatgagtgacttatgacttaaacaaaaaccaaacgaaaaggttgcttctttgcttagcttagacgtagtgtttagggtagaggttagcttcatttattgtgtgcttcacagaaagtgaggtaggcagcaggtggtgacagtcataatagagttcaaggccgaactcagcctgtcagtagactagggaagggccggtgcccaaagcattcgatagagttttaccttggttaaatccataggaatattctctgtcctaagcctatcatttagttgttgtccttggttaaatcctgttctgagatacacacgttccttctgttcgatacgcttggaatactcttgtgaatttatctgtgtgcgtaacaaataccaagagggggaaggggagggcaaggggaggaggcgacgagagaatgagcggtgagagagcgatgagacgaggtgcgcgggcatgagaggacaaggaagcgaggggcgtgagaggataaggatgcgaaaggagctggtttagctcgctcccaaccattggcgtgactcgaattttaagggtgctggatttttaacagaccggcacctaaaatatattatatattctggtttaaccgacacctataatatattaaagttgttggtatttttacaaaataagcacataaagtattggtccagttttctctggaactggtatacatagttggttaaaggtattggtttatatttttccatcctgtggaggtgggaaaatgtctatagatgttgtttttacaattttcggcacctataatttgtcccattggtgatgttctatattactagagcctcaacacgtgaacgccaacagaggctgaggaggacccgcgtgcccgcgaagatcgaggaggagctgcggtgactgcgagtttcatcacatcaaaggccgaggaggagccaagctcaccagcctccttgagagcaaaaaagcttgagacatcgccagtcttgtcgccgcctacacgcgaggttgggctccacctctgcgcaagctccaccgtcaggcatcgggcgagctcgtgtgggagagtgtcacaatggcagtatgcttattgtgctaacgagatggaggcacaaccggcgagcttgacgggccagccaccaccgcactcttgagctaggggagaagagggagagagaaggtggggaatgaggaagctaagatagagagaggtgagaggggagggaatctgataggttggtcccaccgattcttttttaaaaaagttgttgactacttgctgcctcgtaggaccaaaataagaatggatggagtcaaatggttatttgtctggctcgaatagttgactgtaaaatgtttggtatttaagttaggggtaattcggttgactgtgatagttcgggagtaattcggattttttccgctaattaatctatgtacgtaaagcttccgccttctctttcgtccgtccgatcccctccctcccaagcacctctgcttctgccttcgcctccccccctaccggcacctcccatctctcccttgctgcacattctcctgctcccccatggctcctgttctccttggcgcccctcctttcttgcctcccttccttctccccccccccaaatctcttcctcggtgcacgcgctccccctctcccacagcccctcttctccttggcaccccttctctcctgcctccctccctctcattgcactcgctcccgctttcccatggcccctctactccctggagcccctcctctcccctatgttcccttcctcttgagcgttcaaggaaaacaaaaaacttatgtccgtgaacacgttttgatgtactcacccggctgtgttcaccacaagagatcgtcgttgccgtttctctctctatgggaccatgccgttgctggtcgtgttcccgttgttctggttttcttcgttgccgatcaccatctatggataagtcacattgtgggacatgtctagctaccttactcaccgccgtttgattactggagcaccgtcgcccaccttccctcctcatatgttttttttgtttcgggtagggaagacaataaactatgttagtcgttgtttctctctctttcgttcttcctgcgtgttcaaggaaaaaggaatcccctcatccggtaacgcgttttgatgtatactcctccggtcatgttcatcaacagtgcttgccattgtcatttctctctctatcgggacacgttgttgcaggcctattcttgatgttctggttttcttcgttgccaccctctaccatctat

SEQ ID NO: 24770 - DNA, 5233 bp, Oryza sativa
aggcccggtacataaagtatggggactaaaaatagacatataaacgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagggcggcacgtgggctggcacggcacggcccggtgcgtcggtcgggccgtgccggcccgacaagcctcggcccaggcacggccgggcctgggccgtgccgtgccgggcggcccacatggccaactatagagtaatatagtgtgtcagtcactgtgcaatggccattttgaccgttctaccgctggtcttggtgatgctgctgcttccgttggctgcaattgcatccggcgacccaccatggcagcactactgcggaagcagcggcaactacacggccgggagcaaataccaggccaacctgcaggccctcgccgcgaccctcccgtcgaccgcgtcgtcttcctcccccgcactcttcgccaaggacgccgccggcggcggcgacgccgagcccgacagggtgttcgccctgaccctctgcagaggcgacaccgtcttcgccaacgcctcgtcgtcgtcgtgcgccgactgcgcctcccgcgccttccgcgacgcgcagagcgtgtgcccctacagcaaggaggtggccgtctactacgacccctgcctcctctacttctccggcgacgacttcctctcctctccggccaacccggcccaggtgaggctctacgacgtcgatcgctccacccggcgtggcggcggcggcgccgacttcgtcaccctcgtgagggcgctcctgagctacacgatgcagtgggccgtgccgtacaattccacgggcggcggggccgccgccgtgaggtggtacaccacggtgcggatggacgtcgtcacgccgccgctgttctcgctgatgcagtgcacgccggacatgtccggcggcgactgccggcagtgcctgcaggacctcgtcggcaacaccaccttcaacggctcggtctccggcgtgcgcaacatcggcgcccgttgcggttacaggtacgacacgtacaagttctacggcggggagcccaagctgaagatcgggtcactgtcggagatcaactcaacggcgccatcgagcccaccgccgcctccgccggtgacggagacacgttccggtatgtttggacagtcaccttttatatatactatatatactaggtgaaactatagttggtcccggtcttgcccgggccaagatttgccgggccggcccatgtgctccacctgtggaccaggcacggcccaataagggtcgggccgtgccggaccagcccgaaggcacggatagtccattgtgctttctttgaaataagtttgtttcccctccctcctctttaggttgtgacatatatataactaaaacaagtctatttaatgtccctacactttgggccgtgccaaataatacgtctatttatcctccctattctttgtgccttgtcttataggtggtttaaaataagtttatttcacctccctaaagtttgtgccgtgccagtccggcccaccgtgccaaggcataggcccaggcatggcccaacaaccgggccgtgccggcacgggcccgacagcgatcaggccatgccgtgcctgggccgggctgtcgggccttatggccaactataggtgaaaccccgtgcgttgctgtagaagtatactacgataacgataagtaaaagtaacatgtgttataggtgctagttttagataatctatagatgccggtttaaaaaaatcagacagccacgagccgagccgaaccaagccaacgccccaccacacgataaaaattacgccgctgcccgtatccactcccctcgctcacaaccaaatggggtattgaagttatttcatcatgtgtaatgagaatataaaataaaattatgagcaatgtataattatttttggagatgagatttccttgcagggagaaagaaggtgttgacagttgctttgcttgtgccactgatagcactttgccctgtcgtcatattctgttttgcatggataaggagattaagaaaccgtgagttatagaaatcaacttatcaaatctttaaattgtaatataattattgtttctgagttctgacagactactcttgtgttattagccttttaataacgtatttgttgctttagacaaatcaatgttgcgaaaaaaggatacaatggccagagaagaagtattaaagctttggagactagaagaaagcgattcagagtttatgctatttgatttctctcagatagaagatgctactagcaacttctcggaagataagaaacttggagaaggaggttttggctccgtatacaaggtaaaataaattagatatatacacacacataaaaatcttcaatacatgtttacttgaagtatgaactacttgaactttgtttgaaaaaaaatgcagggccaattgcccaatgggcttgaggtagcagttaagcgacttgctgcacattcaagtcaaggcctggttgagttcaaaaatgaaattcaacttattgcaaagctacaacataccaatttagtaaaccttcgaggatgttgcattcaaggagaagagaacttactaatatatgaatacatgccaaacaagagtttagacttcttcatctttggtatgcttatacattgtttttcaaaaaatgtggttattttctatatatatagcatcaaataaatagtaacatatatccttatacttcactatgcagatctgaaaagagcagcattgctcaactggaaaacacgcctgaacataatagaaggaataacacaagggcttttgtatctccacaaacactcccggttatgcatcatacatagagacttaaaagcaagcaatattctactagaccgtgacatgaatcctaaaatctctgactttgggttagctaagatatttgactcaaatgatgtccaaagaaatacaaaaagggtggtgggcacttagtaagagttaattcacctttcaaatttgttatttagctagtccaagtgatttagggataagctcattttactccctcaactatctggtttgtcttaaaaaacactacttaactctaccaaaccgaacacatacacccctcaacgtacaacctaagggcaatataacccagttctaatggtggtttccatgattttgaaatccaaattcttttttttacttgtattttttaataatggaataacattctggcctttgctcaaaaagctacagctaattattacaattttttttacttatgtctcctagtttggatgatatgtgaatagtatttgaatgtgagtgaaaaaaaaacatatatttttcgatatcaaaatcatgaaaaccattattaaaaccaagctgtgtgttgaacccacatggtattttggttggttttgatagtatgtcgaggggtgtaaaatatccggttacatagttaaggggtgtcttttaagacaattccaacgtttgagggttgtactacagacttatctcttattatgattttggtggatccagactgaggtgttttaacatgtgcatgcattttgttttgatttcagtgggtatatggctcctgagtatgcatctgagggttgcttctcgctgaaatcggatgtctttagctttggagttctggttcttgagattattagtgggaaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactaaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaaactgcagttatgttacgtagttctgtaacattattggaacggcagatatatatagttgaattacttttgacgaagtgtacaattcaaattaaataatacagtttttccttgtcctaacctttgccaaaattcaaaattatctttggctgtgcatgactttcaattcgctctgccgaaagataaaaggccaaactttactgcattcaagaacaaagaaactgaagcaaactcatcacataaaagatcagttcgttggtattaggacatagatttatgtggaaagctgattgagccaattaatgatttttcatatggacagtgccatcatccataaatatttgacaataagctactctctccgttttaggttatactccctccatctacttttgataggcatatttctaaatctaaaaaatttatttttgatagtcatatttcaatccaacaacctatcctcttaatgacttaattagatttaatgcgtgactctccattcttccatacaagattggctacatgagtatcgagaaatgtaaatattaatgaatcgcttgtttacgacgaataactagtagcatatttaaatgaatgataaatataattacttatccttggtctgtgtgccaagataaaatatgactatcaaaagtagatggagggagtaagac

SEQ ID NO: 24771 - DNA, 17806 bp, Oryza sativa
tttgaccaaagtcaaaacgtcttataacctgaaatggagggagtataagaaacgtattcctggctcttgtttgtgtgttgtctctttatagggagatgtcaatcagacgaagagagatatttctgcaggtttaggccctcttcactccttagaataatgaccctaagttatcaagcaagttgttggttttattgataccgaaagagtatggttacaagggtatatgtggacctagtctaggtctatagatatgctagtcatcggtcctggcgcaatggacacgggtctttggttatattctgcatcataccctccgttccggtatgacttgctgagtacagtgggtagtactcagtcttgctctatctcccaaccccagagttcgagtatgcgtcagatggtggctactcggaggagtagacttcgtccgtgccgtcgaggatgcctgtggagtggtgttgcccgctgctatccaagtaagacttagtttcagtcatccctttaatttccgatgtatttatgtaaaactttttgtttgtaagacgtggatctgtatgtcaatattgtcgtttgtgtaccctggtctggcctgtcctggacaggggttttaatgcacattctggttggaattctattcgggaatttctgggcgtgacaataccctatctatatacacaaagacatgatattactagctagcactaaaaatctctaattaaaagatcttgtccactatgtcaaataggatactcttatgaatcaccggaatatttcaacgggaaatgttctaaagtttcactatcacaagccttagggaattcaaaccgaatacaatgtcttagagtaaagattccgatgaatcgcaacactgtcaacgcaaaaggctattaagtatcattattacacgcgtatagttcaacgcgataacgtctcaaagtatcactattacatgtcttaaggaattgaaatttcggtaacaacttccattgcactactgggtgcaccaagggtacttgcccttccttgccgcttccgaccccgcatcctttgcacgctgcgccctagccaactttcttgcctgatattcggcgcgttcttccttcttgtgtcttgccaacacccttagctccaactcttctctcctctccctctcagtcttctccattgcccatgctggcattggcgtttctcacgttcttcattccactcgcgccattgccaaatcatactcgtatggaactcatccatctccttgtcaatccactccacaaagtcacaaagaggaggagggatttaggtgcatatacattacatcacaaattatatcttcacgacaaagttgcatatattcaagatgaaacaatagaaaattaacaaatttaccttcactgccatctttgtctttccctcctttcccttaggcacatgcttaggtttctctgggctatatgcatagttgcggcacattcagtacctctggccataggtatcctagtcatgactatgctgaaaacaacactcatccccacaccaacacatagggcgctttacacctggtgctggcagctgctcaggggaatagctaacaacacccttccttaatatcctaaaattgcaaaaatgtttatcgctatatcaattgcaattaaccaacaactatacctacaaatttaacataagtcggttttttcatcaaaccatctattcaactccaaactacaaataagcattatcacatatatactagaacatatcctagaactaatctatcatgcaaccgaattggtctctcctccatataatatataggtacatattatatactcctcgattgataatacatcccgagccatattccccaaatcacggttagaaccaaatcaaccaaaatacaaagtaaaacattagggaaattagggtttttgaaggaggtcaaccttataactaaattctcaacaccgtatatgaatcgtccataccaacatgaagattgaactacaatattacattcttacccacattccttaattcacaccgcatctcgagccaaatttatcaatccatggtttcaaccaaaatacacaagagaaatgaaagcccggttgagcaaatttgggtttttcgagggggtttaccttacaaattgatgcccaatgcaatgcccacgaaatcttggggtggatttgggaatatttggggaagggaggagagaggacgaccgtgtggggatgaaccctagacaaggagagaggagaggaagagagtggatagcataggcttctgagtgttcagtcaaaaaaaggaaagacaagaccaagcaattctaacagccatcttacaatctttaagattaagaattggagtgtcttctggcaaataaccacatttatagagtgtcttaccccaaaagtgccttcctgcgatgtcttgtaacaaaaattgcctttttttaccctctcgcacgctatcatataaatctctgctacttaggcgttgtttagttcccaaaataaaaacttttcacccatcacatctaatgttttgacatatgcatggagtattaaatgtggaataaaaaaaccaattatacagtttgcgtgtaaattgcgagatgaatcttttaagcctaattacaccatgatttgacaatttggtcctatagtaaacatttgctaatgatggattaattaggcttactaaattcgtctcgcggtttcatggcagaatctgtaatttgttttgttattagactacatttaatacttcaaatgtgtgtctgtatatccgatgtgataaccaaacctaaaatttttccccaactaaacaagtccttaaaaaaatcagtaatggtgctcttgttttctggcacaacaaacgtatatgacaggcacgcgtaatatccaacggactggaccacaaacccatcgcgtaatgcacccatcaccatctccacagagatcgcgcattgcgcggacggtttcatcctccgtaaatgactcctccgcctagggccggtccggagatttgggaggccctaggcgaacttgacactataggcccataaggagttctataaaacgcatataccatatagtgacacaaataaatatttctaacatggtaaacaataaatcaagcagtttgatatagcaatttattctcgataaataatatcgatggtataattgacaacaaaaataacaccatagaaacaaagtagtatgaatagcttaataggagaccacagatatcctatatcccttataaaaagagtttcttcgcgcatttctcgaagcgaaatcattaatgaaagtttggagatcaatgctctctaagatattcttctcaatgctgcacatagccaagccgttctgagcacccgaaaataaaattttaacattgtaacaccagaaatagtaaaattgcaaagtaaattatacaacaataaccataaaaattatagcctaaataatctaacttttggagtgggaaaatcatgcaatgatgcaaagcaagaaaatcctaagtccataagtaataagttgctaacctaaatttcttagaaaaatcgaagaaataacacaagaacaaaaaacaccttagttttcctaggacttagggctaaaagagaatggagagtggagatgggaagaggcgtgaggcgtcagcgattagaggccggcccgacgtgccggcagccagccggccaggcgcccgccgcctgacaactcggtgaggcggcgaagtgcttgtgcctccccggtctgctctgcgcggagggaatatcagagaggagtagacgtgtcgtgtcgcggttaggttgtgcagtcaggagtcgcgcaagactcacgaaaaaaaaggagaaacaaagcggaggagacgcgcgtcgcggcctggcagcgccctcactcctggcctagcaacgcaaccgcgcctccctccttcctaggctgcgcttgctcactgggctaggctgcccgcagggggaggggggaaggggtggtaatcacgccctgtcagccttaaccctaggcggtcgcacaaccgacctaggcccagggctggccctacctccgcccactcgtcgccgccacccgcaaccaccaccatcgtcccccgccgcgcactccactctagatccccccactgagccgattcctactactcctcaccaccgacatctactccttcacccacccgccacgcgcattgcccacttgcaaactcaactccaccgccccttccgcatccccccatcccaccaccttcttccgccgtgctaccgacggcccctccacagcgccgctgacggctccaggtcatcctcgtcgtcgtcacacggtcccggccagctcctccaccacgccgccgttggcccatccacaagatacggagataccagctcggcaaccaagccattatggcccagccaccagagccagcctgcccaaccgaccaagcaggtcaggccgtctttcccccaatttcccgccagcccaccaaaccgagccgcccaagcctacagccttttgcgttttacctgctcgacctcgtgtcgcgcgcacctgcccggcgacctagctcacgagccccggccaccgtcgcgtccgctccatcaccagctagctaaggctgtgctcggaagagcctcttcccaacttccctctcgcattttccacactcactctttttaaactgttaaacagtgtgccgcgcactgtacttcgctgcacctgagattgagccaagcccagagtggaaacacgagtacaccggaagcgcagccgctcggtcgaacaaatccactgccaacctaggaggggcaccaagatcccacaaggccaccaacctgttcgctgcgccggtgcgcatcgacaattactctatgtgtgccataacgtaagtcacttcgactttttttaattatttttttaagtttaattaagtttatagtaaaaacacaatagtatttcacccaaaaaaacacaatagtatttacaacacaaaataaatatattatcaacatatattcaatgttggatttaatataactaatttgacgttagagatgttgctaattttttttataaacttgacaacttaaatatgtttaaaaaaaatcaaaacaacttataatataaaacagatgaaatggagagagtattatagaagaaacatgtttcattttaggggtcatccttttttctcgttttagataaaaccaaatagatcaaaagttgtcaagggggtaacttatattgaaatcaaataatgaggctggaaaacgtttgttgaagttgagtttaattgaacagggttgaaagcggttctttattgggttaattggatccatgccattacaattgtgtcaaattagagaaatgccattacaaatcgcctatttcgaagcgtgccatccatatacgcgcagaatagtctccatgccatgccgtacgacgtaggctcgctttgactcattttgaccggtgtgtagttccgtatggtcgcaaatgcccctgcatacatggttacatcggcgacttggttgggctcgaccacgagaaaccactcctccgctgtccccaaaccattctatcgacggcggcataaaccctagccagcggtggcggcggcggcgacggtgagtccctcggcatctctgggcgaccgtgggagtgactgcgatggacgcccaatcgagaaccctttctcggtcgagcaggtgtagagaggagcggtcccgggcagcagcgtgcgacatccccgagctgaagtgtgcttgcgggtggccggcagcttcaggcacatcgacgactgtcaggaatcctggccggcgatggctgcaatgcggcggagaggtgaatctttggccacgacaaattttgagttgcatttctttgatttctttcccaatcccctttccttccctttcaagcagcagggtgcacgatgctatttatggatctgggaggatctcctcagggagtatgtcgaggagatagtggcatactgccacgccggcgagtttgatagcctatgggagacatgtgacgagttgcggtggcagttgttagatgtgcagggtcgcaacatcgagttgtgtagtatcttggaagcaaaagaggcgcaattgcagctctatagagatgagttgaatcagtcaaagagggaggttgcagagatgaagcacaagatggaatcagagaaggccatgctccaatgggttctgtatatgctaatgtttatctgtgttctttgtgtgtcagtagttgtagggaagaactatcttggatagttaattactgtgaatgtgcaatatgtaattgtaaatgacttgtgtaatgaatcctagtttcagtttgagcaaatgtgagtaattgtgcatttgtaattggcccgtgcatttgtagttgtagatttttagcaaatgtgagcaaagctgataaaatgggacttatgagacatgattttcatacatgattttcagcagcatatgtgagcaaacatgattttcatgtccaaatttcagttcaactaaaaactatcaaaacttggcaatgtgagaatgttagcagtaaaacaacaaatttgctggtattttctgggttttccagtagagaaacacaaatttatctaatttccagcagaccaacacaaatcacatatgtcgagcaagttcatgaatataaggtcatatatggaccaacacaaatttatctaatggcacatgtaaggagcaatttcattcattacatatctggtatttcaagcgaatcgacacaaatctgagaatgtcacatatatggagcaaattcattcatcattgcagccaacttcacattcatcattgcagccaaactcagaatacataataagcaggtcttagtgccatttcagtactacatcacaaaataaacaggtctgccagtcatcacaacataggtgtgtcttaggcattacatcacataatatattacaaaagggaacccacttctgtgatgctaacttacacaggcattcacatcacaaataccagcaattcttgggacatcatatattacaaaagaaatcccagtaatcagctaggtgaacatcaagctgggttggttggttgagacccttcaaaccaatctgatagccttctaggagcagttcttggtggagcactggaagaagcaagaactctcctcttttgtggtgttcgcttcttctttggagtttcatgtttcttcttatttggtgctgatgagctagcttcagcattcacattagatggcctcctcctgcaagtgaaaagaagaaacatgattcaacaatagttaaaagtactgaagtcatggatcaaatcagagatcaaaatggaagggttcagtacataccttttcctgggtgtttcttcagtagccatgtcatcttcacatagtggttcagccagtttgcatgttttctcaaagtgctcaaactggttgcatctcttgcatttcaccttctttctcccaggctcaagacagccccttatcctttgcactctaggcctgccagctcctcttcttagtcttggaggatgcactttgaactcaagatcaactgaaggccattgtgacctatcagtcatgggttgaatcctccctgcataagctgctctaaagtactggacactgtaatatggatgcacaaagtcctgaatcttgcccctgttgctgcatatccaagccaaggggatcctctagagtcgtcctgcaggcatgccataccctacaagaacaattttggttgtccaagtccacaatgtgcctctgggtgctgttatcactctcaaccattgtgacttcagcaaacccatggtcacttctggccaccttaaccaccttcaaattactagttgcagtgtttagctccttcatgacacttggcaggatttcatcatccatcttgctggcacaatctcttctaagtgcaaatttctccatgatcatttctctgatggaatcaaccaactcatgtaagagcaaaccttttaagcccttgatctggttgttgaaactctctgaaacattatttgtcaggtaatcacacttgctaagttctgaaaatccacatctataccaaatccttgagtggtgtttctctaggaactctattgcatcaggcctgacatcccatatatgcttcaaatgccactgaaacttatcctcagtatagcatctagcagctggatacagatgatcagtgaacactggcccttggtacttcttcatgaaattagcatagagatgcctcatgcattctctatgctctaccttcttgaaagccttacatgctttgtctaaacccttacatgcatctgtagaaataactaaaccctctgtgtctcctatggccttatttagttgttgcataaaccaaagccaattatcatctgtttctgagtcaaacacagcatatgctacataatacaaccagttatgtccatctacagcagtggctgaagctagctgtccagtgtatttaccagttaatctagttgcatctacacctatgtaaggtctacatccagccaaaaatccatctatgcaaggtttcaatgcaacaaaaattctcttaaagcacatcttcttgcctactttctgcaactcaatctctacaattgtacctggtgacttgttctgcagtgcagccttccagttgaaaagaagctggaagctttcttcatatgtaccatggatctggtcaattgccttcttcataccagaccatgctttggagtatttcagcttgatctcgtatttttcttcaagcttcttcctacaatcagttggtcccttgccaggattggtcttgagccaatcatgtagcctgtttgcacaccagccttgagtagccatcttcccttcatgtagctttgtagaagaacaagtgtgctcaaatggaagaaccttaatctgcatgacaagtagtgcaacacataagtaaacatcatctgaacaagaaaacaaaggaaatttgtgaagaattcacctttgcagtcttcttatcctcaatcagagatgcatgtatatatgccaagggcaaccatcagctgcacattttgcaataaaccttgtaggatctggcttcaccgaacctttagcaaattcaaaacctttcacgatggcataatgccttacagcttttctgagagctatcatgtcagggaacaaagcatctttgacaatgtttggattctcagggtcatgaatgatgttataaatctgaggatcatgatctgtaatctgtgcctcaggagctgccatagcactagcactagcaccattctctccactctgagcagtagctgcagccccctgaggttcagatccaggttgaccttgctgtttagatgcatgaacatatatgtgctcatcatcaacaccaatatactcctcttcattgtcaaagatatctgcctctctaacttctgcttcctctgttgtaggatggtcagaacctccaacagtagggatgtcagcagggatttcatgagggatgtcagcagggaattgaggagggatttcaggatggatttcagcagggatttcaggaggcaccacacatataggatttaaagcatttatagcaaatggcacaccctttgcagcatccaggatggatacaataagctcaaagtggctctcttctacatacatttcaaacaactctggaatctggccatcctccaacagtctcacatcctcaccaattaacttatgaaaataccatatggcaggagactaatttgggcaacaagttaactcaacacttaggctactcaacacaaactcaatgttaaagctatctgattccacaacccattgatgagttgacccttttgtgtaaattttcctaccagcagcatctattgtcacatagccttgaaccctaacgtctaccgaaaaccagttcctaccaaacaaatcaccacacatgaagaataatgcaagccaaagatgcatgatgcagaaaaaagatgctttgccttccaacattacagctttcaattgatttagggttagggatactcacggcctcgaacagattgttggattggatttgcctacatccatctcctcgccatctcgcccaggggtccgcgggggggtggttgtcgccatcacacttcctctgccaaggcctactagcggcgcatctctcccgcttgaatcctcgccttcaccgccgccacaaatgccgccgccagccagatctggagcgcgaatagggaggaatggagtggggaatggatggggctagggtttcgactgggaatagagtgagcaagccaacgggtcgagctgaaacaggccagatttagagcgtgtctgaaaggggcatttctgtccatacggatatacgtatccgatactacgcgtccaaacacgggagacgaccaaattatggcatggatcaagattcacatcaatacggatggcacgcttcgaaataggtgatttgtaatggaatttctctaatttgacacaattgtaatggcatggatccaattaacccttctttatttgccattaatcatatatagggttaaaccggttaatccaggaacttggcacgacgacaagcggaaaggcagttgcaggaatgaaggatgaagggtagctagcagcctaggaaaaagaattgcgaatatacttattatttttaataactttacgtatatacttgcacggtaagactttgcataaatatatctatcccacagggtgaaaacacgagaccgaatgtatgccgcaacgcaaaatcgcggaaccaacggtctcgcgggatggtcgcgcggcaccggccgtggcatgcgtagggtgggcatatataatgctgtttgacactgtttagcacaatagagacaccgactttgctactgttcacagagctggttccgtgcaatggaattgcgggaccgtgttggtgtcacgtttttgagccacgggaccgtctcggtgccgtgcgctaccgttggccaccacggtggcgcgtttttgagccgggggaccgccgcggtgtcgcgcgacaattctacagtaccgcgtgaccatcccgtgtgatcgtcggtcccgtgttttttgctgcaactaacatttagtctctcgtccttaccccgtgggacgggtatatttatgaaaattcttcccgtgcaggtatataaacataaattattaaaaaataagtatattcataatttttttagaagcctagcacccattgaagacagttggaaatgatttacattctcatcagttcataattcgcaaagtataacacgaacaacttgttttttcctggttttcttgctaagacgattgtgagctcaaacgagtcgagttggcccattatcgacgatacaacaagtgagggatgaaaatgggacaaaaggaaaattgaggtgaaacgcaaacaatgaaagaattgaatttgtaaattttgttagagaaaagagggaactatgaccaattgactgcacacggtggcatgtcagtgccacaacaacaatactatagttgggaaagtgtttttctttaaaatatcatcactcggagattgaatagctcgagttaagcttgtatgaactgtccatcatgctgattgctgagctccttgatgaacccgacgagccgctcgaactccgccgccgacgagccgccatcggcgacgtcctgcctcacctcgcgcgccagcgcctgcgccgacgccctgatctcgccggactccatcgcctccctcaccatcctctccacgacggcggcgtcgcacacgtccttcatgtccagccccgtcccccacacggcgccgacgaaccggctgttgatctgctggtcggcgaagaacggccagcacaccgtcggcacgccctcgccggcggcctccagcgtcgagttccacccggcgtgcgtcaggaagcaccccacggcgcggtggcgcagcacgtcccgctgcggcgcccaccccacgacgcgcgccttgttgttcttctccgccgccgcgacggcttcgcggagggcgccggcgctctgactcgccccgaccatgtccggccggagcacccagaggaatgggtagccggcggcgacgagcccgtggaggaactccgtgaactgctccagcgagatgacggcgaagctgcctaggctcacgtacacgactgatcggtccggctgcccgtcgagccacgccacgcagccgtcgtccgcgcgccacaggctgcccgcggccgccggcaccgggaacatggcgtggagagggccgatggcgaagacgtcgcgcatgcgcggcgcgacgtgcgcgagcgctggcccctccatggacgcggccgtgttgagcacgaccgcccgcgccccgcggctgtgcgcggtgacctcgatgagcatctgcacgatggggtcgttctggtcctcggtgcagttccggaagttgccaggaagatctcgccggcgcaggaagctctccatgcccggaacgccgcgcaccggctcgtcgaggtcgccgtcggccgggaacaggacgacctcaccgagctcgaacagcctgtcgactgacaagtaggccagtacgctgcacgcgctggccgtgcggaagaccagcgacgggacgccgatctcctcggcgacgtcggcggcgaacggcatgctgccgtcggcgacgacgcaggtcaccggagggaagccgccggaggaggcgccgtcgtcccctgcgcgtacgagcgaagcgagcaaggagcggtacgggacgctgccgttggtccgcagcgactcgaggagctccacgatgtcgccgacggcgcgcgggtggtcgtcggggaggccgtcggggatggacatgaaccggagccgcggcgagtcggcgccgccggcggccgcggcgccaccgaggcggcggaggctgtggtcggtgtggaggaaggtgacgtgaagaccggcgccgacgaggccggtggcgaagtgcatcatgcagttgatgtggccctgcccgggcgccgggaagacgagcacgtgcgccgccgccgctgccgccgccatgttcgtccgctcgcgcggcgggcgtctcactcacggcactgcgctctcgtccaacctgacccgtcgtttccttgtaggcgcctaggcgatctcatctatggccatttggccaatggttggttctacggacaagttgctgaaaaaaaatggtattagtagaaaattttggacgagtctctagacagcaaatttcactgggcgtattaaaaacgaaattgctatgcttccaacttggattgggattcggtgacattgctccggtgacattcccgtgacattgagtcactaacgtgtgggactcctgtcaccgagaatgtcacgggggaatgtcactaaatctgcgtcggtccaactcatactataacttatatccggttagtgtatatataggcataaatactacttgtttgggtccagatgacaagaaacaagctcagtgagtcgaatggctcggtcatacgtatagcaagattctattaaaaactgccgtaacctttctgagtgattcaaagtctagaagtttaatttattgtgtgatctagagaaggtgttggtactatttataactgactttaatttgtttattttatttctccctacgtagatcgagttcagacttcagattctgtggcaggtgctcacaatacaaatgtaacttgcggttgctgccatttgccaactggcggcaataggtccatctcgccttcccttaccctctcttcttcccacactctcaatttcacatcaagacggtgatcccgagactgtgaaggacagtaagggtattcttatcttttttatgtctattgtgtatatttatatgggattcggatcaggtgcagtcactactgtgactgtaactttagcagtatccatcatccaaccatccagcacacaagggatggtttagattcgttgtttaatttccccccagctattcaactactctctgactcgagcagatgtgttttggagggaaaagtctgagagggaagtaagaattggcgccaattctaccatgggaagcatactttacctcctactgccgcacatcacacgcaattaatttggatattatctttttttccctagggttctattaatgttgaagatgtcatcttatcttaaaagttcatttgaagaggtcaatagaacttagaaggcatcgtgctgattttggaagcagacgatgatctacttttggatcatgaaaatttttgtaactgggttaatctagcagtagcatagctagttgattttgaaagcttttgtgtcagtggatgcatgacacccaatttaagcgaaaatagttagggtgtgtttagttcacgaaaagaaaatttttgagtgtcacatcggacatttgaccatatatcggaaggggttttcggacacgaatgaaaaaattaatttcataactcacctgaaaaccgtgagacgaatttattaagcctaattaattcgtgattagcacatatgggttactgtagctgtcggtgacatgggatcaggagtatcatgactagaggtttgaggcagacgcaatcgcccacgtggcctggcaccctcgggggacgtcgggcccgagggtgatgtgttcgacctcctcttagtccccccgagggggtcggaccgcacccgcctcggccccgagggccgaggcgccccgacccctcgtgggttttttctccgcgtgtatgggttaggtgagcacagcggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcttatcagaaggtcattcggacggcaactatacaaatctccgtccatttatgaaaagggagggtaagtccccacagaaaagagggagatggtgcatgtggtatccccttaagatataaaaggaggaccttgcccacttagaggggggactggactggactggactggactttccgggattcggaacccagaacaagggagaggctggctcatactttgtagctccttcagacacagatccaccaaaaacacaggagtagggtattacgcttctcagcggcccgaacctgtatacatcgcccgtgtcttgtgctctttcgattgtcgcaatccttccacacatcaagagcttagaatttcacccagagtccccggccgaaccggcaaaggggggcctgcgcggtctcccggtgaggagccacaagctccgtcatctggcgcgccaggtagggggctcagcgtgtgtcttctgagctctcgcactcttccgtgtgcgccaagcttttcctgttcagcctgatggccgagcaagcaaaggcgcatgacctctctccgagtgtgagtggcgacgacggggagccgaacccacgccgtcgagctcgtactccaccgccccctccacgccaaagtcctaagcggggggaggcgcttgagagggtcgaaagatccgcgacttcaccgatcgcgggcgatggagaagaacggcgagatggggagcgtcgcctcctcgtctacggcgacggcagcacgccccagggcgcgctccaagctgcgggcgcgctcttacgtcacccgcctgtcgtcctgacccggagtctccagcccaacgatggctggacgacgtggccaaattagtcatgacggcacggcagcgcctagatgctggtgggcggtcctccgccaccaaggcctctggtgctgctaccaccggctccgcgtcgtcaagacggagggcacgacgagcggcagccgttgttcgccattcggccgccactctttcgtcgactccttcgatccgggaagatctgcgtggggggccgaacgcccgcaccagcatcgagcgccggcgtaatgaccaaagtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacccgcgtcagtccactcctgggaggatttgtgccaacaggtcaccatgaactttcagggcacatatccgcgcccaggtgaagaagcggacttacacgcagtacagcgaagggatgatgagtcacttcgctcgtacattcagcggttctgtcaaatccgcaacaccataccatgcatccctgcacacgcggtaatctacgcgttcagggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgccgctcagacagggcggcgtgacaggaggaggaagaagaggtcagtccatttcgacgacgagggtcatgtcctcgccgtcgagggcgcttcgcgggccacccaaaaggacaggcctgcgagcgacaaaaagaaaaaggccggcgctcccagcagggagcgcccagccggcaagtggtgcaccgtccacaacacctccctccacgacctcgtggactgtcgcgcagtcaaaagtttggcagagcgaacgaggaagtgggaggaggagaggaggcaggagcgccgtgagggcaggtccccggcggttccctccggtaatcggcgaagtgaggccaagcagaaggcccccgccgaggacatcgatgatggcgatgaggacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcaccttggaccagaccgaccacccaccgtgcgttgcccggggagggcagattgcgatggtggtttcccccaccgtttgcaacgtgaagttggggcgtgtcctcattgatgggggagcggccctcaacatcctttcccccgcgggctatgacgccatcaaggccccggggatggtgctccggccgtctcaaccgattatcggtgtgatgccggggcacacattgccgttaggtcacatcgacctgccggtcaccttcggtggatccgccaatttccgcacggagcggg

SEQ ID NO: 24772 - DNA, 1767 bp, Oryza sativa
  unsure (1)..(1767): unsure at all n locations
gcttggcgcctccgcccccgccaccccgaggcagcagatgatcacatgcgatgaggtcccgttcaaggaggtcgcctggggcgacggcccgtccaagaccacacggatcggtggtcttctggacggcaaataggaagacgcgctcgtctccttcctgcgggcaaatgctgacgtcttcgcatggagaccggcggatatgcccggggtccccagggaggtgattgagcaccgtctcgccatgcggtcgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacaacaatgcccttcgggttaaagaatgcaggtcctacttttcaacgtactactcgaatttctttgggtagccaattaggacgtaatgttgaggcttatgtcgatgacttggttgtaaagacgcacaaccaggaaacgttactcacagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttttcaaacgctccggaccgtttacctggacggaggaagctgaaaatgccctcacccagttgaaggcgtatttaagctctcccccagttctggtcgccccggagccagacgagcccttgctactctacttagcggnnnnnnnnnnnnnnnnnnnnnnnnnnnnnnnnnnnntggagcgcgatgaggacaattcttcattttgcgctttccccaccctgtggcgacttggccccggagagaacagggaggagaggcccccgagccgaacggtgggccaaggcccccgacgattggagttggccctctgcccgcttgtcagaccgtgctagaagccnccgacccccaagaaaggccctgaggccactgtgggaagnccgcacctatcgccctttgaccccgaggctaaccctgtgctgactcgacccgggaaagagaaggagaagaggcccccgagccgaacggaggcctaaggccccagacgaccggagttggccctttgcccgcttgtctgacgacgccaggagcccccgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgcc

SEQ ID NO: 24773 - DNA, 2774 bp, Oryza sativa
gcataatcgagagggtacaggacgggtggtgaaatgggcaatcgaactttctgagttcgatttgcactttgaaccacgccatgctatcaagagccaggccctcgtcgattttgtggcagagtggaccccggctcccaagcccgtctcaatccccgaggccagcacggacccctcgcagctgcctcacaccgcccacttggtaatgcagttcgacggctccctgtctcttcaggcgccggtgcgggggtcacgttgacctctccgagcggagacgtcctcagatatttggtccgcctcgactttcgagcgaccaataatatggcagagtatgagggactccttgccggactcagagtggcagctggactggggatcagccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagatgggataacatgattgccgacgaactctcacggctcgcgtccacgcgagcccagaccccaccgggcgcctttgaagaaaggcttgcccatgtttgattttgaaatctcaatgacaataaactaaaaagggtaggcagcgggctagccgtagaagagtacagcagcaaagccgctaacggtttggcgggacttctagaaagtaaaaatgaacctaaacaataattatttttgatttttgaaattccaatgccaataaagagaggagccaccagacgagccatcccaatgacaataaagagaggaggcagtagacggaggcagcagacgggccgtagagtatagtggtagcgcttgacgagacttttaaaaatattataaaaatgaatcacaacgagatattaaactctaaacactacaaaggtctaatttttaaaggttcgggaattaaaaaaatataaaaaataaacccaatgataataatgttcgattttaaaatcacaatgacaataaagaggggagacagtggcgagctgtagaagagtattgtggaaaagccgctaactgtttggcaggactaatagaaagtaaaaaaaatgaaccacaacaacaattatgttcgatttttcaaatcccaacgacaataaagagataaggcagcgatcgagtcatagaggagtacagtggcagcgtttgatgagacttctaaaaactataaaaacgaaacccaatgagacaataaactctaaaagctataagatctaatttttaaagattccatagagaatgaatataaatagtggtagatcgagcaagcaaataaataagaggtaacttttgaaaacaataaagttaaacacagggatgataatatttgatctttcaaagtcttaagatatcgagataactatttaataaatttaagtaaaatcatatgaaaaatagataattttatatggatgatagctgtgaaattgtgcgggccacccagctagttcataaataaagaagggagcaaaatcgcgtccacgttgctctccccggggtgacacatatggcacttagcaccagctgccgccaccttcctccctccttttccccgcgcctatcgttgcctgagtggccgtcagcaaagccggctgcctgttaggatggcagcggcggggtttcttcccccctcggtgcccctgcacggctagggaccaagacgcgctttggaggtggagagtcgccacgccgtattgatccgagcctgcatggctggatccggacagggagagactggcaagcgtccgtggaggtgctagcggggtggctagcggcggtggaggtgtggacagatgatggcggtgacagaagtagaggaaaggcggtggcaagagaggacgatggtacgtgggacagcaggcggcggccctcggcagatctagcgcttcggcgctccactggcctgatccggtgccctcttccatctccggcaagggatgtcggatcccctcggtgatgacgtcaaaggaagctttggcagcggggaagagtgcgaggaggcaagcgacgggcaagaccagcgggcggaggtgccaacgctgaggaggacagcggcaagcccgtggcgatggcggcccaatgaaggcacgatagctgtggccggtagcggagatggccaccgtcgagccggacagcggcagagctcatggctacgacaatggcagcgtcgaggtcagcggcggcactgccgaggcaaaaaacggcacgcgaggaagtgcggggcggcggcgaagaccggtgtggtgtgtgccagaaggcgcgggtgcccatccgccggcggaggttagacggcggttggagcattggtgcgttagcgatggataagcaggctgcgaacggcaggtaaaaacctagcccggccttagccaggccggcaacgatggctttcagagcatcactcctttttttgggcattgtcgtgccatcccatgccctttagtgaggctgccgggtgaaaaaccagtctcggttctctttgagaccttgacagacagcggcggcggtgctttcgtcatttatctccttggaggcgttgtctaggcagcccccttgccgaaacctctgaaacaaccggtgcaagcttactctagattcttgaccccttgtgtcggtgcctagcttacgctactaggccacgttgcatgacctagggggaaagcggttccactcttctttatcaccttctctccctcaatcccaaa

SEQ ID NO: 24774 - DNA, 1851 bp, Oryza sativa
ccgtgcaccgccgccgtcgcagccaccgtgcgccgccgccattgccgtcgccgctggtaagccgtgccgccgccgcctttttcctttcctcagccggtcgcggtaggcaggacgagagagaggaggagaaggagccgaaagagaatagaggaagagaagggaagaaagaaaggagccgggaggagaaaagagaaggaaaaaagaaaaagaaaagagaggccggcagaaaagagaaagagaggagagaaaaaggagagaaaaagaaagagagggagagaaaagagagaaaaagaaagagaggagagaaaaagagggaaaatagaaaagaagaaacggagaaaatagaagggaaattgggggagaaattaggaggatttaggaaataaaaatggtcggggttaatcatagattattttcggaaattcctcgagcgtaatagtatttcggtcgaaattccgagttaattataaaaatatgtttcttaaacagattagattaaaattggtagtaatttagatataattaataactaaacaattagatgaattcttatagattattatagattatttttggtaatctctataagtcatcggttcacggtagaaattcggatttaattactaggaatcttagccgtgtattatatttaatcgtttagtcatagactgaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcacagatagtaaagttaataaaaaggaatcgactttcgcatttgactttcatttggatttatttggatttttatttgaattctaaccgaattcaaatcaatttttgcacgtaaccatagagcccgagggagttgcggatccaagcgaaggccaagacccgcaagactttgagcaaggcaagtcatcactattccttgaacatgttgatcccaattgcaaaattgttttgtttacaaataaaattgcatgcaatgattatgccatgccttgattattgtttacccttaaaatccttgtaaccataattacgtatgagtccctagtcaattatgacaattgcttagaaatgccattctagaatcatgcatactcatatttatcaaatgctatatgcttggtcaattacctggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccataaagttaagcatgaaacgacccccgtacaaccgcacttctcatatgggtatagacctagcggattagatagccgaacggaggcagtatccctgcatagatggttcacccctgagtgaggcaggtgcgctacggtgggacagccgttgaggtagggccgagaggcgtgccctacatcggtgtcgccattggtaggactgccatgagtgtgtgaaagagagaacttaacttgaaccataatttaatatgtgtgtgagacttctctttcccgggagcgccagaactcctctcactgttagaaacatgaacgcctagagtgcatgaggatttaagttcatggagcgggtactaccaaaaaaaggtaatcgaaaagctttgccgtgacgcgtctcatgtgttgggacgaggctcatggggatcctcta

SEQ ID NO: 24775 - DNA, 687 bp, Oryza sativa
  unsure (1)..(687): unsure at all n locations
taagctatctccccctaagctcagggatcatcccttccattctcagatgattgcaatggctcttacgactcagagcgtcggccacaacgtttgctttgcctgggtgaatagtgaacttctagatcatagtccttgattaattctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcacgggtagggtagttttcctcatgtggttgcaattgtcgcgacgcataggccacaacttttccgtcctgcatcagtactcctcctagtccttgccttgacgcatcacaatatataacgaagtctttcctgatgtcgggaagaactaaaataggcgccgaggtcagcttttctttgagctgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24776 - DNA, 4511 bp, Oryza sativa
  unsure (1)..(4511): unsure at all n locations
ctaatcatttgcttatacactcaataagcgcattagtcccttaatcgcttgtcatcaattaaccaaaacccactaagggcatagatgctctttcaatctccccctttttggtgattaatgacaacacgattaaagcttacaaaagattgataataaatgattttgaatccaaaggttagtttgagctcccctaaatgtgtgcatacaagtttatgaagtgaacacacatgcacatatttttgaaaatgtgagagctccccctaactctttgcatccgtggggtgtattgtgtgtgaaggagataccaaaattaaaacaacacacacaactcaaattcttggcaccaattcaaaatgtatcaaatgaaattattgatgccaattgcaaaaacttgattctatgccaattgattccggtaccgattgagaaagcatgagtaatcaagttttgtagacaatttcaagtatcaaaagataatcttaattgcatgtggcatggtgatcaaataataagcattcacaccaattgataaacactttcaaatattctctccccctttctcatttactctttggcatctttaaagcattcattttgataatttctcacaaatatctcaccctttgatcaatattttctttatcccctttagtatacttctccccctttgacatctaacaccaaaagggncataagtagggaaagaaaagcaaagggatccttgatgagggatcatcgagtacttacctctcaattttatatttcatcacttgtgattaggaaatgaagcaatttcacataaagatcacaagaaaatcaataagcattgagatacaaattttgcgcatagaaagctcacatgcaaagggtttaaagcatagatgaaaaagaatctcacctaagattttcacaaaacatttcacaaatgagtttcgcatgtatgaatctcatagtttgtgctaagaccaaaaattcacataaacattgattcacttagaacaactttgtgattaatactcgcttaatgactaaacaagcatgtcgtcacaacattttgcaaattaggctaattagcaagaaatgaaacttggcctagatgcccagacaaggcaagtgatccaatcataccaatttaaataacaagctatggatcatcaagttaccttccttgtcgatttttgagatgcccattcaataaaattgatatcttgaacccaatttgaatttggcaccttgatgggcttgatgaaatctcttccttgatttgcttgattccaatcccgagaaagaacttaagcttttccatcatgaacatgtttaactccttgatcacagtctacgtcctgatagtgcttgtgctcttcttgtaaggccatgacccgatccggtttagcatttgcaccatcttccttctaatagtccaaatacaacaagagagagtaacattcacaaatttgcagattgagaatgaatagctactccctttttgtatatcatcgaggatattgtggagatgatctcgttgaatgatgtggtgaattcttggatggtacaccgatgggacttgagcttgtatggtgtaactttgctcttgagttgcccttggtatcaatcccatccatttgtgccggaaacatgtcttcatgttcttcatagacaattgcggtaggttgacttgagttgattgaggttgatcaagtagtccaccttggtcatcatggacttattgtggtctcaccttccaaactatcttcgaagatgtttttgatctcctatgagactaatcacaaaaatacacttgataacaagttagtctcaaaaacacaaaacataggatatactccccctaaatgtgtgcttcaaagtatttgaattacttgtagaaatgcatgtgtttaatgaaaaacaaatggggagtgtagcctatattttggagaaaggcacatcttcccggagtctccggggtatgtacccagagcctccgggctcgaatgcatggtgatagatgagcttgattgcaaaccgagcggtcttaccgaagcctttggttccactataaaatctgcaataaatcttgtagataggtcatagaacattgcatatttttcattttgggagttttacccaattctcaaacaattagaagccacaaaaaaacacaaaaatttagaaaactgaaagtttcaggattttcagaatttggaactcaaaaagagcttggaaagggcatcataaaaatattcaaatgactatagaaaaatccaagtaaatttagatgtgaagtccaaccatagaggaacaaaagtcattatataaactcattccagtttgcaacctattttgagatgtaaaaatcacaaatcagtcaaaaaccatgaattttctgaaaatttcagcaacttgagcaaggtgagaaaaagtcaaattctttccaatttaaatcgaaaccttgcagaaatgatcttttcacttaatagaaaattttccaaaaagaatttctcaaaaaagatttttctttcaagagaaatgtcaaagagagttttgtaggccattcaagtcaataaatctcaaccaaagtgtcaaatcacatccaaataagatttttatgaagtttgacatttggaaagccttagatgggttagagatactaattcatgccattattcacaaagaattttggctcaaattgttcaacccaccatatgcaagttttggccaaatatggtcaaatcaagatttttgatgaactttgtaaggctgcaacattagaatggttggtcttttacaaaagctttgaactaaagatatgtttgaaatgaccaaccctaaaagttttaaataggcaactttttcaaaaactcaatagatttagatttgaggtaaaatctcacttttagcaaaaacaagattgcaagtaggcggttttaaaaataaatgcggaagctaaaacaaaacagggtcggattgtctgatatcaggtcggatagtcctatgtgatcagatagtctaaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagaaagtgaggatatcaccgaggtttatgctccgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggcaagatccggccttcacaaacttctcttggccaaccacacgtagatcggtggcccaagaacgacacctagccgtctaggagtcctcaacctccaagagtaataaacaccacacaactcttggacaaatcctagtgctcaagattaagagaaacacacactaggctcccaaactccaaattcacacacaaagatccaagtcataaagaacaagggggatttgagatagagagggagagagctcaaaaatccaaagcacttagcacaaagctcaacccaaagcaagataggaatgtaatcagtttgggcagccctagaaaagggttggtggggggtttatatagatccccaaaatgtgaccgttgaaggggaatctttcagcccacgtcggatagtccgatacgagatcggatagtccgatattttaaacctccaaggcaacgagaaatagagaatgaagttccatgaaatttcggactttccgagacatcggactatctgatgttaaatcggagtatgtgatattttagaagcaaaaacttcgtcctcaaacagagactcaagttctatgaaatttcggagtctctgtatcatcggactatctgatccaacatcggatactccgacacttagaaaaactcactcgaaaggatttttcaaacaaagacagagagtgaagttctgtgaaaaatcggatagtctgatgttgctcaagtaaaaatgcaataactttttactccgaactccgatttcgaagatcttggactctatggaaagctagtttcatgggctatcaaacccaacataaaacatggtccaaaacctttaagagattatgaaaaacttgcaaagaaacccggtgtaagtgttgtgataagtgaaacaactcggaattgaaattttggcttagtttttcaactcacacaaagatgaagcattttgagcactagtgttcaaccaattatatgcatgtggtatccctcttaatagtacggcatcctaaactcaaatttaaaaagcaaagttaaaccaataggagtaccttcacaccatattgtttcttcacttggagggttaccaacctcaatgtcaattgattatcgggaagatctcatcttcttgatctttgacattttatctttcatttctaaatgaatgatgccgataatccatggctt

SEQ ID NO: 24777 - DNA, 1204 bp, Oryza sativa
ttaaaagaaacacatactaggctcccaacccccaaattcacacacaaagatccaagtcacaaagaacaagggagatttgagatagagagggagagagctcaaaaatccaaagcacttagcacaaagctcaacgctcttaatagtacggcttcctaaactcaaatttaaaaagcaaagttaaaccaataggagtaccttcacatcatattgtttcttcacttggagggttaccaacgtcaaggccatttgatcatcgggaagatctcatcttcttgatctttgacatttcatcttctatttctcaaatgattgatgcggataatccatggcttcaaatggcctcgcacggttcatcacgacacagtcttcactcgcccttcaccaccggtttcggttcatcggccccaagccccttgcttgcccttcaccaccgcatggtccatcgcagctgagcgtcacttgcgcttcaccgtcttgccataggtagtcacttcatacccgcatcttcaatatcttctctttaattctcatccatctataagtacatttcctagcttcttcatcggactaatcatttgcttatacactcaataagcgcattagtcccttaatcgcttgtcatcaatttaccaaaacccactaagggcatagatgctctttcaatgcctatcgaccggccgaacctacgaaacaccaaactcctgaatcctgatccaatctggacacacaatgactgacgaaaaactacggcaaaaacatcttaaacttttataatagtagagataagtccattttacaccctctaagtctttagtttgtctaaaacacacctcacaactttaaaaccggacatctgacccctacaacttttaataccgtgcaaaaaaccacctggtgtggttttctacactgtttttgtgcactaggatgccacctgtatagattagctagccccacatgtcagtccggttcttcttctttctcctccccactctctccccccttcggcatgcgcgcatggattatccctctgcctagcgaggaccgccgcacacccatcgacaagctcgctgcgacggtcctatctcatcccttgcggagctgcaaattcgccgcctgcaaacaccgtcctccaatgcccattccaccaccgtggaggataacagccgcaaccaaatcgagctccaacacacaatgacttaat

SEQ ID NO: 24778 - DNA, 13817 bp, Oryza sativa
  unsure (1)..(13817): unsure at all n locations
nnnnnnnnnnnnnnnnnnnnnnnnnnnnnnnnnnnnnnnnnnnnnnnnnnnnnnnnnnnnnnttccgtggaatttgcatgaaaatgctgaatataagacgatttacaaaagagtactgttacacgtactaaaattttcttacaaaacttttactaataaatttctcaaccgtttgatttaactagatgaaagttgtaagaaatctagatttactcatagcttgacaaatcagagtttgtaaacattttgtaagaaaaatttagtacgtatagacttttcctttataaaaatataccactgtcgcggtttggtttagcgagaacgcggcgtcgcacgggggatgtgcgagaacgagagcggtatcgctgtttagataagcgaggacgaagtgccggcggtctcgcggcttggagtaacgagagcgtcagcactctcgcagtatgcgttagcgagtgcgatggggccagcgttgctaccagtttcgcggcgccgaaacgtgagagcggcggcggtctcgcgcctgggaagtgcgagagcgagcgggtgccgcgggcctatgaaagcaacgacgggacgcgcgttctcgcacgaaggtaatgcgaaagcgccgcgcagtctcgcgcggtgggaatgcgatagcgccacgcggcggtctcgcggaatgggaatgcgatagtgcacagcacaggctcgcccctgcgccgaacacgagcgatgtgacagcgctgtcgcttgtctgatttgcgagaccgcgcttcgctttccaaattagccagacggaatcagtaatgtactgattattaagttaattacaattttatatttgcatgaattaacaacatgtgataataacatttgttttaaggctcgttagtaaatatatatgagaaaccttctgtatatgtactagaaatataactaccattatttaaacttttcatttgttagacacaacattggccatctatataaaataaaaaatcacatgagctacaaattaattgtaacttacaattagtacaaattaattgtaactttaatttaattttttttaccatataaattaattatgtctatctaatttttaaacccgaaccgactctaacccatataacagaaactacctctgttattattatcctacttaataataatatactatacattattaatattttatatttattaatttcatattttatatttgttgtttgccctaaggaccatgtagctttgcttcacggaagaggccgttgtcttgttcaaaatataaaatttaccggtctcgcaattctaacaagcgatcgagatcgctggctccacgcgcgttgttgcattgctaatgtgcgaaaccgtgccggactaagcaccaaccagaaaatcaccatgggacccactccacagtggctctcgtgctacgaaagcgcggtgccgaggccgctctcgcgcttcaggcatgcgagaccatgggtctcacgcacatctctcgcgcgccagtaatgccacaccacgggccccacaacgctactcctctcgcgcattgaaaaagcgataccgatcccggtctcgcgagggcaatcagcgagaccgttgggtccattcctgctctctctcccaaatcgcaagaccggattaggtcatctctacgtggtgctctcgctcaagggaaaagcgatactgcatcggtatcgcttacccaataagcgataccggagctgacgtcacgctttcgcttattgatattgtgataccgtgtcggtatctctcaatcctcttgcgaacctcggtatcgcgctttcctcccgcgatttcaatagtatatttgtgtaagtcgaccaacatctggtatatttatgaaaaaaatatttatgaacagtatattttcaaatttttttcagacaggagaagcatacacacaggtcacaagagacaggtcgaggtctatatcgtgcttgtgtcggagcagcttcttccctgctccctgcttagccatatatgcgggtcgtgcgcggcttccgccgatgaccgcgcgcagcggcttggatatgctactttcctgcgacaccttctccgccgacgaccgcagctgcttgtcggagatacgcggcactgaccgctcaaccctgccttcgcagtgcctctaccgccgccgctcctgaaaattaaggtcaaaacaaccaagcaatatgggcttgccccatataatcatatgcgctgacgtggcgaagggttgatgtggcatccaacgtatcatccacgtgtgcaaaaaccatcataaacagcccaagggggtcaaatatcaaatattgacagttcagagggtgtattatacccggtttcgtagttcaggggtatattttagacaagttaaaagttcgagggtgtaaaatggactttccccaattttatatactaaaactttatatctggttctaattcgaatcaagtgattttacatataatagtttcataaagtttctacttgtaggtttatatgtataaagtttcggcttgtaaagtttacagtatatacattgagtttgggttcataaacttaaaaatgaaaaagaaaccacgcaaatgcaaaaatggaaaacgagtgcttcgtaggggttaggcgcacgaacatccacgcgttaaacctacccgttattagctacacaaacgacattcatcaacggatccacggaaacgtatcttttgaagggcttgtgcgtgtacgcccgcgtggacaccctcctacttcaattttcatgtgcatgatgtctgatttatagataaagctttatacataaaaattagggcatttacaaatctgccactatttttttttaattttacaaggatgctacttaaatgaaagttatagtgatatttttgcaatttcgtagtggtcgtattatgataacgatttaaattagtggcaaatttacaattgccccccaaaaatacatgtataaagtttctacatataaagttgttgaaagcatgtcacgagggccttcgaccgaggctgccgaaaccagatgggcttgggtgaaacgccagctgagaagactaaggttttcgcctcgaacgtcttcgccactgaaccaaagaagttataaggcttaaaatggcctttcgccacttgagggcccatagtgaagcccattaaggggcccaaggcaaaatagatattagacactagttaccctcataaatgttcatgtacacattaactctaggactaggatgcatgagcttctactaagactataaataaccccctaggggcatgaaatggaggatcccaataattttcatcattaatacatattgttgtcgaaacgacaaccgcatacgtcgaaagacgtggttactcaacagtggttggaaaacagtaaagtgtattaaattaagaatttttctcgggatccccctattacatggccctagggggctatttatagccccattacagattcccactactagggtttaggttatacaggggaatttacatggttacccttatgatagggacattatgaagggcacattgtgtcctttacacacacacgggcccctactgggcctaaacagctcggcctatctatcttgcgaaatcccccgagggcatagcggcccgccaagtctcccgttaacgggttttggtgctatggcgaaacctgtgcccgtgtgccgaggctttcgccacatcatcttcgctcgttccgccttctgtcgagaactccacttgacgaaggtggtgttacccacaatcacggctttcgcccatatggcttcgctcttgtcctttggtgtgagcctgatacttgaacttttcggtttcggcaggttcggccgaaggccttccatggcaagcctccaacacatatgctttacttttccactgtgtgaaccacgtccttcgacatgagcagttgtaattcgacaacaaagttcatatgaataattgagatgtgtataaacttgataaaaaaaatcatgtggatgcaaataaggaaaacgagtgttcaacagaccaaacgcgtgaacattcacgtgttagacccagggtttacgattccgagatggctttccgttttaggctctagtggaatgacggttttcgcgaaatctggtggagagccgataaattccgaacaaatttcataaaccaaaatttaaatataaattccctgattttaccgataagctcacaaaaaccggtcggctttgacaaaattctgagcgaaatcatcaaaatttcaatcggtaactagaaaaagaggtaaactgaaattgttttccttttttaattcattattcttttctttcctattgtaaatttcagtaaatacacgaaatacattaatttttttcaaaaatttatatcccaataggttctatgaatatcatactatttattagtttttttatttttttttcttttttatcaattcaaatttgaatttggatgaaacttatcgaaatctcaaacggcttttattttcgagccttgtcgaaacctttaaatttcgcagaattcgactggttttcgtcagagttgtgaaccctacttagacatacctgttagtaggggtgaaaacggtacagaaacggacggaaaccatctttatcgttttcgttttcatattttattcggaatcggaatcggaaaccccggatacgaaaatggaatcgaatattatcgaaactgaaaacggagcgaaaacaaaccggcgcgaatacggtaacgaaaatttatcggaataaaaactccctcaaactgataaatccaattgaataaattatgtatgtttaaaagagtaatgttgttgataaatccccatgtaggacaaaaaaatattcttatgtaattttagtttgcataacaaatatttttttaaaaaaaatagccaaacaccatggtattcactattcagtgcttaaaaaaagaatccagggtatttctttcacaaaatttctggtaattccgagaaaatttccgaccgattccgagttccgacagaaactgcccttatcatttccgattccgtttccgagaaaatatttccgaatttatttccgtttccgaaaaaattccgaccgacatattccgttttcgaaaaataggttcgaatccggaaagtttccgtaccgttttcacccctacctgttagatgttgcataatcgaaagctacggatggatccataggctaagccagaatcatttcaagtatctcacactctcacgcgcgtgcatgatctagacgcgcgaacgcccgtccgttaaacccactcaccgccatgtgcggcatatgcctgagtgcgaagcatagtcgcatgacgacctacagggctacaactcccagtcccagcactttgccgagaaaaaaaagaaaagacccaaaccgcccatgaccccgcgtctccgccacatcgtgacaccggacaccggtgctatgcaccacgagagcacgagaagagacgcgcgggtacaactacattccacacgcgactactagctaatagcaaagcagcagtaagtaacacgttacaccggcatccccccaggccccaacccgtcaaagcataagcccacacagcgggagaaacactcggcggcgaccggccgtcgcggcctcgccgggaagagcaggttaattagcggccgctcgatcgacgatatggggggcagcctggtgtccatgctgcggtggccgccggacctcggcgtgccgagcctggcggcgctgctgccgtcgtcggcggccggccactacgcgggcgcgccggccctccgcgggtggcactggcagcactggtggccggagcggctcggctcggcggtgcggcggtggccggagctcgtgcaggacttttcccccgtcgtggacgccgtgctctggggcctcgtcaccgccatcgagtccgtcgcgctcttctccatggtgtgctgcttcttcctcttctgcggctgcacgctatgatcggtgccactcccccaccatatagggcgcgcgtacgtacgtacgtatgcataattgtatatgatcgcttcctagctctgctctgaatctcccaactgtttttgattgattttttttttcagatgattctccattttgttgtcggttattcactgtgttcatgcttcatggcaaattaatttagatgccgctaattgtattgtactggtgcttagtgcgtagatttgttactggattttgcttgtctgatgtatgtgcagagcagtgaggcagaagaacagcaagcaccattgatagttttgggtgatgaaatgtttggggagagggattgagtgagattcggttggactagttggtgcgggtgcgcggtcggaacgggggtgagtccaaccctcgaaatatcttatgattttcttaatcgtggcgagtccatgaaactactatttcctacctgattatactcgtcataaaaatataacaaaataacttcgaccactatattttttattataatatataaaaatattaataactgtattaaaatatcaataactgtattatgattttatggaagtaatttttaatcatcatattttataaatattttagatgttatttatagtcaaagtttttaaagtttaacaatagtctgatatgacaaatattattaactgaggaatatataaaattctttttttactcccttgtctcatataagtgcacttactcactccgtcacttaagaaaactaacctaccggaagtaacacatatttttagattaatagtatcataacatgtcacatccaattatatatttgttatttaagattgaaggaatattataggatatgattgaattgttcagatttatagtacacacgtagtactagggtattggaagtttggaactgaaggtgtagttaataccagtaggcagtagctgttgtagacagtgcactgatgagtcgctgattgcatgtcacgtttcggtgttgtcgttctgtcctaggacctcgtgaagcgccactgttgcagtcaggaccatttacaggttaaaaccatgatccgatgactgaccaaaatccggcttcattcctactaacacggcccttttgttcagagagctgtgatgctttcggacgtcgcataacacggcctggcttcaacaggcaatttggcggcatcaacgtgtgtataactgtatatgctcataaaagattatctacgctttgaaatttatttcgactgttaccgtagagtgttcgaatgaaatggtgtctttctgaagctaatgagcgaaccgccacaatttaagatgacaaattttactataggaaatcgtcggttttagctaaactcgtcggacgaagcgtcgccttcctctgctgcccacgcgctgcttcccatcgacggcgatgacccccatggcaccaacggacgggatagagagagaaaagagatgaaagaactgacatgtggatccagggggtaattttaagagtaattttaatatttcaagtgatttttcgctcctctccaaccagaaattattattttaataggtgcgatgtccactgtcaaattaccacgtttatagagtatttactcctaaaagtcactttgtgttgtgttttacaattaaaatcgtgaagtaacgatatactgtagaaaaatttaccatttgagatagcttcgacacttgatgtgtcgagtatccccgcaagattacataattctcttttattactagtattttataaacagactcctaatatcttctctggataacgaaatcctttttattaagtaggtattttaaacagcctcctaatatcttctgtggatatctgctgctcgcaatggcaacgtttattaatgagattgagggcatgtttactttgatgaaaaaaaccttattaaattttagtaattttggcataattgcctgccaaaattttggcaatttgacagcaaactaaatatatccacttttttaataaatttatcaaaatttgataatgttgaaaatgacattaaaatgaaaaggcctgagtaagcgagagctcaacaactgaacagcagacagacgttagcccccattgccccacgtgtagcagcaccaaagcgcgccagtagagagtcgccccggctctcgtccacacaatgatacaaacaaaactaaaaacgacccgtccgctcgacacctcgtgctgcgcggacgaaaaacaacggagcccgtcggtcccggtcagccatcttattttgagcggctgacgcgtgggtcctacagtttgtgatctttatatacgaataacccacgttagagggcagtagtacatgagaacagataaactcatatcccctttaattcaaagaaaatttataggaattcagaggattttattcttatagaaaattttccaacatagccctttgaatcgaagtaatgaaccctatgaaatcgtatggaattcctatggaatgccacttctatacgagttttgaaggaaatttaacgtgaggtaggacctcatgaaaataatcccttgagtttttatctcttctcaaattcttatggtttttcctacatccaaatcaaacggtcattcctatatttttgtgttacaataatttgttttacacttgcatttatgttagaatcctatttttttatttctctttttttattcctgtgatttaaagggttgagaatattatgttagaatcctatttttttttatttttttttcctgtgattcgaagggttcttattattctcaggtgggagagtgtgacgtggtcgctcttgtctctcacgtgccaggattgtaagctgcagcgccggagccggagcttaacgccatttggttggttggtccggtcgcgagaagaatttaccgcgcgcggtgttccgtccgtgccgtgcaccacgaatccgttctcagcgagggtcggataaggacgagcatcccgggcttccttctttctttgagcgtctacggttaaaactcctctactcgaagggtcactgtcgcctgttattgccttgcaaacgtaaccacgtttttcggacgaatcaaaactcagcagaatatgatatgcggtctcaatttcgtagcctgctcgatgcaaaggcgaatgctgcattaatgaagactgtagcaaggccacttgcgattgaaaaagacaggcgagcaagatttatcctgcttctgattttattccgaaacacgcatggcacaaattccacggatgcattttgcgtgcatccaaaagcctttcaatcagcacagctgaattagcgtaaccggaagttgttaaaggtcaggacacaattcggtgttcaccctcagctttgaagattttcgcccgttattcttcctgtcctggtaaaaaatttggggggattaccgagttccggaacgggtgctcactcgatcttaaatccagattttagatcaaccacctcttcgatatttctagccaaaaattctgcctctccgatataagaatgtggtgttagcttcagaagcgacgatcgtgccgcctctggcaagtctagatcttcaatgaattgccgtatgctgtccttggtgacagcctgccctctggtcatttccttcagcttctcataaggttcagggattccataccttcgcatcacctacaaagatgatataataatgtatgatatgcatctgagcttgaaagacgacagacaaatgatgatgaatacagttgatgtatctggtgaaaatgccaataggtgaaattacccccaatatcaaacttataagttctgagaaattttcaaaatattgtacgatgtaggagaatatgtcgttttcgaaccaaacaaaagcaattaaactaaccattctcagtatcaaaattcaccatgaatacacctggctaaaaacgtaaaaatcctacctaacaaagcattaagggcaatgcaaaatcacaaaacaagcatccaaaagacactttcgacaatttgaaagcatctgaagaggcgcacaaatttctaggacaaaccaatacaactcctccatggaagcataccattgtgaaaacaaccagaaaccatatagaggacaaaaagaatggtcttactgtctgtattggctctgcaaggacctcccatgtttgatccaagtcttcagataaccgggattcattcacctaacaacaggcaaaattcagcataaatacaacgaagtgtcatagttacattttggctagtaaacttaacaaagttaaggtcaattacaaaacagactaaatgtctaaaattccaatagtccgaaaatgaaattatgtgtagtgcacaaaggaatatcttgtttctagtacgacagataccctgactgaggtccttcctgtgcatattgagtagatacaaataatagttggggtaagacctagccacatccatcactttatagttcacttagtccaaaaacataaagtgtgggtgggtggatgtgcatgcttgggcatcaaccattcagcatcacagcatgcatagaaagacttcaaatacaaaatatgctagttcaatacttggacaatgataaaattatctatacaagaataattcaagaaacaaccaaatcaaacaagaggaggattgtggccacctacctgaaccttattgattcctcgcaatgtagctttgtaagccaagagtgaatgccctaatccaacacccaaatttctcaaaacagtcgagtctgtgagatcacgctgacagagagacatggttgctcattagttcaatcttaagtaaatagttaggcatgtctgactgcttgctgtattttacatcagtggcaagctacaatttttgcatgcacattggttgaccaaaattgcggttgcattgaaaaatgaggtaagaaagcattaaattgtgcagaggtaagaaagtgtagcgtgtgccacgagttcgacagaaatccatggactatagcctaataaagccaaacttaagaacaccatttgtggcaagttaggcgtctgttcttgcatgtgcatcaacaatggatgatgtactacccctttttcacaactggagatagtaaaagtggaaattgaagagtacagacagtattatacctgcatccgagaaattggtagcttcatgcttaaagaagacaatgtaccattggctatagtcaaattgccgtcactattttcgaaatcaatgggattgactttgtgaggcattgtggaagatccaacttcaccagcctttactatctggaacaacatttggaaggatgcagtaagttcaaacagaatctaaaactgtagaccactaagtttttcccactatgtactaaacgaattcaaccaaaccttaaagaacagtccttgcatgttagtattacctgcttgaagtagcctagtgatatataggtccacatgtctctatcgaaatcagtcaagacattgttaaactgaacaaatagattgaagagcttcgagatatagtcatgtggctcaatctgtaaaaaaaagttaaaactgcgtcagaccaaagagtatcatatgactttagaatttacagcgcagttagataaatggaaagtgtattaataggaaattctccacaccaccatagttcaagaataataactccaataaagcactgaactgggaatacaaatgaaacaactggatatcaaaataatgaatataaaccacctgggtaacataaggattgaactccaagcccaacgatttgacaaaatcttctgcaaccttaggccagtcaacttctggatatgcaacaacatcagcgttgtaatttccgacagctccagcgaatttccctagtatcttgacctcagaaaaactatttcctatgcttgacaatctggccgcaaaattcgccatctcttttcccagagttgttggcgatgctggctacaagcaggaaagtggaaatctaagctagcgttataacttctaagcatatagcatcgattacagtgactctgtgtacatatgtacgacagtacaagcatatattactgagtatacttcagaggtggttctcgtacctgtccatgagttcgcgacagcatagggatggttgaattttgtgttgccaaggagcacattgctttgcatatgtccatcataacagggaacataactgtatttaccccctcttttagagctaatgcatgtgacaagttgttgatatcttcagaagtacatccaaaatggaagaactccaacacctggggacaaagatacactcaacagctagcaacgaagtaatagtatgttcaggtattggttcacacagaaggctgacatacctttgcaatctctggatttgagctgcatttttgcttgagaaagtactcaacagccttcacatcatggttggttgttttctcaatctttttcacttcttttgcatcagcaacactgaaatcctggataatcgcatccaggaataactgggcctccttgctgaatggaggcacctcattgatctcagggatttgggagagtttcagtagccactttacctacagagccagaagtcacttcagataagcaacattgattataacactagcatcatgccccagtttctgtatttaacacatgaatcaagcatcctagtttatgtgaggaaatgatgaaatacactacaaatgatacgagtgcaaaggaatccaaataaatgatacctcaacgatgacccggtatctgatgaggccgaactcactgaagaagggtttcaggtccctggtaaagcgctcgtaccgcccatccagcggcgaaagccccatcaggcagaaagagtccaagtcctctgcccgctgcatctcctccagcgacctcgtcgcccaattcatcggagcacgcacctaaccaaacagaccccccccccccccccggtaaggaacgacaactactcaagcgggagttcagagtttgcacgggaagagtctctgctcacctcgccgggggcggcgcttgatgcagagcagcgcaagcgtcgcggcggaacgcgggacgcaccggacggggcggcggcggcggccgtagcgcggtgggccgcggccgccgcgacgaggaaggcggcggcggcggccggagccttcagcaacggcggcgccgacatgcttggggggttgtcgtgtgggaaaaccctagagcgagaaggacgcgcgcggcggctttgctgggtggctgcaggtgggccgtgcggcgcgcggccggagaagaaaggagggcggaggagatggataggaaatgattcgtagggtttaaggggagggggaaatttttccgggggagatggacggcgaagtggcgaaccgatagattccaacacccccaacaagtgggcgatgccaccgcgccaccatgaccgttcttttcttccaaggcacatttcccttctgtcccggactttctcagcccagcccaatcaccttgcctgagcccaatcaccagcccaatcattcttttagggaataagttcaccagggggtccctcaacttaacagcgagattttttgtgatcccttaaccacaaaaccagaaatgtgtacccctaaactccctcaaaccgttcaccggaggtccctcggcagtatttttgcccggttttgctgacgtggcatcctagtcagcaaaaaaaaattaaaaagtacatgggacccacatgtatgtcagctgcacattttcttttctcgttttcttcagtgaggcggccgggcagatgagggcgtggcgacaggcggcggtgcgggcacagcggcgcgcggggaagaagcgagagaggggagaggaagtgggcgc

SEQ ID NO: 24779 - DNA, 2018 bp, Oryza sativa
caagtgtggctgcggagcgacggcaggcggtcgacgacgacctcttcgccgatgcggagcgccaccccctctcccgctggcctcatctccgcccttgaagacgaggttgatgggctcctcatcgtcgtcgccgtccccgggtgggagcggcggcgcagggggctcgtaatcgtcgtcgtcgggcagggcggccttggcgctcttctcgccagagaggagagagagccggccgagcttcactcgcgagcttgtcggcggcaatggcgtccctccgcgcacgagagaagaaaggccaaaagcccgtgaacgcatgcatgatagctatgggttctcaagtgagggatacatgcatgcaatagagagaaaaagaccaaagcaaaagcagcttgtgattgatttgcaggctgcacgggttgaaagtgtatatgtatatattcatgaatggatgcatatatgcatgtaactctaggcctcgcccacggcgacgacgacggtggagatacgacgacaagggcggccacggcgcgcggctgatccgctccgccgccgcgctccgatgcgtctgattcgccgccgaacggccgcgccgcgtagcctcgctcacggcgacaacgacggtggagagctgacgacgacggcggccacggcgcgcggctgctcctcctccgcccacagcctgaaggagaagaggagagaagaaaaaaagagaagaaaaaaatgtggagccccacgtgtttttttaatttttatgtactgaatagaatgccgcgtcagcaaaatcaggcaaaaatattgcgaggggacctccggtaaatggtttgagtaagttaaagggtagacatttctggttttgtggttaagggacctcgaaaaatctagctgttgagttgagggacctccggtgaacttattccttcttttagggcattcacgatttcaaaagtacaaatgacctcctatagtatttaatccggacacatggcgcccccttcctgttctcaagcggttttggcactgaagtagcaatccagtcaaacaacatttttaaaaaatggtgggactaaattgtaagtgcctttccctttctcagctccaacgcctagctcaccgggcactccatgaccagcgatccacgttagttgtttttgcccttgttgagccagccagccacaaccatgcatctcctcttggtatccatgtgctaggcagccagcgatatctaagctcgagatgaggtgagggagggagataagataaagggggaagaagtcgatgtcacttcatcctccacctcactagaccctgcctagagctccacattcgcccacactgccactagctctaattgatccgcaccctaccgctccagtcaaaaagggagaaagagaagaggtgatgagatgctgcggtgctaaagctcctagaaacacacatggtggagatggatctctgcagaggaggcggatgcggtgttggagctcgagctcgcctttgctactgctcgtgggcagtggagaggaggcaaattccccggtggttggcagatgggagagaagtgacgaagagaggaagagtgcatcaagatgaggcgaccattgacacgtgggttcaaccatttttttaatttgtttttttgatggggttgcctcttgtatgtcaagtaggacaaaaatattgttcctcgctaggttaaggcggtattttgtctagtttgaaaaattgagaatataaaatgtatggtattggagttaagagggataatttgtgcttttataatagttgagggggtgggaggtaaattggatttaaccttacttgaaaaagttcatctttcacaatacaagtggcttcaagtgtccacctcaaaagttttttttttaattttagcccttgtatatttcaatctacatgtaaattaaaaaatacactaaaatcaaaataaacaaaaaaattatataaaaaacgtagcgtaacctaatccaacatttattccccaccacccacaccggcaaaacaaa

SEQ ID NO: 24780 - DNA, 1737 bp, Oryza sativa
ttcctcccctaccaccatcacaatgcctcctttcatattgttcgttcccgtcctccttgccaccactgcaaatccaacgtcccgttcctgtcctcctccttgctaccgcttcaaatatgatggtttggatggtgcatgtggttaaagtgcaacctcggtggcactgcttagaacaaacggtctcaacgaaaattttgtatgtagtgatggtttgcgtggcccatggtggtgaagaccctaacaacgacaacagagcagcttgacgtgctaatgagggaccgttgcagtatgtagcgaggtgacaagatcaaccaatgcggctccccttgagtggctctacatagcaggagccttttctaggtgaggcactcattccttgcaaaggggcacaagcttcatgtggaagccactcgcctccactcctctctccttaggctgtgtttggtactctattttcctaactctcctctctcattttttgcgcgcacgtttttcaaactactaaatggtgagtttttttcaaaaagtttatatacgaaagttgcttagaaaaatcatattgatccgtttttgaaaaaaatagttaatactcaattaatcacgtgctaatgaaccgctccgttttccgtgcataggagatgggttcccaacccccacctccgaacacatcattaactacttaagtgcactgtgaatgttttcagtagttcatttctttgggatgagcccacaagcctagataatgttcaagttaggtagtttatcattgtcctacatttacttcttttttgctgttctttatcccaagattaaatctttattattctttataaggatctaaatcacttctttaaatgtcacggatcaatgtactggttttttatggacgacatagtggaaattattgtaacatttttgtgagctgtggttcaatatgtcatattaatttgtgtacctcattgtgtatatcaagattagaaatgtaccttttcatggtcagattaatttgtatcttcgtatacccaatggataaacactaaagcatctggaagtaaacaactacatttataaagtgagaaatggttctctatatatatcccatataactcttgtatctcatttcgtatatcaaagatttatgtgtatattttcataaatggtttagttattcatatcttcatctacattgagtaacatctatctctacgtaaacgactacatttatcaagtgcccttttgtataactttgactctagatagcagtcattgataaacataagcatatctgaacataaatgactacattaaatgactacacttattaagtgacaaatcgttctctctctccaaattaatccgcgtatcatttgtacataaaaacttatgcatatcttttttcataaatgaattaattatgcatatcttcgtcttcatcatgagtaactgcaatctatatggacataaatggctacatttatcaagcgcccttttttaaactatagccacagattacagatagcagtcattcaatatcataaaagaatgcaactcattattctcatgaaggaataattacacaatgacaatattttctttctcaccattttaccttggctttaatcctactttcagtcgatcaatccttctccaggttatagaatagcgtgtaccaaaagcacgaatctaatcacggattataatggtgcatttacaataaaacaatataatcgttgtttc

SEQ ID NO: 24781 - DNA, 2554 bp, Oryza sativa
  unsure (1)..(2554): unsure at all n locations
nnnnnnnnnnnnnnnnnnnnnnnnnnnnnnnnnnnnnnnnnnnnnnnnnnnnnnagagttattcatgatttatattttcaaggtttgacttaaacattgtcctaaacaattttctttatgagtacggagggagtagtctgcagccggcttgcagaatagttccataaacatcattttttttttgtcagcagctgttgccgtttgtacccatgccgggtcacgcgtaccctacgccccctaccggtgctccaccacgtcagcggctcgcgctcgccccccctccacccatcgcacacggcaaacacagcgcaaaacccccgtgtccgttggcaccaccaacccccgctatataaacccccccgtctcctgtcgttgccacaccgtcttctctcttctcctccgccctgcctcgactcttttctcccccattttcccctttccaactccccccaatacacaacctctcaactcaaaaccccctcgaggcctcgagcctttttttttctgcctcgaaacaactgaaaacgcggggggttctctcgacgtccccccggcccggggcaacaccaccgcgcgcggtgacgcggaccggcgtggcctcgccggccccgggcaatgtcccgcagcagccgcggcggcaggcagtcggcctcgtcggccacccggatggcgttcagggcccgaccgggtttccccgtggcgccaccaccacccatgggcccgccgccgcccccgccgatgcccccggtcccggtgatgtatctccggggggtcccgccgcccccgccgtggctcccgcagcacctgatcatctgcgggctcgatcccgcggccgccgagcggactgacgctttccggagcaaatccctcctcaacgtgagcaccgggggcgtttaagcttcgtacgcttcatcgtatggtcctatggtgtttgatctcgtggctaattttggggggatcttcttgtttttttttacgaggtttagttcatttctcgtacgggggttttgccctcgccggaggaggagttgaagaggcaagtggtggtgcgggagctcgataaggtaatgatcgttcgggtttcggagcttaaaggttaaagtttgcgatgctgactggtctgagagccttgatccgatggtggtttttgcagatagtgatgggttgggcgaagagggtggcgtacgaccagagggaacaatattggaacacaacagctacggtgttgacctttgggtcgtatgctttgggggtaaacaagaaatgttcgatttgtgcacaatttctgggattttttttttgtgttgatgcaatgtccgattgattttatagtgtatactgttggagtgatataattattttgcaatgcatttagttatctgtcatatgttgtgctcattttgaacctaaaagtgttaccattaattcgtcaattgcccagtcattttcagccactgctcttggttatgagcattttagagctgctacaggagaagccacgagctagacatagctcgttgttttaatatttggaattacatgtatgccatgttaattttagcagagcatgtttatttgtgagctcaaacaatctttcaatcatttttttgagtggaaacaatttactgctctagtttttgtgtgctaaagaagatgaccagaacctgagagagagagagagaaaaaaaaggagaaacttggttctttggcttgctcattgttctttttctaagcctcttggtgacttaatgatttattctggattgatgagccagaatatgccatagtgactagtgagtgtaagcgaataaagtttctgaatggatagatcatatgttcttagttgtgcttgtgcatagtcaacttaatgtggtgtttgttgatttgacataagattatatggttaaggaatacatagaaagattaaatcttgacatctgttcccatggacaatattctacatgtaaataacatgtaagatgtttaaatccatgcttgaaagactgatggtaggcaaatcagggaattagagaactcactaaatatccatttgtattgttgacattgtgcagagttttaaggatggaaatatacttatgcatacaatcttggctcggttaaacttttattacatgttgataaaatagactgggttaatagtagtattttaactttgttttgcttgtctataacattgcctcgtaactaggaattcccctttgagatttttaatatatcttattgtgacaagcgttgcctaaaatgttctgctttgaaggcatatggacctgaatctgatatagacgcagtctgtgttggcccttgtattgcatcgttacaggtgaatatctctttcagttttccctttgtccactagcttggagctttcgaaattaactcaaggtgtatgtgtgttattggatagcaccatttttttattgtcttgcgacaaatgcttgaagagaggccagaagtatcaaacctggattctattgaaaatgcttaggttcattgatgcgctttaaatttaacgggatggtaggtgattcccata

SEQ ID NO: 24782 - DNA, 9780 bp, Oryza sativa
  unsure (1)..(9780): unsure at all n locations
ggttccattgatgcgctttaaatttaacgggatgttagttgatttcccatatgtccaattgccagttatcaatgctgcagaggcaagtaccttatgtcttatgattgttttgattacatgactatagttacatgctatcataattagtgttctgtactaccttatatatgtgttataattgtcccatgattaattgttgattcagtcaagttttcttaaaacaacacctttcactgaagatatagaacctgctggtgatgtcctggagctaatttgcaggctttattttttaacttccttcaatattttaccatgatatggtttcattttttgcagaattgcattcaatcatgcataatatttttcgaaagcattgcatgctaccttgttaagtacctattaatggattagatccccccagaaaaaaatgaaatgaattcgaggtcatgtgttattgtggggctccagtatcactggctttgattcaacggcgatactggagtcccaccactgctgttgcaggcttagtttgaatgtaatagtcaatgttcaccataacaccatgacttcatttcaataactgagttgtacatttacttgtgctctgtttgatgagtttaaatggcagagcatttataaggaatgacgccttcactgtctttatgtgtatatatagatgtatatatttaattggtttatggaatgtattttttgaaaataatgtattttatatgcctattaatggattaggtttcccccaccattttttcaggcagtagctttagtttgccatttgactgtctacatttgttttagaatgctcttggcctctgcaattaaaatcagttaaaacacgatacataatcaactagtccattcttaggcctccctggtttgacatgtgttgttcattatcaattaaggctaactgtgaaccattttgtcacacacagattgttaaacacaatattgtggtggttaattcaagttctcacaagttgtttggtgatgcaggcaatacatgcatttgaccctcgcttgctagcggcggttaatgaaccaagctggagatgtctatctggagttcgtgttaatagacaaatcatgcaattgcttccaaatataaaggtcgaacactagcctcgcttgattaatttatatgccattctcatattttctcatggtagttgtattttatttcatattttcgcacctttgtttcactttcttattcctggttattttttgttaatgcaacaataatgcattacggttcccttattctatgttgaatcttttatctgctgagctctctaaatttttcttgctaatagtctttttcttttttttaactgcttcctttttctgacgtttaatgcagaagtttcaaattcttttgcggtgccttaaactatgggcgagaaaaagagggcttcattgccatgtatgtggcttacgttttctttatcaatgacagcttatggttttgtcttcttttttggtcttacagtgttatacttaattttatggtgttattttcagctacttggcttctttgctgggatccatttggcgattcttgcagcatttgtttgtatcatgcatccacatgctactctcagctctttgttcaactcattctttgatatattttctcactggcattggcctcttccagtgagtttacttgatcagccaactccttggagacctcattgctgctctttcatgcccatagtgatgccctgttctccaccagaattttgtgcctctagtataacaagaagtacctttaacaaaatcaaagaagaacttcagcgtggttttgctttgaccaaggtatgttgaattgcttattctttatcaactactatttagctaataacccattgtactctctcactttccgttcagaaaaagaaaatgagtaactagtcttagtgcaactagtatatggtcagtccttcctcttttgtttttgctgaactgttatatttgaataatttgttacttgaatcttcagttaactctattttaagcatttaatatccagtctccttttatgcagtagtcagagcacctaccgtttcttttttaaaaagcattgaatattcaaatgaaacaaattgacccacaaattttgttttctttgtttttattattgctatgccatttttatcttttttttaaaaaaacagaagtatttgaagacttaccaaaaaactttgaagctcgtaactgtagcactgctctacacctcactgaaaaataattaaggtccaatttatctgtatacttcatctgctttgggtagtgagatccctctattagtcaactgttgcaaattatgtaatttgctgaggaagacctatttttaacttatgtcaattatataggtggatctattcatgggtatgttttttaactaagcagacagctaggaagtggtgcttttgccttacatggtcttttgctaacgctagaatcctcgataatgttcttgtcagtcatctgcactttggtggactttagggtgacatttgctttcatcgttgaaatttctgctgctaacatctagcttggtgtttgcactgttgaacagggtgataggaatggtgatattaattggactgagctttttgcaccttttccgtatactgtgagatacaaacattttctccgtatagttctttctgctccagtggctgaagaattacgtgattgggttggatgggtgaaatcacgatttcgcaaccttcttctcaaggtttttttttcatcacctgcccattgtttcttcacatttatagctgcaagttctgattgtaacatatccaaactgatgttctgcagttagaaagcattggtgttgattgtgatccagatccctcagaacaagccgatcatagcatgattgagcctaatgtcgtatttttctggggtctcatgtatagaacgagtacaaacatctgcatcgactctgtgaaagaagacttcatgaagagtgtcaccaacgacatctatggaaaggagaagtgcacccattcagacataacgatgtccattgtctggccaacccatttgcccaaatgtgtgtatgctcactcagtttactcacagaatcgacagaatccgcggcaatttatgatgggcaaccaactgatgaatcaggactgcaatgcagtgcgttaggactccattattatctgaaatttgttcggcatctgcggatacctgtttgagaatagttagagatctgatactcaggctgttgagtacgctaacatcatcagatactccgaatctcttctgttttttggaccgaggcttgggatgcttctgtcacaaggactatggagggttttttttctttgttggagctggccggcgagagctgggtttttcgtgtcgagcttctagggcaaagtaagctcaatcgagctacttattgctgttctgagttttgtgcaggtacatgtatattcatgtacacagcatagggggattggtatacatgtaacagaggtatagcgcataaaaagttttataaactgtaggtccaatgtctgtcccagcagcaaaattgtgtaaatcgccacctgtggttagaactgttgttgggtccagattcagaggtcgatatgatagtgtttactgtttaggatggatgtcagtcattcttactgttgtaggctgcaaaactgttgcatgtactgccgaaaaattcttatgtggcaagtcatccagagaaggaaaaaaacattgccattgtgtactcaacattgtcatgcattctctcgggctctgttcaacatagttttgagttatatccctgcttctctgattacctgcactgattatttacctgtttgagactttaaagctggctagctggggcttataaattccaatttcttacatttcttgcttccttggatgggaaatgggatgccagcttactgtttattgagtgtcatgtttccgcttcagtaacatttgtcattgtttctgtaaaagtattatggaaagtcttggttttgaacttcagactatttgaatactcatctaaccttttccttttctaactccattttcccttttgtgaggtgccgtaactttctagtgtctgttgaaggacaaatattccagatacaccaaaacacaattagtgcatgattaatcggattttaattattacaaactttttaaaaatagatttatttgatattttaaaacgatttctatataaaagttttcgcataaaacataccgtttgaaaagcatgcaaacggatatcaaggtaaaatatgtatcctaataaaaagaacgcttatatctcactcatcccaatgagacaaccaatatttttattcctctcgttaatatacgtgtggaatgtttaaacttattatattttgaaaagtagggagtagcaagttttagctattagtatagaggtaaaaaaagcttggttgtcttctaggggtaggtgactaggtggcaataagaaagctaagaggtaataggggttgtatatgtggtttaattagtagcaaaagtcacatttcataagtactatgttgttatatttgaacacaatttaaacattaaaagttattgtattttgggatggagggattagtcttttttaaggaccaatatatcgtactaaatatgaaagtaaatatggcaaaacataccatttatcatgcccacacacatcgcacatacccacacaagtgcgggatggacctagatggatgaagtgtcctgttgagggtatctctcgagagtgcgagggcgaccaagaagttacggtaatttcccacatcctgacccctgccccctccaatttcactggtggtttaccactgacgagggctggaagaggcttcctccctgtactaatatagagtagtttaggtcaaaatcctcatgtagtcaggtcatcctgtaactcgacttcatcctatttttgggtctcattggtgaagttgccatgtcaagaaagtgatgttggtagctgtagttgtaggtttgggtgtccctttgcctctaggaagagggttctcatcagtcatcaagctcatcctccccatcaatggtccccgcgatgagtgtggacggatctaggagggtcggcgtgatttgcgttgcgacgagaggtggaggggctagatccgacacaaccggatcttgcttgtcggtcagcctggtgaacggagctagagatggcggatctagggtggtcagcccattctccatggtgatgatggctggaggtggggcaaaatgggtgtgctcggctcctacttgttggtatttaaaaggtagagctggtatagttcgcttgatcctccagcctcaagtactcgtggttctggatgtcaagcgaggtggcctctcaataagttcatcaatttcttcaagtaagtctttggtgggcttattgcttgatgcctggtgtagtgtctggggttcatgggggtgtcacttctggaaacaccattgctcttcgtggtagtggtcatctagcgatctgtagtcgcaaggttagagtggaatgcatggtggggaggcttgatcgaatcatctcttccatcgttgctactgtgttccgctttcgcttaatcgttccaaggcttaagttcagttgctaccattcctaatcattttgtgtttaaggcaggctggggtttgggattgtcttccaattttccttgcaacagtatccaagatgagaactccgtttctggatgagtgcggactgtttgttcgacttttgttgataatattacagttagtgctcctcagatttggtagagaacttcttggcaaaccattgttgagtccgatcaagcctaagaaaaatctacggctcaacattaaaccttgaacaacgaagttctcgtggaggcaactgaaggggtcgccgatctatcgagcggtgtgcacatctttagtagtggcttgtggacgtagtggccttggcaatgccatagctccccatcgatctcatcaattactattgttttgtttagcttggaggacagtcttcttagttcaatcggctttgccttctgtttgaatggtgttgttatgtatattctatctttgttgccaatgtattggggatgttgtttcccttaaactctgtccttgatctatataaataaagttttgagttttaaaaacaaaaactctaacctaagacctatgttggcctatagtgttctgacatgagcccggtatagcacatgatgccacccatcatagtactatggatcgatctagcacgaaatgcatgctcagattcgtattattaaaatatatcacatctcgtactaaatttgtttattttaggatggataaagtacacgataatattttattgtaacacaggagcctgggtctgtccttgcacacacgagtgggtgtgtcttagcatcttttgattacataatattataataatattataatgtatgtttatcctcggttttgaacacaggaaaacaaaacatgagtatatgatcaaataaaaaaaataatatttagattttgagacaactatagcagtgttagaggaacgttctatatgatgttagcatggacgtcactgaatggaccatttctgcctacacgagttctatagctgttgataagatatgccatattgtggcctagttaacttgcaggtatgtcctatatattaaaaaagaaaatgaggaaatgagcgcatctctaaccacgtcactagatagggatacatatggtgtgatgttagcatgggtcgtgccgaatgggtcattcggactattcatatattatatatagagagaattacttatatgccactacaatttgaccagtttctttatatgccacttaaaattggcttctcccttatataccactagttcaagtttttctacccttttatgccactcccaccactataatgttagttgactgttagtcaaaggttagttttttttcgtaaatgaccaatatgccctctcaactaaaaaatgtgtaaacttctttttgagtgaacaaaattttgtcagaaccagtgaaaaatgctctttatattaaaaatattgttggaaaactgcatgtttcatgcttatattgaaaatttatttgtgatggtaatggctaaaattgcatgtgatgcagaaaaaaatcaatttttatatgttgtatccagtagctatattagtactaaaatacctattattggttgtatactaattctcaagggcaaatgcgtatttttacaatgaagttaacggttaactgacggtggactgacggcaatggcataaaagggaggagaaacttgaaccggtggcataaaagggagaagccaatttgaagtggcatataagagagccagttaatttagagtgacatataagggattctctcttatatataatatgtatactagtataatggctaaatgaaaacgctaatcaaaatttggtaaggctatttattataataattattcttaaaccaaacccatgtaatatcaaattatataactgccattgttgttggtaacagaccaaatacaatgctgtcctaccaaccaggctaaccgaaaggttaatttgtagcaacattgcttgattgccaaaattttatcattacaaacttaaattttagttttctataggaaaaggtacaacactaaattttccatgaaagtctaaagattatctctaagcttggaaatctgacacttttcatccctgaactttatttatgtaagtaaacgcggtatcggaaatttaaggatgatcagtttccggttaactaaagtttactgagtttcgttttcgtggctgtgtttagtttttgaaattggggagaagtttaggaaaaattggtagtttggaaaaaaaagttgggagtttatgtgtgtaggaaagttttagatgtgatgtgatgtgatggaaagttgagatttggagaaaagtttggtgtgaactaaatatagcctacgtaaaaatttagggatatgaaacgaccattttgctttcccatagtataaccgtgcagtgcaatacacagtgaatcgccgtcgatctgcatatccagccggaaagaagagcaaactcgtgtcacgtgccaaacaactaatcgaaaagccctggacaacggcaggagaggaggaggggggcagtaatgaaaagggagaagaaaagaaaggcggccggcttgattgagtggccctttgaccgggagaagaagcccccgcttgctaccccggtcccggtggccgctgcacgcccccggctaccgccgtgcgtccgaagcgatatcgaggagtagcatagcacgtacgatctctcacctcaatcacgtcgtacgtcgcggctgcatgcagcgcatctcctcactgagcggcctccctgtcggcgtgcggccatcaatcgacgacgacggcggcgggccccgcgggggaggggacgggtcgacctcgactaacctgcgcggctgcgcctagcgccgactacgtgcacggcagcaggagagcccaggagaacccccgaaacccacggggtgtccgcagtgtatgtactccctccgtccaagcattttaagttttttttactgtttgatcactcatcttatttaaaaaatttgtacaaatataaaaaacgaaaagttatgcttaaagtatttttataataaagtaagtcaaaaaataaataataatttaaattttttttaataagacgagtggtcaaatagtgtaagcaaaaactcaaaatccggagtgcaattgtacagtaggggcttgcaatgatccgtatttttgggttcagacgtgtatgaaaaaaaggtaggtgtgaataattagataaatattgtggttaattgagaagaaaaaaaacagtataggagaatgatagtgtttaattgagctgtattttaaaaagaaagatcacgtaacttcctgatgtagatccattttgtttctatgtgattatttacttctactagagtttttagtgaaacaaaactgatctaccactatgcgaaatgtgaaaatcgcttgataatttgttgttgactctccaaagcccccgcctaagtttgaggattcctgtggaacgaaaaaaatataggaatttcttatctttgaaattaccccatttgaaaggaggcatgaacatatctcatggggtgggagctttgcaccatgtgtggtcatgtaacagtagtactgtcataagaattgctctcttggatggctaaaaagaaggtattgacatggtcactctcgagactagaaattttcatattaattgaaatgttatttttttattatgattgtatagaaggtatgattttatctagaaaaaaattaagggctactttggaatggaaaattggaaaaaaaagtaggaatataaaaaaaaaatgcaaaacacaatatgggggaaaacacaaaatctggtaaaagatatgtttagatgcatcatatggacatgctgccttcgactttttgaaggaaatgtaaaacacgacctttgataaattttggaatcctccaagtggatgaatggaagaaatcctattgaaattttggaataccttcctatatatacaattctttgagggctttataggaaatatttttataggatttcaattcttggatgaagttcctaagaaaaatacttggtttcaaaggagtcacaggannnnnnnnnnnnnnnnnnnnnnnnnnnnnnnnnnnnnnnnnnnnnnnnnnnnnnn

SEQ ID NO: 24783 - DNA, 3305 bp, Oryza sativa
  unsure (1)..(3305): unsure at all n locations
nnnnnnnnnnnnnnnnnnnnnnnnnnnnnnnnnnnnnnnnnnnnnnnnnnnnnnnnnnnnnnttttcccctgaagttcattactggatgccatcttgtttcagaaaaaaaaaaatctttctctccgattttttgataaatcggatcggatcaatagcaaccttctgcaatggggaggtgactggctgttgctcatcccacggccacggagtcacgatgcagaggtccgattgtgctgcgaccttctgtgagccgttggattcactagcacgggataggtctcaatcagtgtcaggaagggctaccatcgctaagcaaaagtcactgatgtgagaagttatcttaatcgggtatttgaccgtcacgaatgataattatctcaatcggactaagcataaggcccatcatagataggtttggcccagcatatgagtcaaacgagattagttatggcacccgccacggatgacgggcattttacccgttgcaacgcacgggcatttttttagtccctataaaatttgggagtataaacttttaggtatacaaacttattagaaatagaaatcatgtggtgccaaatattaaaagcgtgtgtgttcgtgtggggcctagtcaagcaaatgtttgtgctatagcccttttgtgctatagcccttttcgcattgcggttacccttgcctctatactatagtttggcccattttaacgatcttacaattttgtttttccgattttcacataaatgatggcatgtttggttaatgggttcttcgaataaataaccacccactatagcaagttttaatatgaactatccatatttctcagctaatttcgtcctaacccttcattcatctctatttctcaatcccacccttcacaacccatcaaaacacccctaaattgttaaagccttgtttagcatatgtggggaactttctcatttcacgttgagttaaaatgttttcttgtgaaactcccattttccaaaacaatacttatattggaaccttcccgtaaagattttaaaattcacatgttaaaacttcaaaccgccgttgatgtagaaggagcaagtattaagatctcataagatacgcacatggagagcaataacatcattttaggtgaaggacggatgcaagtccttagtcgatatgagatcgcaatatccccaaagaccaccttcatttggagtttgtgtagaaggtgcctttgataaggagtggttcatcttcatctctccattctattctctactttatcatttaatcatgtgatgccttaggaccagtgcttaaaaccttattaaacttactttaacatacatttcgacttgtactcatatccatatcatatacaaatgttaatgaatatgttctgatttgtatttgatcccatatattatgactctcgactaggggtgaaaatggggcgggtatttcccgattgcccgcccgacccaaggctcgtaggagtaatatgggagaaaaaaatgggatacccgatactatccgaggattcgacctgcagtcattcagaaatatgggttaggatacgggaagacatgtatccgcccgcatgtcccatattataaaatatgtatgaaaaatctattataaatccacctacaaacatgataaaagattggttaatcactattttacgagctcacatgtaatattgtataatttttttcttgatatatctcttttaatactttaattatcttattatatttaatatatatgaattagagatacaatatatatccatttccgaatctgattcgaatgaaataatatgggataggacacaggatgagcgatatcttattcggcactagccatacctgcctccgaatttaaagaaaaatataggttaggatataggaatgccaatccgaccgtatccgcccgttttcacccgactacctatcagtgactcgcacccgatcaaaaaaagcatatgaaataaaaaaaacaccagtaacaaaaagaaaaagtgttgacgacacgagacaacatgcgtataactgaagtagctaaaactatacaattcaactaggaattgaacacatgagacaatttataatttgacgaggctatgcaatataattttctcttgtgcaatttgcactgttaatcgcaccaatactttccaagcaaggaaaaaacaaagagaaaaggaaccaacaccaacttgaccactttgaaacgagactcgcatggccatgagcacagaagcatgttttcgtggcatgtcagatagctttgaagataaattgtatagatgtagtgacgtttatctaaagtatggaaccacataaccccatactcaaactggagggattaaaacagcgacatgtgtatgtaattgattatgataaatcagccaaaattttagcaaaaattagagaaacatgcgtttgccgggagtcgaacccgggtctattgcttggaaggcaattatcctaaccgttggactacaaacgcaattttgattatttatattctccaaaaatctaaagtttggaaacgtacaaaatgttgatatgaatatcatagatatactggtcaagaagttttccttttcacatgacatgtaatacaattgaaattttccagtgggacatgaatgtattttgtaggacttctgtgtgtttgtagatcttctagtgtcaaatatttgcattccgatggtgcccttaaagtttttcattctgccaagagtgtaaagtacatatagggtgtgtttggcaaatagaatataggagatgggattgggaaagggaaatggatgagtggctaggattaaatgatgtgtgaagaatgaatggctaggatgcaatattgccctttggagtgtgggtcccaatcccatttgctaaacaaaaccatataaatgtaacagcaaagaaagagaccaagccatcttgcgaaactcctaaattggtgcctttttccatcccatttcaccttcgaaaccatttaattttgcaattatattttcatgtatacattatagagaatgtgaagtaaaaaggaattgaagccttcagaggaatcaaaccgtggctatttagttaggagaactcttgtctcccttttttatttccctacatagagctgctgctgttgttgttatgagtaaaatctatcaccggtccctaaacttgtagcgttgggtcatcccggtccctaaactcgcaaatcgaccgttcaggtcctcaaacttgtttgactgtgtcatcccaatccctaaacttgcagatcactcgtttaggtcctccaactcgttcag

SEQ ID NO: 24784 - DNA, 2575 bp, Oryza sativa
aggacctaaacgagtaatctgcaagtttagggatcgagatgatacaatcgaacaagtttgagaatctaaacgatcgatttgcgagtttaggtaccgagatgacacagcagtataagtttagggacaggtgacggactttactctattattattattattattattattattattattattattattattatttcttacaagttacaatcgaaccgtaattgtaaagaaaaatatcattttaaaaatcttaaaaattcaatagaaaaaaataaataaaaaaacctagatatatattattgccttaatgtctatttagcaacagtttaactcttgattcttgttccttagagttagaattgaagatagagctaaactaaactttactatctttttcaatcttatatgagtgaaatagatggatttgctaaaaaaatattaaaaaatcgagctaactttttataagggcatccacattgttgctttttagccggtaataagcaatacatgctctcttcctacccggtaggaagcattgtgagagtggcaaagagttaaaacctggtcatacagctactaccgatgaacaagagataaacaatattatttgtacagtgtttctgacagaactcgtgggaaggagtcatgcagcagtcacgggaattttactatcggtgatttttttttagctgggcccatcttattcctctccaacgcgcataaacaatgtgaagggtgcgatggtttaataccgtctgacctcttagcccacagtattgccgaagtcggcagctaacattgtgcttgccttaaccccaactatatacgagtttataccggactccacgtaaagagccaggtagaaatgtagaatatgactacaacacgtatactgagtaaaaagaaatacgccttttgaaccggttaacggaaaagaagcccgttcgcggttcgccccttccaaaccgacttccaatcgcgcaattcccaaatataaatctggcgaccccaacagagccgagctagggtttcgcctcccccgccccgcctcctcctcctccgcaccgcgcgaaccgacccgacccccacttcgccgccgccgccgcagccgcagccgcgatggggacggagcggaagcgcaaggtgagcctcttcgacgtggtcgacgagacctccgtctccgccaagctcggccgcgccgccaccaccaacggctcggccgccgccgccgcggccaacccgtccatcaatcggtggacggggaggccctactcggcgaggtacctcgagatcctcgagaagcgccgcacgctacccgtgtggcagcagaaggacgatttcctcgccgtcctccgcgacaaccagaccctcatcctcgtcggagaaaccggaagcggcaagaccactcaggtattgaatctgtccctgtgcctgtacatctcaacattgaactgtaaaagtattttaggtttgtcgttattggttgtttattaggggatcgttattggttaggttttgtttgtgtattgagatgtgatgatattgtgttatatgattaggggatatttttcccctagatactagtggcatggagctatggtaaattggttagattttgtttatgtattgatgtgtgacgctgtgtcaaggtttttggttgctatatgggtgccttattgatgatttgttcttggggattaattcgttttctgttgatcagattccccaattcgtgctcgaggctgaaggcttgagcaaccgctcaatggttgcttgcacccagccgcggagggtggcagctatgtcagtttcccggcgtgttgcggaggagatggatgttactatcggggaggaagttggttacagcatccgttttgaggattgcagcagtcacaaaacagttctcaagtaagccttagtttgtttatgtttaatggaagaacatgattagttgcacatcctttggcagattgatatggtgcggatgtttctttcttttttaggtattctgatctaatcatgttgtgttgaacactattgcttcctatcagatatttgacagatggtatgcttctgagagaagctatggcagacccacttttagagaggtacaaggtgattgttcttgatgaggcccatgagcggacattagcaacagatgttctgtttgggcttctgaaggaggttctaaagaacagacctgatttgaagcttgttgttatgagtgctacccttgaggctgagaaatttcagacctatttcagtggtgcaccgttgatgaaggtgcctgggagacttcatccggttgagatcttctatacacaagaaccagaaagggactacctggaagctgctatcaggacagttgttcagatacatatgtgtgaacctgctggagatatccttgttttccttactggagaggaggagattgaggatgcctgtcggaagataaataaggaaattaataacatgggggatcaggttggcccagttaaagttgtgcctttgtattctacgctgcctccagcaatgcagcagaagatttttgaacctgctccagccccatcaagagagg

SEQ ID NO: 24785 - DNA, 1341 bp, Oryza sativa
tggtacgtgcgactgatgagcagcggatggggaattgggggagagaggatggagtgggctgtgggctgtggagtgtgtgtgtggatcatgggctgcagaagcagtaggccgcaatgttgaaatcctgccgagcgaattgcgaattcgagggccgcgcaagagcacccgcaacggtaaagtaatgtgctctttataaaacatgtacatctcagcaatagactgattaatagtaaaccacctcaatagtatgtctacataggtatctatagctctctcatcaattgcctctttttatctatagactatctccaagttagtagatagttttactctctctcttttcatttaatctcttccaagtaggaaaatatgctgacatggatcttttatagaaagcttatagataaccattgcgggtgccctaagggagatttttcaccagaattagaagtttttttaaacagttcaacctatcgttccgattcttagaacctataaaatgaactagaaactcagaaggtagaaaattcagctttttcatattctcagaagctgactactgaccaactggttcttaaaatacctatttattagagttacaacttctaaatttagtttcaaaagttaaatctagagtgaagtagtggagcagcctaaatctagctccacctctttagttcattttgtgagagctttacccaggcacccagctcaactgagtgaagctagctagtctcctttataagagcatctccaagagaatgggtaagtgactctccaagccaaattttagccatagcagagaaaaaatagcctccaacagcatctccatcccactggctaagctatatggttagccaaacactccccccaactagctaaatctagccagccacaaccacatccccaaggctggccaaatgctctccccgctacctcttgcgatgcaacggcgaggagtagcagcgttgccatccgttgcagcaccgccgtccctccgagtagcctcactctctctctctttagcactgccctccgccggctcgaacaggtcgtgcccagcgcccgccgcggtggacgaagtcgacagcggcggcgtctgcggcgtccccataggcgtggacgacgctcgctgctgctgctgcatcggcacgccgtgcgagtggtggaactgctgggacggtgatgagaaggagaagtcttcattcggccgcctctgcaggtcgcaaccgcggcctccgctcggcgtggcccgccccgccgctcgccgaagccgtcggcatccgctcgggatagcgcgccgcctccgctcgtcacaaccgcggcctccgctaggcgtgc

SEQ ID NO: 24786 - DNA, 8257 bp, Oryza sativa
cccccccccccccccccccgccgctggcagcagccgccggcatccgcttggcgcagcgcgccgcctctgctcgttgcaaccgcggcctccgctcgccgctgcctgtcgcctcgccgctgctcgctgaagcccgtcccgcacacccgtcgccgcagcatcagaggcaagtccagtaggaggaggaaggtttatgtatgagtggggaaaatggggtggaagaggaggaagaaggttatagagactgacatatgggtcccattggttatagacttgtaatggagagggtagatagggaggctgttgaagcgagcaacaactttaacttgctaaatcaaatgggtagctggctatatggatgtttggagagtctattttagagaagctgttggagatgctctaagagatggagctaaaactagagttgtgacaaacaaaccctcaagttggctagtctactatgtttaagtttgcatttgtaccatacgatgcacgatagttttcatgcagtagtaatacttcttcagtaactagcaaattacccatgtcatctaatggtataaaaacaaaccggtttgccgtgtttttaagtaggcagttagtttttactctctccgtttcacaatgtatttatattgatgttaatgaatctatatatatatatatatatatatatatatatattcattaacattattattattatgaatatagaaaatgttagaatgacttacattgtgaaacagagggagtagtttctaaaaaacattggctggtttttctagagaaactgttcgttttttttccctggaaggacagggcgaacgatcaattttctagtagcagttacgtgggtgggggaaccactcccttctatgcagagaagagaagataaaccatcccccgcctgcaggttttggttattcttcttgtagaaaacaaactcgcagataattcttctgctactgcctactggtggagtggtggttctttcccaatctgctaaggtagattgagatccgctaagagcatctttaacagcctccttatcccactttccaaagttatattatagcaattttggctcaaatttgcactccaacagcctggctggccaaagtcgctcgcgctggctaaatcgtgggccccacctctattctctctccctcctgtagcctctctcctcctcccaaatccagtgccgcccgtagcattctctccgccgacgccgcccatccgcgccacccctccgccggcgaagagagctccctccctgtgccggcgaagagagctccctccctgcctgccccaccatctgcccagtgccgacgtcgtcgtcctcccggctccgtcgtcgttgtcgccctcacagcgccgccgccgtcgtcctcccagtgtcagccgccctagcgccgccattgtggccttccctcgccgtcgcctcgagcctgccttgcgtgcgcacggatttgccgccaagagcggcaccgacgggtggagcctgagcagcggcggcggcggatggggacacagcccgagcggcggtggggatggggatggggcggcggcggcagatgagagagggaaggggggtttggagagaatgggagaaagatgagggagaaggaggtgtagagactgacatgtgagcccaattgtaataaactcaaaatatagaggacgaatagagtggctgttggagtaaaagacaatttgacttgctaaattaaatggagagttggccaaatagacatttggacagtcaaatttggatagactgttagagatgctctaacctacttatatttaacttatatcattgatatgtggaccctctacccaataaactcacgtatcagtgactcaaagtcagaaggaagaaagtcagagggtcctcttccggctaaggttatatggaactacaaccgaacagatttttagctttccttctctcgccaagaatttgcgatgaactttgggcattgcagctgtaggaaacagaagttcaatatcaagttttatagaatcgtggcatacattgccgacatgagcatacgagattgacccagagaagagtcgatttacagactagcaatcagccacccctactgatatgatattgacaatttcatttccgttttaatcacctggaaagaaacaccaggcatgactaggttctcctaaacaccgtcaagtaaacgctacgttcagtcacctgcaagacaaagtaagaacatcagatggaattaaagaatcttaaaactgaaaaccggctgttaaaacatctacatcttgtcaaaaaaagcaatgcacactcctaaaagaaattttcttgtgcataaccactataggattaatacttctcatcactcagaagctcaactcatatatgctcccatttcaacatgaggtgtctatttaatttctaggagagcttcgaatgcatagagttctctgctcaatctaaagacatgtttcatttccaatagcttgaccagtcaaagagagcggtaaataggctgagtcattcaaaccaaaggtagctagctagctccctgccttctcatcactaaataggctgtattatacactcatttttctttgttatatgcagcatgagttaatttctccttggtcttggtgacaaaagtaataggtctaacacatttggatcgagggagtacttacgttgtatgccaggctctcctatgtgtcatcactcatttgctcctatggcatgaaccgcacctggctcatcccacctgttgggtttaaaacatgtccgtgctgtcagctcctttacaattgacggtttatttaagcctctattatcttatcttattattatagtaccaatatatgaatactgtcacatgtacaatataatctgttttttcaagtgaaaatttcatattgctcagcatcctaccttttttccccctagagttacattgttttgaatgtgatccaggactaaagagatctgacaatgcaaatgatcctacaagatatctacaacgtttaatgctcatgaagttacttgccattttgcatagttttagtttctataattattgaagagatatgaaccttttgactgttgactgatttacattttaattacaggacacccttggaactgtaaatcctttcatctcaaataattttatgtaacgaacaagttggctttgagtgtttcatctacctatatgctttgaggtgatagttgagtgtctttcaagaagagattgttgggttaagcaaaatgctcaaggtagtggacacaaagaacaaaggtgtaatgttagaagataaagcgattgccggcagctactcgaggtctcacgaagacgtgactagagtgacgaatgtagcataatcatggttaattgtttgttattaggatagtattgtttatttcagaacaataaattgtaggcaaattttgctacaggacatcacgattttatggttttagctataggacaccgcacaaacttacttttagggaaaaacactctctaaatgtggttatttgccagtggacaccgcgtccattataataatgtattcgtgctgacgaggcaataggggacccaaaagtttacgcggagtgaccaaactgcccctgcgcgttcaggtgatgtttggcagcagcttcttcccttcctctctctacagctacccaagaacatcttctctcttcctgtctgtttctctctctaagctagctatattcaaatcaaatatcagatttgatccacgataattgatccacaggattgaaaaaaaatcagattcgatcaagtctttcatcctgcagaaaaaaatcacagaggaaaaagaaaaagaaaaagaaatgacgatggagctcgctgccatctccaacacctcatcgtcgctgtcgaatctgctttgcgacatatgcttgcctccgccgcgaggagctcgcctccgccacctttcacttgcttcgccgacgtcccgccggcactctgcgaccagctccactgtagccgttgctcgctccgtcaatcatcgagaacctgcttgctccatcgctactgctgctcccctcgccgacgcccttagtgccgctgctcgctttgctaccgtggcttgtgcgctgggtagggcttggagctgctgtatttggggctgatttgaagctgtgcataccagcggtgcctcctctaactctaggaggcgcgggtggtccggcggcgcccacggcatattcctgcggccgtggcactagatgtcgccgtgctccacctactccggctcctcgtcatgggcttgctggaaacggttgaggaggataaagggaggacttcccctcaactaattttactcgagagcaaaaggagcagccggatttggcggtcaagcggcgacgactccgactctgccccgaccagaggtagaagataagcctgacagatggggcccctatcgccaggggtagtttggtcactccgtgtaaaatttttgggccccaatcgccatgtcggcacaaatatattattttaatggccatggtgtccactggcaaataaacacacttagagagtgtttttccccaaaagtgagtacgtgcggtgttctacagctataatcacaaagttgcaatgtcctgtagcaaaatttgcctaaattgtaactacacttcgtaccacatatttgctttataaacctatttacaatattactagaaatcacacatttaaaaattaacaaagatggaggtgatagtcacgcaaaagcacgataaattattagttgtcctgataatactgttaattacaaatcaagataaatttgttaacgttgtagttacacttcctgacaagtatgttctataattgtatatttgcgttgttttgttattgcaaatttaagctaattgctgcaaacatgtaagcatattcaataaagagggaggttatagccacacaaaagaacgactctataggctagttattacatattaagtgcaagaaactatatgtagatgagtgcacaagcttttcatgaggcatggcaatcatccatgtgtatgcaatactattagttgctaaaagactataaattgcaggttcaaatgaataactagatagtaacagcgattaacattcaaagcaaaatgacattcaagtatctggaacagagaaacaccatactcagattaataaatttaatagagctctgcaagtgagtacattagggtaactcagattccagcggagcaatattttaataccttataagccaaaatgctccacttcttcatcttccccttcatcctcatcctcatcctcatcatcctcagaaatcctgaaatcttctaatgccgcctcctcttcctcctcatcagcatcatccatcatatccgtagcacgatttttgtccttcaaaccagtgctgagcacaacagtctgtcctttagagttttccatgtctctttgcaacctttccatgttctccttcctacgctcagcctctaacctctctttttcagcaatcctcttgtcaagatcagccctgaaaagtttttttataacaaccacttatataatttttgctatgcatatatcagtcagagatagcagcactacatcgcaagttaaaacacctgtaattctccatgtattctttggcacttgcttcaatagcttcaaaaaatgaattgactccagcgccagatacggcagatactccaacagaccgcagatttttgtaaaactcatccaggacaagagagaggcttcgggtaaatgtagaggagtatgatgagtcagaatccaaggcggtctgaaacgcctcaaagtcttccatccactgataaaataaacaacataatctctggttacagaagatgtagggaaaaaaacagataagacaattaactaacaggcccaatcaaatttgagcaaatatcaatcaagtgcaacagtttcaacttgattaaataccaaagagagtcgttgcataatgccgataccgcattactgaaatgcaacacttatggtgtccagaatcaacaacaaaggaattagatattcatagatggcaaacatacctcaagagcaaactcatgcttggcaacatcaaccttattaaatgtcagaatcatcggtaagcgggtcttgtacagaatactgcaggcataaagcatgttgctcatgaaagtaacagggctcgttgatctgggggtgtcaacaacatatgcgacaactgttggaaatgtcgatgcaaaagcttctgttatgatagctcctgaagccgaccaagtgaagatttcaatctgccctggcgtgtccaccaggacataatccagctggtcggctcgtctttcaataacagatataacctgtaaagacaattattaggtgttacatatgatcattagcagaattgcatcatgtgtcaaccaaatttatctgtacactgcagtaagcaaaaagcaagctcgctttctgaaccactttacatggaattgtggaaatattatcccatcaacatgataagcagactgcattcctttaacaaatttactagactagtcatcaacccgtgcatctgcacgggctaggggcatattttctacccttatgtttattttatatcattattgacatatttgttaaacattataattttatattatgttgaccatccaacagtatcaataagctagtttgttgagaaatgaccattatttagtgtttccctacacacattccatacagctattagaaccataattagacactgtgcaagcatctccaggtaagaattgaaaagttacctatgcagaaccaattagtagcatacatgcacgataatcttcctataaaccaaattaaattagcattcattacattgtatcttttaagggaacaggactcaatctaggcaagtttatttgggaatctctatgtgctgcatgacaataacacttctaattgaatattacgcgtgtatatgtgaaatcttgaactatttagaaactattaatgaaattgaactgtcgaaacttatcgctgaactcttcactgtccatttctgttgctccctaactaactatcgttgcatacaaactaccattgaagtgattaaattgcctaagtattgcctaacttggtattgaagtacttcctgatagtgtgcattcaagtaacccaatcctaacaaccacttgatctaaacacatacggagatgaaatatatgatgatcgaaaagcacacctcgtcaaacttggtggagaataggttgagagaggtgaggataccgccattggggccaagaccatactccttcatcacctccttgtaccgaacggtatcacggatatctatgttggccccaaacggcagcgtcatcaccgcagggtcaaggttgagcacataacccctcatgtttgaagcctgggtgtggcataccagtcggtgcataaaagttgtcttccccgtccctacatcacataaaccgagacccttgaggcctgagctcccaatcccaaaattactcaacaagagctcattgtatgacaggttggttgccactaaacatcaaaggatgaaccaatcagcatgcgaaatcgatgtaccggccatgccgatgacgatgatgatcaccggcttcttcttgaaattggtgcgctccgggccgatggagaggctcccgatggagtccgcgagctcctcgctcttccccttccccttcgcgtcagtctgcacagggtccatcatcaggggcaaaaaaaaaacagtcacaatcaaaaactgaaggtagaatccccgtggggaggagtcgggcggcggcggcggcggcatgcctggtcctcgaggtccatctgggtgggcttgcccgcggcggctgggtcggagtcgacgtccatcggcggtggcgcggggagaaggcggcggccacgcggcgagcgggtggaggacaaccgcccgctaaaaccctagagactactgcgcttgcgactgcgaggagaggagagagagcttgagaaaggaggaagtggccgaacgtggatgggaagggagatggtcagtactcggcagtgtgaacatgctttaaggttttggacttaccgactttagttgacccatgctggcccatcaaattttgcgggctgacccacaaggtttcgtgccggcccatcatctgaagcgccggcccaagcacggtagtggcaaatgagccgctccggcatgacccacaggctggcgtaccgtgccgtgccgt

SEQ ID NO: 24787 - DNA, 11925 bp, Oryza sativa
actcgcatggcccggatatcgctgatgcacaaaactgtggcttccctagcatgaatttccatgtaacttgggacaggatgggcgttgttagcttgcttgacaccggagttggctgacggatgcctggattcggtctggccacagctgctgcgctatcgaaatctcctaccccatgcagtagctggtgtggcacatgtgagtgacttcaggaaaggaggacatggacggaggcgatcttggtggcggcgcaaacggggcaagcgtcaacggcggcctcgcaggcgccgcacaggcacaggcggcagcacggacgcctacgtgacacggcaggccttgcacgacgtcgccccggacaccgcgtcggtggcagtggcggcggcgccgccgcctggggtctcgaagcagcacgactgcgcatcctcggcgtcgccctcccccgcggtggcggcgacggcatagggggactggaggagctagtcgagcatcgcgcggaggccggcggcgacagcctcgtggctcttggcaacgcccatccacgcctgcccttccgcgctcatctggcggagcttctcctccagctccgcgttgcggcagcgtgcgcgatccagcttggcctccgccgcacgcgttctccctgttgtggcgcgcgccgcggccgccaccagcgcccggacgtgccgtcgctgcgcttcctccaaccccgcgtgcatccgctcggcttgcacggcatccaccaaacaccgacaccgattaaacaccactcaccaaacacaaacagaggaggccggcggcgtgagcgggtgcgtggcctcgtcgtaggtgaagaagagcgaggcgttggttgtcgggatgggaggcctgttcccacgtcgccgccgccaccgcgtcgcctgtcgccagcctagagagaggtaaagtgagacagagagtaaggacgaagggaaagagagagatagtgatgacgtggcacgctgacatatggggcccacgtgggtctcacgcgctacgtaggccaaacccggggacaaaaccactgaagcaactcgggtgaccggttttgtatagttaagggatctcgcatatttgtttttgtggtttgaggacgtttgttaatcccgatgataagttgagggaccttcggtgtactttttccaattccggcaccccggttctgttcccgtatggggccgacgaactgagcggatctgccgggaagaatcgttgggcttgatcagacgaagaaggcccaaaatggaatggccgggcccgtcaggaggaaataaaagagacatggaaaagttcgagtaggccccgcatatgctcgccgaaataggaataagttcacttcatgaccctcaaatgtgatcgaaccctaaaccacaaaaccggatatctcgacccccaaactcctaaaaccggtgtaatttaaccacctcgacggttttgttaacgtggcgtctacgtggcgatattggtcttcgttccatgtggcgttgacatggcacttatgtgacagtagaattaaaaaatatatatggaaccattagtcattcaaaaaaaataaatgtgggcccactgacatttgcttcgttcttcctcctccctctctcccttctctttctttctctccccttcttccccttcggccggcgggcgggagggcaacgagagcgagcggcggcgggcggcgacgaacgcgcacggcatcattatctgactgctccccaccacgcgcacgtcgccggcggcctcgcatgtgtcggagcggcggctcgtctcgtagcacaccggcttggccccatcgccgccgcccggtgggcttcgccggagcggcgacctcctccgctgcagcatcacgaggagaatcagtttaattagatctggtcgcggaatctcgcagccgaatccacgccattctttagcgcaaaactccagaaagcccaagaaataaattatgaaccaggatagcaactcgccgggagaaaaaaattcaagaaataaattatggatgcttcgattccttttcctttttttcttctcctctagtccttgtttgaactaaagccaaatcgaaagaacggatatgaaatcgccaagaacgaatcagccaagccagctcaagcaatgcgctgcactgcgccgctcacgcgcgagcagatccaagaaacacatctcgtaattaccagctgccgacgacaacgacgaggactagtcgccggattcggtgttgacgacgacgtgattggtggtgacgacgagcttggattcgtcggccacgagcttgagggcctcgcctccatcactagctgcgaaggagaacctccaaatcagctctcgcctctcgccatagcagcatccaacaaaacaattaacagcggcggcggcggcggcgagaggaagaagaggaggatgggggagaacctggcgcggatgatggagagcgcgatgagggaggagagcatgagtgccaggacagccgcattcctcagcctcctcctcggctcccctcctcacctcgccgagctcctcggctttttcttcttgcctccctttctccctctcctcagttgccgagctgggaagctgagctgagctgagcaggtgggtatggggattagtagcagcaccggcgagaagctctcctcctccgggcggtggtggtggcgggcgccggagatggggagtaggattccgggctcccagccctcgcctgccctcccgcctgccgccgcagttccggcctcgccgcccgccgccgctcgttctcactgccctcccgcccgccggccgaaggggaagaaggggagagaaagagagagaagggagagagggaggaggaagaaggaaagcactgccacgtgggccccacatatcagtgggcccatatttctttttgtgtgaatgactaatgggtcccactcatattttttaattctactgccacgtaagtgccacgaggaacaaagactcggtcaatattgccatgtaggcgccacgtcagcgaaaccgccctccaaaaccgccgagggagtcaaattgcaccggttttaagagtttgggggggggggtcaagatatccggttttctgatttagggccatggattagatttcgatcacttttgagggtcacaaagtgaacttattccgccgaaataatactgttgttccggggtaccacgcgctgtctccagaatcgctaattctctcacgcgcgtatcaggcccagaaggcccagtgccggcccgctagcgcacgcctcccacgtcttttttttaccgatatttttcttttttacccacttttttctgaatatttttttaatcttttagcatgttttgagtttgaaagtttttaaattttgagctgaaagtttttaaatctcgacttgaaagttttcaaatctcaagttgacagttttcaaaattttcaaatctggacttaaaagttttcgaatatcgagttgaaagttttcaaatttcgagttgaaaatttttaaatctcaaattgaaagttttcaatttttcaaatctggacttgaaagtttttgaatctcaattctcgagttgaaagttttcaaaatttgactttagaatttaaaacttaaatcgaaagttttcaaatctaacttaaaaaattttcaatatgttagtaaaaaaatctccaaaaaaaaatctccagaatctttcctaattactatcattagtgttaagtatattactaatagaggtagttaagacttaagaggggagtgctcgctagcgacacgcacgcgctagctaggagccccccgctgtctcgccatttcatggcttagtaacatctaagaaatatcggagtgatcgtgatcggcgtcgaaccaacatctcatgaatttttgcaaatcatgaaactttaagcatgcctttaagcattcccatcgacgtaagatcagattaaggagttaattactactagcaaatagtattaggaatgacctaatattaaataattaaaaggggtgagactttaaacccaggtcgtctttaaacccaggtcgtctagcccatcaccttatgaagctagccagaagactaatggacgtttttcggagttaattagtgctagagtgcttaaagttctaaaagtttaatatgatcttacatcaaaattttatgaccaaagggttcgttgtggttggaggaagtttgtaggacggattaagggtgtctttggcacccctttttctcaacccatctctctcgttttccacgcgcacgcttttcaaactattaaacggtgtactttttgcaaaaaagtttctatacaaatgttgcttaaaaatcatattaattcattttttaaaaaaatagcaaatacttaattaattacgtgctaatggactgctctgtttttcgtgttactattccgggttgggaaccaacatatgcgaacacaccctaagagttcaaagggatgggactattaatgattctgtttggttaggagacttgagagttttggtaggataagatagagaattgagggagtagggatggtaattggaagcaaaatccttaaatctcaaccattcattttttatttaaaatttaatcttcaataaacttcttatcgagtcccgccacctctattaaagaagaggttgagactaaaaattaaattttcatgttaatctcactggtcactatcaatttttggaatgattactggctgctaaacaagcctctctgctaacaatttcaagccctgcattttcactctatgcacaaacttgtctctgttgtagtgacaattcaaatggggctgagcgaatcctcggtgccacgcctttcttcggctgtagagcagcaattgacacgccgcccaaaccctgacagatcaacaagatctcaaaaaatagctgtccccgatagatttactggagctctcaccaccaagcaagcctatgagctcctgctaccttcatctcaaatggacaagaactgccccccccccccccacccccgaagatacatttttttgttggcttctatcaaaagagcgcctaccaacaaaacaaaaaagaacctgcatgctaagacaattgtctcatccccaacttgtgatatctgtggactcaacgatggaacggccagccaccttatacctgctgtgccctttcacctgcaacttctgggcagccctctttattgaccctggaatctctgatgtacgagatgtcggctgcatttgccccctgcaactgcaaccataccggtggcgcaccatcggaccttcttttttttttttttgagaaccatcggaccttcttcttgctctgctggtggtgtatgtggaaccgctgacacgatgtcatcttcagaaatgagcaaccttccctacgactactccttcaacgctgttttgatgaagctaacttgtgggctgagcgtatccggcgccctgatcagattgtagtttcagcctggaaagaaattttctcccgtcctatgcaactccaacatatgtaatggcaacggcactgtcgttctgcccgtcccatataaccctctttgtaatgaaacctcttatcaaaaaaaaattcaagtggggaatctctcctatccggtgattatccaaaaaagataagtgatcactatcaattttcttccctcatgttaccaaacaaatccggaatttctctttctacacaactgtttgcgtcaacatatagatttacggtcaataattctaggcagcaagcaaccagccaccaccagcagcatcagcagctagcaagttcgcgatattcgcaagcctgccagataatcgtgcccacgctgccggcgaatggacatgcatcccttgtggcaaattcggcgtgcagtggatatggatttgcccacaatctctgaatgcaaccacctgaacagtcaaataaggtctgcaagcaagaacaaagattctttgcggccggcgaacgactttcgacggcccggcgagaaataaaagaacaaggattttgatactacgctcctgttttggctagctgtttcccctgcaagcacatctctccttccccatccactcatctttataagctccaaccagcgaaccgaagacacaacacgcatctaacatctgtacagctactcgtactagctaataacttgtctgtgtaattggcgctatggcgttaagcaggagaacgcgccattgcctggtattactacttgtctccttggcattgctcccactgggcatggctacggatcccattggcggctactgctcggagtcggggacgagcgatgctgaaattaacggcaagacgaggcggcgcagcatcaactccgtcgtctccgacctcgtcgccaaggcggcctccaacggtggctttgccacgtcctccgccggcaagggcaacaacgtcttctacggcctcgcgcagtgccgcggcgacgtctccgccagcgactgcaaggcatgcctcgtcgaagccgccaattacaccctctccttctgccactatgcatcggactccaggatgtggtatgcagctacgctagctacggtccagtgcgtcaatattcgacagattttattccacttaagatacaaattttacatcagttttcatcaacatgttttttaaacggttgaatgatatattttatgaaaatcttttctatataaaaagttgcttgaaatattaaataaattaaccatgtgtcaattggtttcgttatttttcatgccctaacattgggccggttcattttgatgacattttcaaccttatcaaattttggtaatgttgtcaaaaagtggctacatttagggcttgtttggttctttaccctaccaattcattggtagtaccaaagtctaggcaaattttggcactaccaaaatattggtagggccaattatttagctaacatttggattgctatcaatttaaagccaaattcttatagcatagtgaagaaacttctagactatgaccaaatattttaggggcactatcaaatatttggtctcaatccaaactaacacacaaactattcaatttgccaataaattggtagggtatgtttttggcatcaaaccaaaacggcccctagtttgctgccaaattttgataactatataaaaaatcctgccaaaattttgacaagttaccaaaattttggcattatcaaaatttggtaaggttttttttttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtgcgtgaaggaataccgagagccccccgcgagagggagagttcaggctctcgaaccccctccttttaggcctgggcctcctttttatctgtcaggggtcaccacaggggcctctagctgcctaagaagggaaacatgctttttacaatgagggctagtctacagccggaagtgacctctgacaagcagagcacgcgcctcctgccccgctcgcctgcttttccggtggacgcccatttcaaccttcatttaatggccagcgacttccttgtcatacttgcgctgaagcctggaatggatctgaccgggactgacataccaactccaggagttagcacgccggctccggctagggacaagagccagaaagctcttatcattccgacagaacggggcgaggcgtgtgacaggccgctttgttgccacctaacccgcgatctgaccgatctgtgaccggtcacacaccgcgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccgagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatct

SEQ ID NO: 24788 - DNA, 1298 bp, Oryza sativa
cgcgaagactgtcggctgccgctccgtccatcgcccaccgtcgcagccgccgatccggacgccactccccacgcacgaagagaaagagggagagatagagaagggaggaggaagaagggataagagagggtggcatgtgggacccacatgtcagtgggttccacaatttttttttggtgtgaatgacaaatgggtcccgcatatatattttttattttaatgccacataagcaccacgtcaatgccacgtggaacaaagaccaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggactgtactatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatata

SEQ ID NO: 24789 - DNA, 17422 bp, Oryza sativa
atatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgatatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtccccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctaaattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgacaaggaaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtagaacaagctaggtgtgccgcctttgcatcatgatcccacgtgcattcaatagcagcaaaaccgtaataaacggcactggagtgacccgcacgtatcttcttccagcgcaagccgtttaagcgaggagacagggggcattaggccggcctaaccatcatgaacactccatcatattattgaagagatcaattagagacactcttagcacaagcctaacttgtgtactagtttctgtttactctgtttgcagatcttgcttttcttctctaaagtctggagggaaactattgtaaactctcgagaagatgatatctcgttatttatatgtcacttaaatagttctaaaataattttaaaaaataagatagatagattaatatgtggtatgtcactccacaaacatttaaatatatgtcaactagctataatttaatttgttttctacagctcgtaaagttgaattttaggttgtacgtttgttaagggatatatcacatgttaatacatcttattattattatttttatttttttcataattatatttttataacatgtaaacaataagaaaatattttctcgagagtttaaaaaccactctcgaaatctaaagtacgtaatctcggaagttctgtaacgttttttttccctattcatgcgactactctgagctcacgagagtacgaagctgaggccattggatgcggtaggaagctatctttaatagggttaactgaatccatgtcattcaaaattaccatataagaaaaatattaatactatttgtgattagttacatgtcacggaattttttgaaattaaaaccgcatcatcgctgtcacattttatgtcattatatagaccaaaatgcttctgtatgtgggacctacatgtcagttttatcttcttcctccacccttccctcttatctctttccagttatccctcggtggtcaaagaatgtggcggtgggtgggccatgggtgtgtggcacgggtggctagagagcgaggcaatggtgaccttgttggcgagggaagtagaggtcgtcgaaatttgctctatggatggagccgtcgtgcgagctccccgagggcaagtaggaactttgagatgtcgatggtgttgcacatggaagtagccggacgagcgacacgcaattgacgctaatctcccctctcttttctcactcaggaggagatgcatgagctactcatccttactgtcaggaggtcgccagtagaggtgatgggcggcgtgagcatatccaatgataaagaagggggtggaggggatgggcgatggctgcaggtggtcggcgcctgaaagagcatagatgtaacctagagggggggtatgctttcctgaaaaatacacaaaataatcgtagcagtcaaattaaatagggcccggaacctcctggtaaagaacacatgaacttacgggtagttatatactgcccggaacttctggtgttcttggcttaggaattttcgggtacaccgaaacttagaaaaacgacttgaagattaaattattttctaatcatattcaatcacagggatgcatagaggaataaaagaagagaaaaacacaggcacaaacacagatcaagcacaggagagacaagaccgactttttcccaaagtccggatctcaccgatcctactctccgttgaggaactccgaagagctgggtctcgattaaccccttgcctcacttatgcaaagatcccagaagaagtctacagccttcaaaccaacacccctaggtcattctctagaattgagtgacaaccaagatccatcttaaactccttctagagaagaccacaagtgaggcttgctctactaggacaacctctaatctcagcacaatttccttaatcacttacctcttttacttgcagaggtgtggaataaattcacaaactttcctaggacatccacaattgcaaaggaaggtcgcgggtgacacctaaccgcctaggagaggatctccaagagtaataaggccaaagtgacagcccacgaggtacccaaagtgctcacaccttcctaaccttcaatccttctccaaatcactccaacaccctcatcaacgctctcaatctcactataatggctcaagatttgggtggaggaagcaaaaggatcttgggagaggctagaaacagctaggaggtgaaagaacaaaagtgaaatggccaaagagtgagcgggagatgaaatccatatatatataacgggtaggtgacgccatctagccgttactcacatttttgaactggaatactacctggaagttccagactggggtgccaggaacatccggccaacacttaggaaaaatctcaatttcacctagtggcccagaagttccggacaagagtgccaaaacttccgggtgggactctctgtcctgggaggggctattttcaaaaataactcccaaaaatagttcaatgagttgaagagcctaagagcacttagggaacctcagagcatcacttgaaacccctcttaatagtacagtttttttcctaaactcgaagcgaaaaataaaactagcctaaaccggctccggttcttctcaccacattgaatctgaagaactggtggggggggtctccaagcgtcctagccacctcgtaagcaacctgggactaatctcttgtacttaagctcaataaaatgcattagttcatttaaccatttagtcattaatcaccaaaacccactagggggttagatgcactttcaacgtcggcatcggagtcagagaagccagggaggttgatgcagcgcgggctacaggagaggatgcagatctaacaacgatgacgaaaaacgtgacgacgatggtatggttctatttcacaaaattccaatggcacgtaggagatatcacgaatagtaatagcatttttataatatagtaattttgcaatggcatgatccaattaaccccttttaataaggattcttttattaataagatgtttatgagtcttaaaaaaagtccgaggctgagccacacgtgtttctatagagagcatatgattgatgaggcattaaaaaggttttttttttgttatgcttcgaacggtatataacctacttaagggattcctttaagaaaggatgtagccagaagtagaaatagaattggaaattcacctttgtatccgctcttgagtttttcgttagtctttgagaggtgcataccattactactaggaggtatatatctattgattagaactacaaagtatatattcctttttacactacaaaaggtgttttgcagagggcttccacggcgaggttgtgtggtggcgtgttgggacgaagtcgaagctgcttgtcggaagtggcaaaatcagcaatgataacccttttctgctttgtctcggcaccgttatggacttgtggcggctttagtgtagttgaaaaagagggggaactggctgaaagccgcacatgtttttttactagtgccaatgacgctgtgacacccataggcgtcatcctccttcttgaaggtgtatttatttgctctcttccttctccttgccccgccgatagttcacactctaagtctagtgggagtgcactcgtcgatagctgcctgatcaccttagaagaggattcggcttcctgatccttctcattacctggaatctctggttagagaggaccgctcgcgtttttgatggggtcctctcccaagtggatacggttattgatcacgtcgtgcaggaggggaggctctgggtgaaagcgaagctgagtccttctggagttcttcttggcatatatagtcatttagttttttcttttcttttccatgcgattttgcttgttcagggtttggttctatctagcttagctagctgttgatctccttttctccccgtgtaaaccttccatacccgttacagtagattatagttgtacaaaagaattttctcgtaatattaacatgtaaggttcttgcgtgttcgaaaaaacaacgaatcagtcagcgagatatcccagcagcatttcttcgtaatcatgcatatcaaaaggtactgaagtagcctcgttgcggttaaccaccatatataaattcacgtgcttcctgattagttcagtttggggaacgatccatatctcacccaaaatagatctcagcataatccaacgttctgtgaaagaacatatagccgactggttacagtggcctgagtaacactctaagatcagtcatgagttcaaatctgtctaagctaagatcccaatttcaaaggctgcatacatagcctcatgtgtacagggtcccttcctgatatactcccgtatcagcgtatctcaaaaccgcagaaaatatgaactcctaccgtatattaatttaacaaacgaggtctttatacttgacaccagcaaacaagctagttagccagtactaatgatactactaacaaatagcctgaaacaaagccctgacttgggaaaatctgacaataatagcccgaaagaactcgtcgatgtgtatagtttcttttttcaaattgtccatgtttacactataccccgcctgaaatttacaaaggatctggcgagaaaaagggcttccgtgtccagtggatcaatagtaagaagtagtactcccgagtacagaaacccctataggtgccggttgggaactggctataggtgccggtttctaagccggaacctattggtcggcacctttatctcaatcttattggtgccggttataaaaccgacacctatactatcaaaaaaattaaaaaaacgatggcacctacactgccggccttctccaccgccgccaccaccacctcgcccggcctccacgccgtgccaaccttcgcgccggcctccacgacgtcaccgccacgaggagaggaagccgagaggggtgagtctccacctagccatgcccgcctccgcgccgccacccaacgtcgcgctggaggatgatgaggacatcctccactattacccgctggcaaagatgcaaaattcgggcggcgaccgtgtgagcctctgaataatcccaccttgcttagcttgggaggaggaagccaccttaaaagggagagccacccttcccctaccggactagtcttttagggagattgggcctttccccgagtgggtgtgcctatgaactggagattgggcctttccccgagtgggtgtgcctatgaactgttggggtccgggcaaccttaagttattgggcctcggccaacctcacctgggacggattgttatcaaggggggaggtcccctgggagagaggccgccaccttggcggggccggattgttatcaaggggggaggtcccctaggagagaggccgccacctcgccggggcccgattgttatcaaggggggaggtcccctgggaaaaaggccggcacctcgccgcggcggccgccaccccacgccatgctagaggagaagaagggaagggaggcgaggtcccccgggagagaggatgctggcgagatccaggcctactccaccaccactgccgtcgccgccacctcgccgcgccagccttcgcgctatcgccaccgcgaggagaggcagccgagaggggtgagcctcctccagctgtcagccgccacgccggccaaccttctccaccaccgcaccgtctcttcgcccgcgtcggtcggccttctccactgtcgagccaccctggaggaggagagaacgggggagggcccccaggccgagagaggaccgccgcgccattcttctccgtcggccgccgccactactctgtcaccgtcgctgcgcaatgggagaggaggggcgagcgagcgagagagagggagggaggtcagaggtggatggatggattaagatgaggctggcactgtgggtggtcaagaagagccggctcggtttttttaaatataggtgccggtttttaaatagaaccgacacctatatttatattataggtgtcggttctaaacaaaaaaccgacacctacagtgtaggtgccggtttttttaataaaaccgacacctataatgtttaaaggtgccaattttaacttttttttatcgtgcggaggtgggaaaatgctcataggtgtcggtttatttaaaacctacattatttatctataaatctataaggtcggtccctatgagggcttttgtagtagtgttactccttgaaggagtttaataatataacgattaactactagctccaaaaattgaaatattatttatagataatctaatagtccactcatacaataagagcaagtacaataagatgccataagcatattgtataagttgccacatcacatttgtatttatgtggataggtaaggaaatgagagagaaacaaagcggactatagatttatagccagcttcagcgtgagttccaataaactatgtgagagagatgggtgaatgatatattaatgatgcagtatatatctccaactaacgattatatgagtgtactattatgttggctatatatgatatttagatttttgaagccagtagttaactatattattgattttgctctaattagttgtagatatatatattgtatcactaatatctaatccatctatctctctcacatagtcagtgtttggctaataggatagggaaataatttcccaccaaccaaaagacatacttaaatcataaccattcattctccctcttccatttaattctaacccttcattcattttccaatcccaatcccactccctatttcctattatccaaacacacccatagtttattggagcttgtgctgcaattggctaaaatttgtagcccactttttctctctccttcacataagtaaaaatatgatgtgacaacttgtacctccacctacatcaggcctatcttactcgcagtaacactcctaatacaaagaacatgaaataatttaatcactttctcggttggatcacctcaataatgcgaacaatgtgattgagggttttgatggtataggatttaaaacaaattaattttacaagatcagagctgttagttaagtatgtatgcatacacgtcttatatattataaaacatgagaaaaaagtggttgtgttttatattataggataatagaagtactacatagtaataagtttcatccggcagaaattcgtgccgagaacatgcaaaacaaaactgggccagagaaatgcacacatatctgtagaagcccagcgcgcagcctgagctgagccggccggccttttcaccttttctcgtgcatgtttcctgtattttcaatcaaaatcatctagtaatgctctctagctatgctgtcgtttcttccctccgggaaatcctcctctgcatgtgcgagcgactgcgtcgacaggatccaggcaggcgcatgcgtgtatgtctccatccatcgggtgccctgtcaaccaaactagtactactactcgtattcctagtgcaatctctttcgtaaaaaaaacaatagtattaaatatgacataacttaatactattataaatttaaatatatctctgtctaaaattatattactcagatatatcatgtttaaagctagattgattttttaatgtaagggagagagtactgcactgcagtgtgcgtgttttgcccattcaagcgcacctacgttagtgtacgtgtggccgctttatctgcccactgccgagctatctatcaatcgcgtcgactacagcggaagccgtcaatccaccggcgatcggtgtcgcgtatgcgcaagcgcaatgcatggatgagtgacttcaactattgctctccggccagttctctcgtgtatatatacgtggaatcaccaactcccaaatcttctcccgttgtcggggcgataatctcttcttgtttctttattttgcgattgcgattagccgcgggttggccagatgtctggtgatcgaggaaattactccctccatctcttaatatagcaacctaatattgaatgggacagctaggttactatgttatggaacgggggagtattattctccgtggctcctaaccatccatccatcgtagtagtacgttttatcgatcaacggtcatcggtcgacggatcgacttgacgagggtgtgtgatcagtgtgttcccttgttgatgtcatgttgtcattctaagttgaacatttgtcgcttactttgagatttttgagattcatgtatatatgtcataaatcacattattgtactttcttttcttttcagtacaggacgaatcttaacaaaagcattcaatggttcagcatgttgcacatgaacttggatcgtgaaaacaatctttccgtttcgattttactgtactgtccgtggataacgtcttacctggagtgtttagctcatgttatgccgttcacaatttctatttgggcttaggcccaaaactctaacagtaaccacattccccgctgtcccgtgacagttgctccaaatgtacactcgaatatgattcgacgatctttttccctgctcaaatcagcggctgagagcgctgagagcacagagagcacggtttgttatcattacttttatctctttcaataaatcagagacagatattagaacggtgaaagctaaaactatcaaaagcatacaagtcaattgcaagcccgccccgcgagacctgccatgtgcatgtgacatgcacgagggcaaagtgaaaaaaatgcggcattgcgtttggagatatgtcccttccgcacgggggaatccacgagcgctgcagcaggctgcatccgtacgctctgggggccagaggcgggggctggctggctggcttgctggcttgcttgctccaacaaagctgcaagctgctcccggtgtccggctggatcgtagggccctgccgtgccggagagcgagcacgcgcatgtgccgacgccgtgcaaagtccccccctgcgcgcgcgcaaccgatcgactcatggcacgcaggcagcagcagtaccagcgacgcgcgcgcttattattggtggtccacgctacttgctgtggctccgctcaacagccagagccagcggtagcgaagccgatcgatcgcgcgcgcgctcgctctctcgctcgctccaccgcgttgtttgtgtcgcattggttggccctctctggtctttagctaagctaccgtaacggctggccggacaggccacatgcatgcgcgctgccacacagcagagacagagcttatcttagggtgtgtttagttctaaagttttttttcaaacttctaactttccatcacatcaaatctttcatacacacaactttttagtcacatcgtcttcaatttcaatcaaattctaaactttggttagaactaaatacagccttagctctaagctccgcgccgcgacgcgatcgatcataccaccacggtccacgaccaccacgaggcaaagcaaagcagctgcggccctagctcccgtacgcgtcgcatgcgggacatgctgagataaaactcgtaagtgcacagataaactagtagtgcggggtgtatcgtacgtacggcccggccgtccggtcggcagtcaggccactttgcaggtcggcccgcccccggacgggctggatggctcagcgtgcatgtgagcgatgtaaaacgaaccgagaaagcttgcgatcgatcgaggggactccatgtcacaccacgtaaagtacatcatcccggcttcttccctgctaagctagctagtagtagctcgcggcttttgcgacccaattcgctttgccattttggtgcgccggggtggtgtggtagtgtacaggtgtgcgtgcattgccgcgctcgacgagccgtgtactccgtatgtgtgtgtcccgggcatcgtgtcgtgtccccccatccccatgtgcaactccggtctactccctctctcctctcgtcaggctcaggccagcctgccgtataaatgaaggcgtcgacgcgtcgacgtgacagtgtgcggcttactgaagtactcttcatactctctcgtctctacgtgtacgtacgagtcagagttatgcactccaattatttctcaatcatgcatgactggtgaggatgtgagtgtgttgaatgtgcgtgcatgcatgcatgacacacgtttgatggagtgatggctgtcatttctcgagtgatctcggaaccaccgcggcgtgcagccggccagtgcatgcatatcagcatatccattggacggtgacgcatttcttgtgggctgttcgtgtcccccgcaagaagatttttttaaaaaaaatacttactcctgatcaaaagagcacatgcatacgctgaaatgcatatgctagtaactctcagcatctgccagaagtggctttgacccctgaatatgaatatatgatcgtgatgatcgcgctcgtggccagccggccggccggtcagtccaaaccctgcatgcgccggcaaggttgcatggcgactctgccccattttgcgagtcttgtcggtacaggcagccacatgtacacgcatgctttcagggtcaggttatacagcagccctccctttctcttggagccgtcgtggccggagcccctccaatcgcttgctcgtgcatttttcaattgcgtgccccctgcgcatgtgttaaagacattctttccacccaatttggccttttcaatccgatcgtgcctttctggctgccatatattttagctcccaaccacatttacggtatgacgaaaaaaatgatcgatgtgacacacccaattattggacgcggtaccagcacaaaaatcttgcgtaactttatatatatggatcgagacatttggatgtgtgatggtcacatacaaaagttcagtaagaaactagtaagaatatttaatttccctgttggatccccgcaaaaaaaaaaattccctgttggaacattcatgcaatcaacttaattagcacccaaacagtcaaattttgtgacacaaaattctttatttgaacttgcgtttgtgaaaaattatttgtactccctccatttcaaatcacttgttttattctagttttgtcgtaaaataaaacatttctatctttaatattaatttataaaaagttcgtaaagtttatcaacatgtgagtatatatatgtcatggaagtattaatactaaggataaatcatgataaatcaaaaatctgaatcttataatataaaacagtatcaatttacttaggatatacataccaggatatataatcgaaaatgcatttagtcggtatcccgttccaagagattggcacgggatcctctccctccctcacgcgactacagcaataaaaaaaatgcagatgcggctggattttgctggggctattgtagcacagaggcatatggattttgcggaaaggttgtggcgtggcgttggccattcagtgctttagtgcggcgtcgcttcttcgcatatgggggtcggaacgggtgcatgcaaggctaggtcgagttaatggcggtgatgacggagccgccgagagatgggggcaactcgcctcctagccacatggtgcaaagaagggaggagtcgggtatctcttggtctagaagaacttgaacagaaagaagattggaaggaggaaggaaaaatgaaaagagaaaggaaggggaaatggtaaagggattgatagagctatcaaaattttgttttaaccattgcacaggagtgaagcggctgcaacggctgcttcaccgggtcaccatggccacacacagaggagagggatgaggaggtctaggtcttgaggagtggccgaagaaggatggaaaacaccgccaccatcacgtcaagggaggatgggaaacactaccaccgttgtgccggtaaccatctccatcccttcctctctcccctctccgcttagatttgataccagataggtacaggatttgtatcggcaagtacatgtgtgataccaatgaggtttaagttggtacctgacaaggtatcggttggtatatggcagatattggccagtaccgacgaggtatcagttggtaagtaacgggtatcggtcggtaccgatgagggccagtacctaccagaaatgataccgataggaatcaggatatgataccttctcggtatcatctccttgagacgggttctcgtatagccgtctcctatataacactagaatgacaagtaatttaaaagaagactaaccatcactattaaaaaaacatatattttgtaaacatgcaaaatagatttttccagacggccatccaccccgcctgcacataaaggcctgtgaaaatgcacgatttttgtaggcgcctcttcatttttgcaggggggacaaccacccgcctgcgaaaatatactctatgaaaaaaaccccggccaccacccctacccgcaatcgtcgcctgctgtggcccacgccctccgctggatctaagtgg

SEQ ID NO: 24790 - DNA, 2796 bp, Oryza sativa
ccaaccgaatctgagaggtcggggaggggagaggagtgccgccgaccggatatgagagggagggagggaactaggggaggggagtgcttccactgacgctcccgtctccgccacactgcatgtggtggccaccatatcttcttccacaccgccccctccaccgcttgcggtggtcgctcccctggcctcttcctatcggatccatgagcgaggagggagagaggggagtagagcaccgccaccattgttccctccatgcgtgttgcctccgctgttgcatgcagtggccgtcactccacctcctccaggcagatctaggagtggggaaggagggagaggaggggagtatcgcctccacaccaccgccctcccctcctccggtcggatctaggagggccacacagcctgctgagaggggtggagggtgaggtgagggagatgggatgagcgatgggaggggagaggacttggtgaaaattaggctaggtagctaggtgatgatttttatgaggtatgaccttttcacaggcagacatattaagacctcgcctgtgaaaatcgattttcacaagtgggactaggtttatggtatctttaggtatttttatgaacattgattttatggtcgcttggaaaaataaatcgtaatgtttggaaaaatcgtttttctattagtgcatgatgcgttagctcatctcaattttaatgcacaataattattttatttaagtacctagctaaatggcagctactaattaacattcatatatacctaccggcttggtggactacgtgagaatgctattctagttttttctggcatttgtcgtaatggaaaatgtctaatatatgatcatcggattgagcagtcgcctaattgcgaaaagcgcgtgacttctccatcaatagcatgcagcctgcctactgtcatgattgatgaatatttgttcctcttcttgctcatcattattgtgtcgtttgcgtatttagaaacaacaattgttgcagtaaaatacaaatgtattggtgctgtgtggattgggaactggcagatctagtgatgcaagcaactaattagagacggaaaggtagagggaggacgagagaaacacatacctctacggctttacatcatgtcattgcgagaaaatatataaaccatgcttggtatggtcagttggagatctatccaacggctaacgcaatccacaactaagtaaccagtaacagagctctgctacggttactctagctagctaaggttgtattctttgtcctgggttcccaaccactctccctctttttcacgcacgcacttttcaaactgataaacgatacgttttttaaaaaaaaaaattctatacgaaaattacttaaaaaactcaaattaatctattttttttaaaaaaatctaatacttaattaatcacgcgctaatagactaatctgttttccgtgcggagaagatgggttcccaaccccattagcgaacacagacttagaggatccattttcccttatgctgatcaatgactatttttatttaccaatatattgattttttttcacattgcatttttttctttttttttctttcttatcgttagtccataaagaaacgcaatattcggaagaacgtgcaaaaatctttcttgtttgtattacaaactaactatggtagcccggcatgcaacgtgttatagctagctattgggagaagcgaccttgcgaccatctaattccaacagtacgtaggagaattgcttcaaaacatttgcatgtcttcatgtgccgacaaaacaaaaccagaccaactgagccagagaaaacacaaaaaggttccactaagaatagcgattggtaaattaacccaagcacatactgattgacagaatctaacacggcaacaacgacgtttgtctttttctttctcccctttattcctggtagacaataatcgcaaagaggaaattttaactgctcggccatgaatattcatacccggccataccctacgcgaagtggcggcatgcgcccctccgctccggcccatacacggttacgtaggaccagccaaattaatcgatccgcctttgtaaccgacccaaccgtagcagccatcccacatggctcgtcgtcactcctcactgccactggagctctttttcggcaagttggcgccaccacaacttgacgcacttggcatctgtttgccctcgtctctcggatcggacccacaatcacagtcggagttccatgtcccttcgctctcaaactagacgagctctctacagcatcgacgaccgaaaaagaaacagctataccgcacagcaccggccttaattcgacgtcgaagcttagtactactagtacgttgtgtcgttaggctagccaacccggcgagtacagatgccgtcgccgatcgcacgcgggcacaatgattaccggctacgatccgtacgcgtcacgtcgtttccccgggcctcgctctgtcgcgaattcacggggcatgaagaaggtagcgcaaggaagagagctggaggatgtagtaaaaccgatcgacctgcgcgacgtacgcccggccgtgtccatgtgtggtcgctctcgccggcgaacaccaatgattgcgcctgtacccgctttcatgcgcgtgcctgcctgccccggccggcccccttgcggcgggtcgccaacatccaacgtgcgtgcgaaagcaacacgcgccgtggcttcgcaacagctcagttaattaggaatcatcaaggatgcacgcgacgcgcaacagaaattaactac

SEQ ID NO: 24791 - DNA, 2696 bp, Oryza sativa
agagacatataaatccgaacacagattgcttggctgaatctggtctggacaaagcccgagacgacaacagaggaagggattaggcgaagaccataattccaccccaattaataccaccacgccctgaacaacctgctccaggtcaccggcgacgagccggtgagattccagtacggccgcgcgcctgatctgcccgttcgtttcagcgcccagagatcaggagaggagatctcggcgcccgatcccagtgacgccaacgagaggagatcaggtgaggcggccacgtcactcgcaaaagctgccagagcaccggacgttttatagctggcccatcggtgggcccggcaaaaaattatacacccacgtgctgggctgcttcacggtttccgtttcctgttccgtttaggaagagaaaaaagaaaaacacagagagaaacagctaatagggggatggcgaccccacctgcagcgacggagaaagcggacgaaagtaaaagcggcgcgatgccacgccaccacacgtccacacccatgccatgccacacatcgccactccgacccgacgaaaaaagggcgggaacgtagaactggacgggaccccacgttttttatgggcatcccacatggcacgttgcgtcgtggactcatgcgtcgggggcccaaccgtcactcggaagaaaacaatccaggggccccggttaccgctgcccctggccgttgcagattatgtgagaatcacggctgccctgactcaggatcagcccctaattaggagctcctagcttctgtcgttgggtaagttcagttttttagataaagtacgagttgatcttgagctcattttcctttttgagatagagatatcgaggttaggtttaggtacaattggacgtttactcaaaaaggttttatccaaaaccctatttaaaagacgacatgcattttgtgatggaagggtatatctcagttaatcagctaaacaaaacagtgggcaaagcaaaaaaaaattaaaaaaggagaaattgccaagttcaatatagcactaccctcactgtcgggctgaaaactgctcggtggttggatgacgccgcatgcaggtatagtagtaacaatttgcagcgataggcggtacccaacgtagaggtcaggatatgattcaggtcaggaaacaggtaaacggatggcacgacacggcagggaccggagcatctcgcagatcgccgggtcgcttcatacaggagacgagaaggacagagaggcgcacaggggcgcgcgcccatgatacaaaatacaaatcgcgcatactaccactgtacaccatcagtacatacatacatacggtttgtcacgtagcccgggcaggcacggcacagcctagcattgcagcggcacaccgcacacacaaccccccacacctgaatgcggatggcgacggggccagccagccaatcatgcccgccacatcaccaccgtccatccatccccctgcccaaccccgtacggaccacgtggacgcctccccccgtcggcccggaggaggagccctggcttacaggtgggccctgcccttcattatgagacagctaggcattagcctatggcgtccgaccgaccgaaccaccaccggtggcctcgcccgcccgcacgcctgccgcgctcgcgcgacggagcaccagcgctgctcccggccagtgtcgcgtagcgcgggggcagccccgtactttcccctacccacgctgccccgatgataaattacaacgacggtgaagaaaaagaaaaggcacggccgtgccctcatccgcaccgtgcagatgagagacgagggatgttttttttaaaaaaaaaaaatttaccgcgtgcgaaggacggccgcgtccggctggccggagccggacccacggttcgtggctgcaccgtggggcccgcgggtttttaacccggcgcgccgttcagatcagatcggccacgtgccactgaatccatcgccacatttcccgttccatgttactcctgcctcagctcgagatgaagcaaactgcaaacacgagaggcctacttccttgcgttggcatttcgtaaagttagcagtagtagtatactccactaatttagtaccgttaattgtagtttgagagagactactacaggcttgggatccacatttgggatactccgttcccttttaccgagatgtagcagagaattcattgctttatcgtcctttctccatgcgaccatgcctctgtccttcacgagagcagtaagtatgattaggagatgatggcatataacttgaaccacactgaagccagtattagatacagtaacaagatggttaattaggcctttcgtcgacaggaggaggaaagacattcatccccacgcactgggcgcacgagagaaaacacagtggtagagaagtgatgtgaaccattcatggtgcatttatcagagatggaagaagaacaaacgaggcatcctacaaaagaatcctgaggagaaagaagagaacaaaacaaatgtggcctactgcattacagcgcgggttaatcaccgcaatgccatcaccaccaccgccataaccgctcacccagctcatggaaaagaagaggacaaactatagagcagacagctcgaggccacccaatcccaaggaaaaaatgaaagaaagaaaaaacaaatttacaacgaatgca

SEQ ID NO: 24792 - DNA, 6372 bp, Oryza sativa
cgacgagtagatctcgtgcgcccgccgcgtccgccacttggaaggctgcgcctcggacccctccgactcccccgtcgcgccacgcttcctcttccgctcactattccccctctcctccaccgccgccgccgagcccgaggtggacgccattgcctcgcgcagcaaagaattcttgccacaaacccaacttacagcacagagaccaccaaaaaacagcaggatcaggatatctgtgacctctcaagattccctcctcctcatggagcatacacctggttgctgtgcaaaggaggagaggggtggtgagatggatggaaggaatgggggaggaggggagttgggaggttggggaatataaagggggtggtggcatgtgcaaatgccaacactgatggtgctcccattagtcctgtgatccttttggattttccgagtttttttctcttctctgtgctgctgctgtgtgtgttagttaaataagtgtaattttgctcgtcccatttcttgtaattttttttatatccctatggtctatccattttgcatgtgtgacactgggagtaaccagctaattatgaggtccaccaggtttggactttttcagatcggtgtccaccggttggttcagggtggcaagagggtgcgagtgtgtaaagagagcggacaatatctgtttgttcaatcgaccgaaagcttgaacaaccgaaatcttagtatgaagcaaacaaggaagatgtacatgtatttttaggcgtgatctgttctaattacgaatccaacggaatgaatgtggaatatcaaatgctttctctattggccttgcatatatgcaaattttataattaggtactaagaacaaaaataatttaatctcatcaacaatttcaaaaatcaatataattagtacttttaaaaaagaaagttaccgaaaaaagcgttaagagtggattttaaaaagatcataattaggtactcggctttggagtcaactttttcccccaattcaataatttataaatttaaaatgaataaataaatgggatttaactcttaattaaaaagcataattataaagttgtgactgtgctcattttcgatttagttaattaacctgttatgattcaggtgtgtcctcatttgctccaatattatgcactatcgagcgaggtttgaatacaattggtcccatcttttcgcttatgtttatgcttatcaaccaaaatttaaattttcaacattaaatttgaagctgattttgaggtttttcatcgaagtttatttttcaacctttgcttttaggtcactaagaacacgtaaataaaagttttattcacaattatttatcgtttgcaaatatgacgtttagcttattcctggggcggaacatgtttatcatgaagatctgaaaattaccatattaatcgaattagaaaaagaaagaagatgcacacttaggccaacttgagctattcggtagcttgagctgcggttggggtgtagcccaacgccaacggtgtcgcaagcatcatataaacgttgggttgtgcagccgtaaccttctgaacacccccttatatcgtgatggtccatattatgacatctagtgattttttatgcaaattttttgcaaagctatataaaagtaaaattgaatttgatatacaactcttagcttctattttaataaatacaagtatattttttataatgtattttgaaaaaaaaacataattggatatcatatacaattgttagcttttgttttcatatatacagtgtggtttgtatacaatgaaaaacactcagggatcttccggctagcttcaaaagatggtgggctagtcgacttgggttcaaagccctactctttttaattatttgatattatgtcattccctaatattcatatttttagtttgtatacaatagttttgaaagtagagttcgattagatatgcaattatgatttttttatatatatatacaagtattttgtgtacaacttatgatttacgtacgaaacaatctacacatcatctgaacccatcatgatctaacggcacaaatatttaattaatgtgaaattttgtatgtctctagaacgaatatggtagctccttttagatctatattgacaatatatatagatagatagataggtatatatttatttatttgtatacgaagtataattttacatagaaaaaaagggaaagataagtactgtatatcaaatcaagttgcactttcaaatatattacatatataacacaattctatagggataaaagttgagtaaatttctaaaactataaatactttcgtcaaagtatcacaaaactacagatttaagagcgtatatcacgaattcataggttcggtgtaaaatttatgtaaaactacatatttaaatcatcatatcacaaaactacagaacttgtgatgaaattatcaaagaactacatgttttaaagtttttatccatagcactgttgaggttacaaaagttgtaggtttatgataaaattaatattaaacttataattttctagtacaatcaaaatctatagtttttttgaaaaagggtaaaatgatgctaaatatgtattttgttatatacattctcaaacatatatgtagttttatagttttatgatagattgatcaaattatctgcagttcttatgaacttactcataacagttatatataatatctgattcaatattcaaattatagctccgtgcaaaactgcacaagaagataagttaattagtcacctctaatattgtatgccataggtgcttttgtatgaagaagttgcatgtttttttttatcagttgtataatcaatgtcggggccattgaaaattttaatgttgttgaagggattgaaaactgaatttttacgtaacaaatatgtaatgtacttagatatgctcgcgggcactttgaaattcgatccgggctcagccacttataatataaaaaatatcatgtgtaaattgcgaatagaaagagtcactaaattttgttctgagtacggtctggtttagttcccaactttttttataactttcaatttttctatcacatcaaaattttcatacacacaaacttccaacttttccgtcacatcgttacgatttcaatcaaacttctaatttttgcgtgaactaaggcctggtttagtttccaactttttcttcaaacttccaacttttccattacatcaaaactttcctagacacataaacttccaacttttccatcacatcgtttcaatttcaatcaaacttccaattttagcgtgaactaaacacaccctacatccatcacatgaataaaatcacttatattttagactgaagtagtactattaaattatgagatgaaccgcagaagtaacaatctttcactgtgagatgtggccggcggatccacaacttcagttgtagcgccagtacagcctaggcatcgcatttccggggtgtaggtgaggtatactaaaaacgggggagctccaaacaaggagtactttgctcatgcagcgagcgagtgatccgatgctagtggccatcattagggcagtactacatgcaggccataaccacggtggtactaccaatctagcatactcctatgcattgagctatagcacaggcaagcaagcatgcacgttcctcaggggcatccagtgatgagccactaacactaacatggagccagggagagggtcacatgcaaggacgttgctcggcacaagcaacctgcgctcaactgggctaaatcattcgtgccctttgctcctcaaataatgccggtattcctcccctcgaagacgtacgtgcttatcctgtcgatcgatcacatgtcgttttctttgagtgaaacaaacatgttttttacgtacgttagtacgtaccccggttcggtccaaataaaactatggatttaccccggttcggtctaaataaaattcctacgagattctgtggatttagattattaccgctcaacacgtccttatctctgtctgtccaaattaaacacgtgcagtgccatgcagtaaaaacttgttaaacaggttggaattaacgggagtatatggtcattaatttgattgtccgtgtaaaaatgatgcgtgcatgcatggctgtgtccttgcagatgctcgcccccgttttatgaggcggctgcccaaccttttaatggccgccaaaagtcaaatgctcgtctcggtaagcgtaaactaagctgaaagcaagccgcgttgtaggtagccgtcgcgattcgactgttttttaagccgtcagctagcgtgctctgccaggccgggccttgttttaaatttgaaagcctatctacttaggctgcatgcttgcttgtttgcttccgtgttagcacgtactaagccgctgctaacctctaattagagtcttagactgtgtatttactagtggcactgctagtacaaaagtactaccagtgctgtgcacttgcgttgcaaacagggggacagcttgatccacagcttagctgaggcagaggcgatggtaaatgcatggtgctccttcaatttgttttgctccatcgtcacacactcgcagtgaatcagggataggctgttgtaatcaattatggtatctccttgcagtgtcgtctgatgttgtaaccaaccgacggcacagatcaaagcaccaatagaaaaccctgcgccttttccctatggcctgcggctctgcatgtgctcccaccgggtgtatcggttgactgcagcagatatatatcaatccacgggcctgtgccgatcgaacgcagagacgagacgagacgagacgcagggtacgtgcctaatcaggcacggggctgacgcacgcatcactcgctcaccgccagttcaacagttgacaaattgcgtgcgtatcgtgcgtccaagccaacgcagatgtgtgcatgcaatgagggatcaaacgtacactcgattggttggtaggatcagagagacgcaggcaggcaggcaggtgaagagagatcgatggccagattccctcctggacgatgcccccacatacgccatgataacgcccgcacagtaactagatagtagtagtagtacccagtaataattcagcatgcatgctgcaggaacacatgagccaagtaaaggcaaggcaaacgcactgtcatttcgtccccagccgagcttaatgtaagacagtgaagagaaagagatggggtcagatgcttgcagctatatgtgctttggttggttcgctgtacgtacgagcgagagcgatcaatcgcacacgacgaggacggaccggcgcttgtgttcagtgctcgtctcgtgtagtcgtgtgtgggggcgcgcgcgcgcgcgcgcagcgcgggtttacagctgcatcgatcgaccgagtgcatgcgcctgcagcgatcgagcgcaaacgcggaaacgcgcatgtgagcacgcgcgaggacggagggtgcatggcagcgagcgagcggacgctagctgcgccgcgccactgcacggcgcgcgggccgggtcaggtcgtgcagccgcggccgtacgtgcagcgggacagggggggggggggggggtgggacgagccgtgctgaatgaaaggctggcgcgtgtcgcgctccaattttgcgaacgcgcgagtacgtgctccctgctgtaaatggttccaaagcaatcgacccggacctgatcaagtctacaatgcgttaccattgcccactttttggagatgtgaaagtcgtgcttttgtgcatgtcactgtctagctaggattcatgagaattgagaactgatgcactgtttattactacttcgtatgtataagagaaagctcaagcttggtggaatatttgtgttttctgtagtgaaaaaaaacagatggatatattttacacgaacacatctagagaccgtgaaaatcagaagaaacaagaacttgaggacgcggacgcccgagtcgcctccgctcaggcgactcgggcggcgacccaagccaccgccaccgccgttcttcccccctctcctctacctcgccgccgcctgagcaaacggccagcaaagccagcagcttgctaggatggcagcggcggggctcgtggcggcggccaccctagatccggcgtgggcggatctgagggtggaggccggtcggagtggcgccgtcgtcgaggccggaggcgtgcagggcgtgcaggcgacggcagcaggtggacgtggtggtgacacgcggcgcaggggcacggggttggcggcggcaggcggaggcgaagactggtggcagggtgtgggccgcggtggtgaaggcggcggcggccgagtctgcgacctcgggcatcaccggatcc

SEQ ID NO: 24793 - DNA, 22818 bp, Oryza sativa
ggtgtggagcgttggcttggggtgggaaaagacgtgccaaatgcccgggcgggtggctgtgggaacagcacgcgctgccgcggcccggcgggcagcccatgttccgtcagattctgccccgatctgggtgtagtttagcctggttctttcgtggtctctggcttctccagccgttcagtgcggtggcggtgggtggtgcgcctgtaacgacctgtttaccagtgcagatttttgggggtctgcatcatgcacgtatactggtatcgtcgttgttgtgcaggatatattgggatttgggaacaacttactattgctctcatcggatggcctaaacagtcagagagtaagctaaattttaaatttttaaacttaattttaaaattgattttgagatatttttaatatagttttttttcagcattgacttttaagtcatcaagaacatatatatgaaagttttacctataaatttatttttattccctaataaaccgttttggcttattagggaaaaaaccaaacgattggggcttatactttttttagccatgtgaatgaggcaatctagcgagccgtctgcacggttaaacaagcaaagggtgttttcccatgacaaatctcgttataagaaaaacgctaatctcgtttgagttagctacgatttttgtaggcgaatatattgattgtattgaggttcggggaaacagaaagaaagattcccagtcagagtcagtttaagtaatcctatatctgcatggtatatacggtcatctttggagtttcttgacctgactcgaattgggactctcgcaactcctttttcttcaaggaaacaaacaatgcgacactcccattaacctaacccaatgcaaatgaaccatacaacacctggctgcagcctacttgcaatgcttcaacctaatctacccctgccctataaacaagccagtcaggcgcccaagcgaaatatacgcatgctgctggccctccatgaggccaatctggccaacaaatactggagtttcatcagtgcccatttacagggcagcctctggtccgcgtctgcacacgagataaaggggaggcggagtggagcacgagctcagtatctacagggcgcggcaacaccgcctgcctgcctccctccaaggcttccgaccccaggagccaggcagagggggaccgggccaccgccggcagatgccatgaaaccatgtggatcaacaggtcgttcgaacagagctcactgtgcttgacaaacgtttgcaggacggctcactcgatcaccagccgtccgtccgcttctggggctctcaatggacggccccgatttcggttgagcatggggaggcgcgcactcaagatcccgtctcaactagctggtcaggctagaaaaaagacatcctctcttcgaaagagcggcaacacgaaaaaatgcaaaggttttgtccgggtgatacagcccgtgactaatgggtgatcaggttctcacgttatctaatgataccaccaatcccaacagcaaacagcactgtactgtactgctgatggagcagcgcgcatgatggccagaagcagtattcgctggctttgcaaatggcagccatggtgctgttcaaacacatggcagcgctaggacctaaaccatggatactgaaggggacgtaacattaacaatctgtcaactggtcatctctcatctctgtgtgtcccactaagattaataggccttgatctcagtcttctcggctggattccaatcagacctaaatctgtcatcttaatcatttggcagatgcatttgcagattatgaaaaggtagtatgagccaatactggtagtagaagacgcaaaggcaaacaagatgtgtcgtctagtgcctcgtatcatctgaatccagaatcgcagaagctccggcgataacttttggccagcgcagaatcgcccctcaatgtgcatcatatgaagacttaaatgggataccatgctctccaactggcccatgagttatcacattccaacgatgcaatctgatccccattctccattgacatctttacaggcgaacaacggtttgcgtcaaaaaaacaggggaacaacggtaagataaactgatagagatattataccaataaaaatcatagccgaaggggcccaacacactggtttagatgttgtaaagagaagggtcatggcacccaaattactgaagatttaaatattctctcattacattcactaatgagaggtacccaaaagttggattcctaggactaggtggaaaatttgagtttcctggtgacacgtccactcttgttaatcatagaaccgatcaaatgattgatcttatttagcaaattagtccagtcccatgtgccagatttaatcagtacgatgattggggaaatcaacacgcgtgattttctgcaaaagaaaaggttaagcacaaatatactcttttggaacacatgcaggccactacatcgcaatactgcaatcagtttgttcagttcaaccataatggtcgtccatgatttagatacataaacggaatgctataggatgacagtgaaacaaaactccatacgggcattccaatcaatcactgaacttgcaacatacgaaactatctgttgtgttgtcacaccacgggacgatatcattttttctaggcaaacagggcgatgtcaatatatataaaaatgaattggtctaggattctatagggtggaggtagcatgtcaagcatacagcattatattacaacatatacatcatccaaaggcagttggaactttagacaccctccaaaaaagagcttacctttctggcactaaagccaaattcacaatcagcacaggaattaacagtaaaacaatcaccctagatctaactataccttgccgttctttccagcggctattaattgtgcgctacttgaagtatctcttggtaccacagaataggaaagagtaatctgcgctggactggggactgcctcttcccggaatttgacatcgaaggcaacagattggtaaagacaaacttcgtcttctttgcagtagtaaacctacatacaacagcacactatactcaatggaaatagtacaaaactgaaaacgataattcacttagctaggttaccaacttaaaccaaaacaagtcaagatgcataatggtttgttgtgtgtcctaatccagggagctacccaaaaggggcaattgcgttggatgatcttgcattagctattggcaaatccagttttcgttaatatgcatgcaggttggcaggaagtgcagacaagcaacagataagcaatctggtgaactagtctcaatccagtttaactgaaccgtttttgttcacccattaccctctactgggtattattccaatctgaatcctactaccaacaagttaaacaaaagtgttgcttgactaaaatgcattactaccttgcaattgatccttcccgttgatgacgatgaagatttccttctgtacttgagtgatgcctgtcctgagtttagaaaaccattaactggctctatctcaattgcatcagctggttctatgtccacatcaaatttacttcgagcttcctgcaaatgagaacgtatatcatcacaagtaaatcatgctgacagccataaaaaacgttttgcactaagctgacattgaacccagaagactccatgacactatgaaagtaagcaccatccacttcggtggtgtgaccagatcattcaggcctttaacaagttaactgttctctttttttctcagaaaaagagtgtccaaaaggaaggaagaattgatatgcatgaagtatgattgcatggatgttatgccatatatttcatagtaggtaaaagcaaccagaaagaccttatagcataaaaacaaaacaaaaatagtatagtcctgtgaagagtgctgacaaaccatcgaatgaaatgatatttctatttaaaaagtgtaccatacaataacattcacaatataacgggaaaatgctcgtcagtaactatataaggctaccatatatgatgcaaaaacattatagctaaaattctgtgatgattttggaccttggagaaatggtaaccatcagggacagagattgctagagacaaatatccttcaattgaagaaccaccatcaatgttaataacatccgtgtctgctgatagacgtcttcttaggcgtttcaatgtctttggttttggtgatggtggctgaactccaatcaaatctagcgtgcgcacctcagcgcctttctcattcaaaactatatacctgattgtgctattgtttgtatctgctacaagaagccttcctacgatatatcagaaaagcaatagtttgcaccatattattcatcttgcagcacaacaactactgtttgcctattctgtcactgaccaggaaaaatgtaagcagcttacacataacatagggttgttcataaaacaagtgcaaatggtgaaatacataaaataggcaaggttagacgattacaggcaaggtgatccagtgaattgctaggtccatcacctaatcggtgtattcaggaaattaactctagaacaccattagatagcgtgattgttctaattactatctcatgtgtcagttaaactagacaagcaacacagcacatggaaaaagattaccatctcccacttcaacaagtcctgctggctcagacagctgcataaaaaataagtcaaaacaattacggtatgtcttagagctgttcctaggaaaaaaacatatatttcttttcacaaataatacaaaatagaacacactctaatactctattgacctatggactgcgttagcactagtatataatattgattatatataatcacgttttaaaatgatgaggatgatatagctattgtaagttaatttacttatataccaacaaaagaaattgccaaagttgtagctttacttgagctgacaaggctggaccatccttgtatcctgcacgtcccgtaccagcaatcgtcgtaactttccgtgtgacaggatctaacctttttatctgcaattgcataacaatgcattagaaatattagaacaacttgcagtaaaagcaagcagtaaaagcaagtttagtcaagagaaatagtttaggacatggcatggatcacttatgctgttatgcacaattcagaccaacgaactatttgataatggaaattgcatgattcagaccaaccttgtgcgctgctggtaatggaaagttgattcactgcctgattaccccatccattaatttgataaaattttcactggttaccttttttgtgagtgtgaggtacatacacaccagcacaaggcataattttgtgataacttgtttattaaccggaaaaaaaaatctaattcttggtaaagaagacaccttcatgaaattttacatactggatgggttacacatattagagatggtggttaccttgtgattgtaagagtccgcaacatatatttgattatcactagcatagacaacacccaatggatgctggagtagcacatccgagccagtcccatcatgatctccaaactgcaaacaaataaacaaatttaactttatacttcgataaaatttagagcagaacaaaaaaaatcttaaaatgttcagtcacattaatgctgaaaaaaagagaggcagaatcctttagtatcaggatatataaataccctaaacaaattctctggaatcattgggtctcccccagctagcgatcttgaacccccagatttcaaattaacaactcgaatggagctgctttcactatcagcaacaatcaactcctgcaattctgtgccgatagttcatgtgaatctgtgctctctggcatcagagcacaaaggagagaaaaaaggaatcaaccagaaataccaggagctaatgaaatcccagatggctgtgcaaacgatgttctggtcgaactgcgacatgaaattatttctcagaaaaaggatccaacaacatgcacgcacaaggtactgcaggaaccaagtgggcccaaggtagcacaacaaagggtaaagcgaacagttccagcattcacaatagaaatgagattctaatgcaatcccatgagagtagaatgaaacataaacaacatgttcattaatacacaatggataactgcaaaaatattttagtagcaatcatgtatctgacccaatacggccatgtcatttgtaagcaattaaaaagttactttctgatggaccaaacggatgaatgtagaagttgataaacataattacctcgatccattcaaatttctctcgtagccatcaccactgagaacttctgttacaccgtccaatgtgttgtgtttccagatctgatgttgtccagccattgcgatgtatagggtctcctttgagggatcatagcagacatcccatggtgaatttagaacctagataaacactttcaagtcagactgttttctatcaacactagtttgtacattagtatttgcattgataatcgtaattaactcagaattttttgtacagattggacttgtcagatcaattatataatatataaacatcagtcatcaaatttacatcaatacaatttatgcaaggggctgtatcatgtgtaaatggcacaagtgtcacaaatccctttttactaagcctagatgttcttaagggccattttggtttgaagtcctatcaaaactttgtttggtttagtgccaatttcagctaataagaaacaagtaggtaatgccaagatttcactaaaagctaatttggtttgcaacctaccaaaattttggtagggtagcaaaccaaaatgggcaaaaaaaaaatccaaattcaagatggatttgtgtgttggcatgttggtttcctttactcaactggcctatgtaggtagactgcaggactatgagctcattcacagtcaaaatgggataatgatactgcaagattatgtttcaatcaaactatctattcttctaactaatttcttaatttcatcttatgtgagaattaagagttagaactgagtagcatgattttataacgatcgtggaactcgaccaacattctgattttcccaaacaaaacagcacttgcatgtgaacaaaacagaggattatagcacagcaatatggcctatagacataaatgagccttgatttcatgactacattagtagagtatgtatacataaaagaaccatgaagaagcatgcctgattagttccctgacctcctcctctgtaatcagagcctttcgttccatttcccgccagtgttttgacagtctcgctcacaaaattaatctctctggataacaagaaataaatatccaattcaggaaataggaatagtttgttgcatatgacaatgatatgaggacatagttaaccatgctaatcaactacgaaatcaattttatatattacaacaaagaatgactagcagaactagttcatcgttcatagcaaaaggcattatttgtttaaagaattacacatttattccttttcaatgaaaagatgcattcaagataagtgaggcaagaataaaaggtgcatataccagtggcacttttcaccatcaaaacacaatatgagatgaaaggaagaacccttacagaatcaagaaaacaaagaattttctgttgttcagataatacaatcaatttgtgcttgaatagtttatttatttattttttgttttttaagaggatagctatctcgcaaatatcggttagctacaaaaagtttcacaactcttctctccataggccatccacattttctcatttttccctatttacccacattcgggttacaggatggtgtattcagcatagaatatacattagaagaaggatgaacgattatcagaccaacatgcatcatatcagaggaagccacctgctactagatttctaaatgattatggttacaaatttcagttttaccttcagttttccaatattgatattttgagacgtggagactgtgtaataagcaatagtaaacatatgacaatctgaaatcagtatcacatggaggcttagaactatgaaccaggtcagggttctgtaaaaaaaaggcaagccagttttgagccagcaggtaggttcctggaggtattcagagccataaaactactgaatgcgagaattacactgcatgttgacacacgccatttccatcaaataccgacattattttattttacataaggcataagaagatcaataacaaatgttgtgtatgccaccataaactgaatgaattagccttgtaaaaaaaatgaaataagcgaagtgaagtcagtgatagaactaaccgcagtgcatggttctcagtatctgcaacatacaggatattctttttggagttgtaagcaagaccctgaaattaatagcaagtattatgaggtcatataacacatgaaaacacaatgaatggaagttcaattcaaggaggtagctagacagggcccaggaattggttacaagtatatgaggtcacagaataaaaatatcacaaaaaggacagttcgattctaaaaggtatgagttcttttcaaataaattcacttaaataaacagagcatttgatatcttagcctctgcccgaggagatatcagtttggttcatgctgtacacaggaactatccaaatatcataccctagctctctactgtagccatggtccatactaccaacaaagttcaaaaggaactcctaacatggtgctacaaaagcataaatttattgtaagaacaaacaataattatttccttacttgagggcgattaaatgaagcagtatcaaatgtgccatcaagtagtccttcttcagaacttccaatttgacatataaattccccttccaggttggtaactaccttaattacagaaatgaggatagaacaaacagctaaatcagataagaaatagatcatacatgtgaagtaaattagcctagtcaatgcaatgctatatcgttgtgcaaaacaaagaatactcacaattcgattatgattactgtctgatataaacaaccgattgttcagtacatctattgcaagtttcccaggaaatttaagcggtgaagctagtaaacgactatccttgtccttctccaatgccaagggaagagaactgttttgtaataatttattttcttcataaaattcaagagctgcaccaaccacatcatcaaggtcctggaaataatgaataagtgtgattgactaggcattgacaccataactaccatgaaaaatgtatgaacaactatgccagtggaaaaaaaaaacaggggatggcttgtttgcagaaatcgttgtacaggttagacaggataaatttgtcctcatatcacaggatagaggtcaggcaggcaggcatatgcagcaacttctgttatcttgtaataacgagatttagattttagaatagttaggtagtccagaacagatgctaaaagaacttgacaagcaagatcaagattaccatggactattaggttctacttagccaacacaattcgtaatcgtttgcagcttaaagcaatcaaaataatcaaataaaaattttgtgttaaatatcatgtatgatggccaagacacctggcaacaggaggctgattccaacaaaggtaacatcattgatctggaaaaggttcagtggtgcactaggagagttgctaggagtctgaccatgttcagagttgacagaatatagtacagtatgaaccagattgaacttttatcagggggctcatctcagcctcctaagatgcatatacctcatttttaatcaagcaaagcaagaaaaaaaatccccttctggatggcctttgtagttattgtgatgtgaacctaggttctcatcatgaaccaaattcatgttttgtgctcatctgttggtattaacctgatgcaaaataaaagcaaccaactactaaacatgtaccatatttatgaactatatgggtaacaccctacaaatatatgctttgcaatgtaacaagagtcgcaggaaacgcttctcttgataataccatcactaggtttcagcctgagcacagccatgacatggaggcaatgtagtttaaacatcaataatgaataaaccatttagttcgtgtggtttaatgaatggcagtacaatcaatttatgtcaaacagtccagtgtcgccactaaaattagcacagacgtcacctagtatatcatgttcatttgagggttggggcaggtacaacataatcatatttgtggtatatcagcatgggtcagttgccaatagcagttaggacaacacagagcataagaaattagcaaatgttgatttgcttggttactcttaaataaaactagctacaaaccccaggtaactgtttggtatatggctcatgatggcatactcgatttgccagccatataactctaataagtactacaaccttatatggagttgtattcaaaacgcttccctcagatattcttctatctgattattttgctgttatagtttagacctaccaaaatattgttggatttttcctcctctcctgatcaatttatgaattataacctttcagtaaatattgtcgctccccttagcattattttaattatgtaatagatatggttttggaacttaactcctaaattcttaatcaatgcctaaactcttaagcaaggatttaaatctccggctatagctgccgctatagccggagatagctgctaggagaagcaaccactaagatatatctaatttacagctacacgttctaaggcgctattagctgcctttagctggagatagccgctaaatgggctctcaaatagcggcagctaactcgttggtgggctgaaatcctgaaattggcgaacggcccatatcacctaacgaaaccctaactctctccattttccactcagtcactcttcgtcctctcctgtcgacggcggcttgcaggcttgcagcggctgctcaaggaggcagcagcagccgcgacggcggttgatcccgaagccggtggctatgacctgcagtggcggcggctgctcccgaaggtggtggctgcgacctgctgcggcaacggtggcggcagcggcggcgactcccgaagacaacagatccaccaatcccggccccaagcgatgactgtgacaggcggcaggcggcggtgcttgttctgtcagtattctttttcttgtgctcgagccaaccttgtgttgtttcttggttcagagatggattggtggcttggctgctcatgaattgtttcttcttggtttgttggtggcttggctgctcatgaattgtttcttcttggtttgttggtggcttggctgctcatgaattgtttcttcttggtttgttggtggcttggctgctcatgaattgtttcttcttggtttgttggtggcttggctgctcatgaattatttcttcttggtttggttggttgcagtggcctcagggtgaggagtatggaggttcttgaattgttttttttgggttcaagttcaggaattcatgggggaggaattcatgggcatgttcctcctgtaatttagcaagatggttgaggaagtggtgaggatttgatcctactgattatcaagcaattcctctctccctagtcttctctgctttccccaagttaaatagctttctcttccatataactgattatcaagttatttatgtctaatttttgcaaaaaccgctaaatagcttagctgcagctatagccagctatagctgatcatagatgatggagaacctagcagctaaatgtcttagccggagatttaaatccttgctcttaaggtgcatctagtagaatctgttgcaggattaaatgatgcaaactggcaaacacagatagtactacacaagttaggacttaatgcttgtcttttgaatagaatgttctagtgctaatacctttctgtgaccttcacctgatatttgtgctaaaaccttcccgttgggcccaatcacaacaaatgtaggccaagagttcacccccagttctctccacaagtacatgtccccatcatttacaaccttaagaaagaccatagctttaaaaagttaagaacaccacaaaaaagcaatagacatgaaagtctatgccagggaggagcacaggaatgatgtttctcatttcaacatttcacaagttatcacagctgtattaccggatgagtaatgttgtagcgcagaacagcatttctgatggcttcaagatctttttcattatcaaatttggcagagtgcacaccgacaacagtgaactgcacaggaacaagcaacattatgtaaatatcaagatatcttcaaatcataccagtttcatcaatgagagacagtgttgcagcaaaatttcacattatggctcgatcatgtattatatacttatattcaaattgcaggtgccatgagcagatccatctaattcctaaacataatatccatgatttataacttacagatgtaagaactaagaatattggatgagtgtaaacatgtgagcttataaggacggaactatactaccaactttttttttttagaacacgcaggagatctgcgtatcatttcattaagatagagaagaaaagatgaacggtgttagagaaagactccgacacccgtccaccaaggatacaacagaacaccacacacccaaaggaacaccacacaaaacacactagtgcattagcagcccaatcctagtactaccaacttcacaagttgatttttttgtgatggtgaattataataaattacaagtttttacagctcagttcagaggatctacagtacaatattttgaggaaaactcagtttcaggactaacgaatcaccatatgatcagtagagagtagttaggagaaaaggaacatgaaaaaaaaaacatcattagaaataaaattaagattagcatcgtcaaaatttacggcgcagaaatactgcagttataatatatcagaacaaatgttaagtagcaaagttataaatcatttattgattccaacctaaagctcttgaaagaaaactaaacatacagtccagcatgcgaggagacagaagctcacaggtttatccttgtacttcttctctataaattccaggtcgggcaagacatgcatgcaattgatgcagcaataggtccaaaaatccaacaggaccactcttccttttaaatcctgcaccaaaaattatgtaattgctttaagtgataatgctatatttccacggacctaaattatgaagcagaaaataaacgaaaacaaattgtcattcgccaatcatcatatctgtatacagctgaaaatcaacccaactgaaaatggtgccttgtcttgaacaggaataaagaaaagggaaacaatcggtactgtagcaaagttgcagctactgagaataacctaaaatgagtttaaattactcttccaaactgaagtggcgctgtattcaaccaatcaagctttcttgggaactcaggtacacaagtagcagaacctctgaggaaacagtttggaagtaaattagtgcttcagtaaaaataaaaatcaacctcagcatgaagcattagaccttgaaaattgatgaacatgtacttagttacctacccagtttcaaaatcagctaaatacttctttatttgttgaacccttgatgtgagttgttctcctatagaaacaaggcagagtgtgcagtatgtaagagaaaagattgtgaatcgaatcaaaagaccaaggccaatctttaattagttttggatccgatttcttccaagctagtttcactgtagtactcaccaaagttgactagcaaatctagtctaacggactaaaatgaagctgccatataatgccagatggaacaaaaaaaatatgtagcatcaaatctcacataacaccccatggtcttttttcagcacaaatcaaatcaagttactgacccggatgattagccaggattgattgattattcaaattattcattaaaaatgaacatacagaacctatatagaaattcttaccttcattactagcaaatatcgaactatttccacccgtgaaataattaagcagccctttgggagatacaaactgcatggcctgaacaaaataaaaataaaaacttcgcaatctgatctcagcacaattataggtgcccaaaaaacataggtacccaaaagaatttgcccactacaagagtggaaattatggagaatggaacgaaaactgcaagctatattaaaataaattatagaaagtgataacatgtgagatggtgccattaggtttctttaacatgtcatcacccaccatgcgatacattcctcttacgtaagttgttccgacagagagctctgagtaattgatgcagccaggctcataccatggacagtatagaagtgataattatatgtgttgaggaaaatgactaactgcaacatcgaagacaggaatggtgtgaagtgaggcattactaaattgaggctaaatagctaaggatgttaggtaacagctaacagtctaatgcccaggttgtgaaagttagtttagaaccctcatcttgtatgtggcagtgctattatttgaaatcattcctagcagaagcacatttgcagtaatttgtttggtagtacttaacaaaaagaatttaaccattgaagaaaaaactaaatgaagtcatgaatatttgcgctttcggctccttcgctttggctacatcgactacggcacaaagggctatcatcgtgttgagtactcttgccggttttttctccagtccaagtgtccgcgctgctcacgcttggactgcggggggatgttaaagtatatggtagttagagtcatattaggataggattaatttgtgtggactccttccatatctgtaatccttccttatctcctccccatgtactcctatatataccagccctgagactcaataaaatcgtcccacgttacgcagtattcctctctccctatactattcaacaaaatagaaggtgtgtagcccggatatgtaaaaatcaaagtcatacaacaaataagtattgtctcacacatgcatcaagggatcaaaagcaaagctgaaaaccgtgaaacaactttgtagtataacaatggtaccttccaattcctggttgtatagataagacaagaaacagctattccaagacttccatatcttaatatgttccgacgagaacctaccagcctgcagaatttcttttctggatgtcaatcaactgtgtcataccgaactacataataatccacatattagaccaacagcattgcattcttttgggcattatatgtgaataactcttgtagctttttttttaacaatgaaggtttagtgtaagctgcgagttcttggaatctgatttggaataagctggcagtttagtacatacaagatagaagtgaagctaagattctatgatatagttttaagcttctttccagaaaccaaccttacccttcacgggaatcatcaattgagcttgcagaatttgtgctcggagcagattcagcattagttgctccattcagaatctctgttgagggttttaaggaactaatattctcagtattttctgtccgttcatctgcaccaactttcttttaatcagcaccaagtactctagtagaaccaacagcaaatgtttctaactccattaacaatgagacaaaagaatgctaaatgctgtaatttctgcattccaatttaactacttagaaaagtgaagtccaaccccaattcaaggaaatgggataggggtcttattcaaaccaatgaaacaaagcaaatataatgagttttgcacaacaagatatgcagattttttttttctttccagtttcaaatacaagagatgcattattttattgaaataaactttgcttgaactacatactgtggtaagcattagaaccaccatacaaaatatctctaattgaaatatctccaatattcttccgtatgagtgagggactggcttgctgtaacgcatcttcctccagagtagtcatcacagcaatgcatctgcaaaatttgtaaatagcataactatttatgctaaatgctccttcgtgtacaatttttttctcaattaaatgaaacctgaagggggttccttatgttcctcaatcaaaaacattaaagataataaaaaagatacattgcaccacttatttgaattgcatggatttgaacagtcagactaaataattaaaagatggtcgttactcagggcatccctcctaataaggacatcataaatgatttggactgaagagcatatatctaatatgtgctatttttgccacagctcaaggaagtacataaaactagtggcttaggatatcaaccaaaataatgccattccattattgcctcccaagaaaatatcaaaatacgtcttctgagaacttaaatactgttatcattgttgaattggtcatatgataacatatggtactaatctttttctaagaaaatccatattaaaatatatgattgcaatcaataaaggttgtgcagtaatcaaaataagaagacataaacatgacgataggtaccacggacctcatttcggcagcttttgcagcttgaactccagcaagtgcgtcttctatcacaatgcactggtacaataccgcaaattcatcacaccccattcaaaatgtttagaaaataaacatctggaaagtattactgacatctggaaacaataaaataaggcaactagccaagtggtaacatactcaacatttcatttcactactaccatctttgggcttgtaatgacaaagtactgcagccaccacccagaattagccacaaatgctctacatataggtcatgaaggtgcatatttattattgccaacaatgatgcattgtctaatgatgcttcaaacagcgatacaggggaaagggcatctattttacatgtatgatgggtcttccataacatggaataggacttaactcctctgcagtactgcttctgcagtaggagtcgctgacattggaatagcattgctagtcataaccataaatcattcagaagctataaaaatagctagacaagccttcttccgctgtctgtttgatctaggatgtatttctccgtgtaccaagaggctatttatgaactatgtcttacatataaagtgtttgtaggattgaggttcacatcagaatgatggagatttaccaaattcacttccacacagcataaaaccagaaagtagatattttccatagccagtaaattctaagttgctgatcttatcataaaagattgtctccataataatttgctagacaattacctcatctgtgtcaacacctagggttttagatgctgccaaaaaaatgtccggagcaggcttcaaattttcaaatgcatcagcagaaacaatggcatcgaatctgaaatttgaaataggtttatcaaaactaaatagcaaacaattaagagattaaattattgcaataatacatcttcagaattatcagtgactcccaatggttttagaatatttggaaatacctaacacgacactctctctgaaacagaattatgatttaatttctatcaattaaataaagctcttcgctggtaaaagagagaatgtcgtggagattctcaaacataagatttcgaagaacatcgaaggaaattgaaatttcagtagcctggcaagtgcagagaaaagggtcaacctatgggttttgctttaacttagaactttattctggttcatgggaggtatgaagaggtatagccaactcatagcattaatagtttaatactcggtacctcttgatacaaaaaaaaaatcatgacttaaataataagacagtagcatgatagcaacaagatatccagtttatattcctactttccttgatggtttttttttctctgaccaataaatagctactctcttatgttgagtacctactggaaccaccatcagagaaagtttgattcagactgaaaaaaattgtgaagacaaacaaaaaggcaactaacatatatgatcttaggcaaaatatgacaagattctctcaaaaaaatgacataaaccatgtaatatattggaataacaatgatacttaaaatgctagtagtagcaaagaaatcttggaacgtgagcacaacgatggcattagcaagtaagtgcttggaatgcaaaggaataagcaaacacctacagcgacagaggcaaaccagcagctgccaaatttgcatccaccttaatcctatcagcactggatgcaacagcaaccttcaaacctgcatttttgcactgaaatattgacaggaatgagctgatgatcacttattaccaaagtacaacaagttttaactcaggcactgcaaatacagaaatacctctgttacgagatctagagccccagggaatccaatgccagcatttggctttgcatactacagaatggaacataatttaagaatgacgccatcaaactacaatgagaataaacaggagagatggtatgaacaaattaaccttgtcaagatatatctcaaaaaaacgtttcttggcactttcagcgttgaaatctttcactcccttcaacttcgctacacctccaaggaaattagcctcacctagaatatatattacaacatttcaaacaaactacacccaacaaaatctgaaggtagctaaattcatttgtgtagagggcgatcctgtcaaaaacggcagcagttataggttgtcatcccccaaagtaaaataggtaagacattttctgtctagagatagcctcaatacttctcccaacttctatattgaaaaaaaaagtaatattttcttagtcctcacatacttgtcatacaaagtaggcaattaacatctctcgcaagcactctgatgcaacaatatactctataggcattaagagcatgctaaggggtttacggttactatctaattagcattcagcttagcaatcactacaattgccaagggatcacagaagatcagcaatggtaggccatatgacatactgattgccgtatccactttaagaaacataaagccacagaacttcagaggatacaagcagcggcggagcttccgatatggcaagatatggcactcgccatacctcaattctattagccaccggtggagtctatgcttgcatgattaacattcactgattcctccttgtaattagctgacttggatgttagttagttacgtgaagcaactaacctagtatcttgttttcactccttgtgattagctgcttgtataagcataagttgttagctagttacatgatgtaacctagatcaaggtttaatctatatgtttggcaatatctatctttccgaaataatttgaaatttgaacaaattttgatcaaatttgaatagattttgctatattcaaaagttttctttgaaaatttccaaattttcgaaaatttcattcgggaattttgaatcctaacatagatcaatatgatttgttgcatcaaaacaacttttgcaagaacttttagcgatgcatgggaacacattgcaaaactatgccgtattacctacaaagtattatgttgattttgctgccacaccttattgttttctcttcctccgccactggatacaagcaccctgtcaaaaactattctgatggaaatgtataactatggatgtgaccacagaccactggtacaggcatcctaatgaaataggagtatagtactataatacatatagagtttggcaggtagcggagatacgaaaaccaacgacgtcaagggagatcccgggaaatattatgtctaatataggaagctactaattgctacaattaccgaatcacacgcaacttaaacagcctacgaccaagtttatgtcacacaagcatagctacgcttaccaatcacgaatcatgagtaatcgagaaaagtaaaataaaaatgcgcgaactacattgtcaattcccagtaccagtaggttgttgaacgtcgagacaatttacctgtgcccatgtaaggaacaaagtcgtccccggtgacgtcgacgcccatctcggcaaataagtcgacgcccgcgaggcgcgagagctcctcgctgttgcagagcacgccgtccatgtcgaagagcacggcggagaccttcccccaggcccccggcgctacctcggtctccggcgaggaggatgccggggcggaggcggcggcgacgtcgcgccgcccgcggcgagggaattccattgcggcggcggccggcggtattagggttttggggaggagaaggagagggcgcggcggcggtgccggggaggaaggcgggtagtgccgggaggcgaggaggcggtggaagcttcctggtggcgcgaggtgccgcgccatggcgaggtgggcgtgtggtttgtcaggttttgggctcgccgctcgcgagctcgagtagtgtcgagtgtgtgtggcggttggttggggacggtttatgcgcggcgatggctgcgacgcacgagtggatggacgaggtgtgtttctgcggctctgttggcctgtggtggatacgtctgccgtgtggtgtggccttatcttggcgtgatcgactccagtcacacaaaaaaaataggaatgggaaattgaacttttattttgctccaaaagcaccgcgtgaggaatactcacaaaattcaacacaagtattcgctgccaaaaatttaaatttttaaaattaattttaaaattaattttgaactatttttcatcgaggtttattttttacattgacacttaaatcactaagtatatatgtatataaatattttccctataaattattattattttgctaatacatcattcggcatattatcctcaattggccaacattatgtctatgaaattcctttatcgctctgaaagcatgaaattcaacatgactatatgaaatcctcgtatgtgcaatactttatgaaattttgctttgaaaagactagggtgaacattcaattagttatatatgcaacaggtaaagacgtattttatataatatactccctccatctacttttgatattaatatttcaccttggtacacagactaaggataagtaactctacttatcatccatttaaacatgctactagttattcctcgtaaacaagcgattcattaatatttgcatttctcaatgcccatgtagccaatcttgtgtagaagaatggagagtcacgcattaaatccgagaaagtcattaaaatgataggttgttggattgaaatatgcctattaaaaataaattttttagatttgaaaatatggctatcaacagtagatgtagggagtattaagagaataagagctgagtaataaattgaaatattgggatcactttacattataattgaaaaggttaatgaaaatataaacattaggatcaaagtatatatatatatatatatatatatatatatatatatatatatattaaaattgaaaaaaataatgaaaatcttttctagcttttgggccaaaagcctttcttccttctcagtacctaggccagtccactgcctccttccgtttggcttgcttcccttcgaccaagggacaaccagagacaagtggagccgtaagcccagctcgcagtgtccactaccatcttcaacctcccgaagatagtctcgtccgtgtccatatggctgcctgtcacccaaaattggttgaggatttttgatccactcgatctattaaagccgaatcgaaagggaaaatcatggagaaaatgataagtgaggagtggaatgatttttgcaattaaattggaggagaaaacacactatcgatatggtggcggtgggcggcgggaggcgtgcggggaatggatcggattaaaaagcgcacgggagaaaaaaatagcaacaaaaaattgacaaaaaaaccaaaagcgccaggcgcgctgtgaacagataggaattaaaaaaaccggacgaaaaaaaaccaaagcattagcgcgtgcgaaaaaaactctttcgcgtgaaaaaaaaggtcgggaaaaaaccggtgcaaaaaatcaaacggacttttttgtttttttacaggcgaaagtcttttttgggagtcggacaatttttttttgtacgactacaattttgagtaagtcgaacctttttttacaaaacggaatttgttgtctcggtagtagagatagaaattagaaccgaaacataaaattaaaaccgattcaaacatggatggcgtaccaaaataccgataaaaacatcttcaatttttataacagtaaagatatgtagtacaactaattcatttgttgcttattcttttacgttattttctactccctatcatcatcaatatttggcatttaggataagattcaatcaaactttttaaacgcagacacatatgcatagacatgctgccaaccgccttaatgttgtggccccttagctatgaaagtccacctcgtatgtctcataggtcaccaaaccactatcaccaagtgcgcgggtgttgcacacctatcgttgttcctgcgtcggctcgtatccagagccaactcattgccgaaccacatggcgtgtccacgcaccctacctcattgccaaggacctagatccactaatcgcagccagcgctggtcatgagtttttagggaccggtgcaaattataatatagaggcccaattttttatggtaatg

SEQ ID NO: 24794 - DNA, 722 bp, Oryza sativa
ccaaggatcggccaatcctgatcacaacctcttgccacaccacaacatagacatacgaagtgtcacaccttaactattgagttcctgaagggagctatatgaccaaggtttaggtggaggttgctcatggcctcaaagaacaatttttctaagcttgtcctcaccaccaccaccaatggatgccccagccaccaagctccattgggtcactattttacattatagcatcaattactctggatcaacaccaccatgatctttggtaaggcaaatttccgccaatgtgtcttccattgcatcggcaagctcttgatcatgtagacaatgttgcattcgttcatctgcttccatccagtctttaagacaaaagattgactcaactgtctcggctgtcaggcatgaccttcgttcttttctccctaatgattccagtaacgctgaatgcttgctcggaagaaacgaaggaggccggaaccagaagaatatctcgagcaaagtgagctaacacaggaagagttcgctctttctctttccaccacccaaggagatcgacatcgtcgccaccaagcgtcggatcatgcttagtatgattggtgacgaggtagtggttaagctctgaatccgggttccatgttgatttgttctctgaggatggagaggcttggtcgtttcctatatactgcttccacaaatttactgcacttgactttcttgctttcttt

SEQ ID NO: 24795 - DNA, 1053 bp, Oryza sativa
tcacctccccattgcagaaggttgctattgatccgatccgatttatcaaaaaatcggagagaaagatttttttttttctgaaacaagatggcatccagtaatgaacttcaggggaaaagttgatatttcacatgaactgtaccataaaaacagttttgcaaccaaaaaagactaaaatttgctcaacaattaacccaccgtacaacaaaatcgcaatcagttccttcaagcaaggttgtcccgattcgtatcctagtatcttacgatactacgatcctatcaagccgaaacgataccgatcccacctagtatccaaattttcgtagtatctcgatcctactattcattactacacgatccaacaaaattttaggtggtatcccgattctacaatccctacgatactacaaaatattatttaaaataacatggtttgaaaataatgtaactaaatatgctcaaatttatataaaaatcagttaaatatatcaaaaccaacgtggtttctcttgataaatgtctctatttgcatgatatatatcatcactatatttttctatatagaatggctatatataattaatataaatattaattaaacttaaaaaaaataaaatctcatagtatcccgatactacgatacgatcctacgatacgatattactttgagcaaaacgatactacctagtatcccgatcctgacaaccttgccttcaagtaaacaagctcacagccattgcgtacaaggatggagcagcatgctcaccggaggtcatggactcctaccaaggccggtgcagctacctggcctcatccgaggatagattctaatatctcgggtggacgtccacccgtttcttgcatgtcacctaaatgattatgaaaaaattcgaaaaaaaatttacaagataggttaatatgtaatatatcacttcacaaacatgcaaattcaaattcgacttctacaagttgtaacaaaaataacaaattaaactctaactagtatacgtatattcacagtcaaatttgttagggtaccgagctcgaattcgc

SEQ ID NO: 24796 - DNA, 870 bp, Oryza sativa
  unsure (1)..(870): unsure at all n locations
ttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgannnnnnnnnnnnnnnnnnnnnnnnnnnnnnnnnnnnnnnnnnnnnnnnnnnnnnnnnnnn

SEQ ID NO: 24797 - DNA, 620 bp, Oryza sativa
  unsure (1)..(620): unsure at all n locations
nnnnnnnnnnnnnnnnnnnnnnnnnnnnnnnnnnnnnnnnnnnnnnnnnnnnnnntctctctgtgtttttcttttttctcttcctaaacggaacaggaaacggaaaccgtgaagcagcccagcacgtgggtgtataattttttgccgggcccaccgatgggccagctataaaacgtccggtgctctggcagcttttgcgagtgacgtggccgcctcacctgatctcctctcgttggcgtcactgggatcgggcgccgagatctcctctcctgatctctgggcgctgaaacgaacgggcagatcaggcgcgcggccgtactggaatctcaccggctcgtcgccggtgacctggagcaggttgttcagggcgtggtggtattaattggggtggaattatggtcttcgcctaatcccttcctctgttgtcgtctcgggctttgtccagaccagattcagccacgcaatctgtgttcggatttatatgtctctcgcattcatcaaatgcggttgcaggtgctcgcccataagaccataataagtactatacgtacgtacgtacagtcgagacggtccatacctcagtcgcaaagccagatgcgtcggccatgcgtatgtaagct

SEQ ID NO: 24798 - DNA, 585 bp, Oryza sativa
aacaccgcacgtactcacttttggggaaaaacactctctaagtgtgtttatttgccagtggacaccatggccattaaaataatatatttgtgccgacatggcgattggggcccaaaaattttacacggagtgaccaaactacccctggcgataggggccccatctgtcaggcttatcttctacctctggtcggggcagagtcggagtcgtcgccgcttgaccgccaaatccggctgctccttttgctctcgagtaaaattagttgaggggaagtcctccctttatcctcctcaaccgtttccagcaagaccatgacgaggaggcggaggaggtggagcacggcgacatctagtgccactgccgcaggaatatgccgtgggcgccgtcggaccacccgcgccttctagagttagaggaggcaccgctggtatgcacagcttcaaatcaaccccaaatacagcagctccaagccctacccagcgcacaagccacggtagcaaagcgagcaactgcactgagggcgtcggcgaggggagcaccagtagccatggagcaagcaggttctcgatgattgacggagcgagc

SEQ ID NO: 24799 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnnnnnnnnnnnnnatacgaggatttcatatagtcatgttgaatttcatgctttcagagcgataaaggaatttcatagacataatgttggccaattgaggataatatgccgaatgatgtattagcaaaataataataatttatagggaaaatatttatatacatatatacttagtgatttaagtgtcaatgtaaaaaataaacctcgatgaaaaatagttcaaaattaattttaaaattaattttaaaaatttaaatttttggcagcgaatacttgtgttgaattttgtgagtattcctcacgcggtgcttttggagcaaaataaaagttcaatttcccattcctattttttttgtgtgactggagtcgatcacgccaagataaggccacaccacacggcagacgtatccaccacaggccaacagagccgcagaaacacacctcgtccatccactcgtgcgtcgcagccatcgccgcgcataaaccgtncccaaccaaccgccacacacactcgacactactcgagctcgcgagcggcgagcccaaaacctgacaaaccacacgcccacctcgccatggcgcggcacctcgcgccaccaggaagcttncaccgccttcttcgcttccggcactaccccgctttcttcccggcaccgncgncgngcccttttctttttcttcccaaaacc

SEQ ID NO: 24800 - DNA, 1459 bp, Oryza sativa
gattttggtgctccgtacgtacgtacgttcgcgcagcgcggggtacgtacgaacgttacgtgcaggagcaaggctaaggcattaaaacgtcagggggtggtgaaatgcaacagatcgatcgagagcggatgcatgtgtgcctgtcctccttttatttcagatggggaaaagatatctgcttttgcaagcttcaacttgcaagccctcgagtagcatgcatatgcacgagcatgtactttcggttttatggtagaccagctgcatgctggtccacttccagttcccatgcatgcattgcgcgtacggtctctagatgttttttttaaaaaaaaaacctaagccaacattgcttgttttatattaagagagggagaaactgtataaacaagagacaatgacccagtttataagagaaatcaggccagaaaaccatacagctacacggttaattatggagaaccggctgaaacccaacagacagaagaaagcatgggacctaactacacaactaacaacaacagtggagcccaaatgcaggacatcgttgccatgctaagcacaaaaggggcacaacagctccgacatcacagaagaggtgttatcgttaccgagctagccgcccaagcgacccagcagcgccgacttcaccaccgcagcgacactgaagccacgaaagccgccaaagcgaaagcagctccgacatccacaatggacatcagccaagccaccaaagagccacttccttcacatagccagcaccaactctttgaaagagactacaacacgtcatcgttgccaagcgtcgcagcaccccaacagcgagcagctccaactttatccgcataagcaaccgaagagtgtgtcgcccaccacagaacgaagtggacccaagaggcttaggcctcgccgaacaccaaggaaagaaagcttttgaaccgaagagactatcaatatcatcgatgtaaaggaacttctccgaagcgacgcccccaaggagaacacgacgtgtaacgccaccgccgctcgtccggagaacacgacgtgtaacgccaccgccgctcgtccgaagctggagcaaggtttacacccggagatttgtggggcaaatgggagagcgtcatgacaacgccttcaagaagggaaacggtgccaacggcgtcgtcgtcatcgaaccggccaaaggcacggcaaggctttagccagcgtctgcacattacccacaagcaccctcacatcgacggccacacgatagtccacgacgtctcacaagcagtcaaccctcgaggcaacctaccgtcacccacactcatctgctgcaccgaccagaaccggccaaggcggccaagggaccggtcatcgaaactcggctagccaccgtcgccacaaatgcccacagcctcactgcatcgccgccaagacgccggtgggagttggaggctgccaccgcgccgacaaaggg

SEQ ID NO: 24801 - DNA, 6130 bp, Oryza sativa
  unsure (1)..(6130): unsure at all n locations
ttagccccaccccaacccaggcccgcgccgaagcgaagcggagaccagatcaccaagagaagtgcgacacacacaccttctcgccatcgttttcaccccctcccttataaatactcctaccgcccgcctcgcctcgtctcgtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcattcgctccccgtcgccgtcgccgaccccgcgccccttctcctcctgccgacgacgtcctcctgcacctgcaacggcgccagcagcggcatgggcgccgttgcgccgcgcacgttggctttgggcgccaccaccgacggcagcgtgatgacccccaccagctggggcagcgacggcggcggcggcggcttctcctccgcgcgggccgtgcgctcgccgtcgccggtgctgtcgctggtgcacggcaccggccaaaggacctcctgctaccgcggcgtgaccaggtaatactactcctactaccactataccacgcgcgtagagatagactagagagagtgatataataagtgcatggttagggagtgtgattaacgactaatcggcacgtgatttttcacacggcgctaatcacgaggaccgcacgtgtggcgcaggcacaggtggacgggcgaatacgaggcgcacctgtgggacaacacgtgccggcgagaaggccagaagcgcaaggcccgccaaggtaatttactaattaaaattaccgctaatcaccattagtccattaccctttctgtaccgtcatttttctgtcaccgatcaagaaggcctcgccggcggggaggggtatcaacgccggcgagggaacggtgatgagttcgccgtgatgggatgggatggaatggggtgccggcgccgtttcggggggagatcgaaagacgggtcgcgtcggccatcgtgtgcatcaagttgaggtgacattagcatctccgttagactcgcaacagttcccggattctctgcggtgccgggccccggtgggtcacccctctttgaccgtgcaaccgtaggtagggggtattgtagccgctgcctagtatacctctgtgttctgtctactactagtagtatctcttttttttttaatctttcttgtggccatttctctgatgcaatagatcggctagagcctaaagcgatttagcaaggcgatttatgttggttaatcttgtaggcgtggagattaactggtcccgtggttggtagagtgacgtcgtgtatctgtatgacagctttgccatggcaggactgctgctgtggtgcatgcagcttttgcttttttcctggttttagtagtagttcatgggtgatgtactgcatgtttagatggttttatttgggtcagtttctttcttccttctattgcaagtctttcttttctccttttttgttttcttctgcattacacacggcgagagtttttgtttctgaaaaatttattacgagtcgcaactttgcaacgctaccagggttgtgtaggggacagctaaggtgtgaccaaaagtggttttggaacgcacgtttgaattttattttatttttgctttgccagttacgactccagtagagttgtttctactgtccgtccttgttgattggcatttggcaacaaacttttgtactttactcgatacgcttgcagagttgcacaggtagacatgcgtgctactggtgtatacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatattaatgcctactatatgagacacccagaaatcagaattccacggatcaatttactgttggatatatagctacatgtaatggtatattttactgtcagatggtacatatatgctgggatatcagtaaaaaaaaatctatcggttgatccgatcatccgaggatagctactctaaaatcacgtgcatagtgcaaaatgcaatttcatcaagtgaacattgcatattctgctgtttggttttgaactgcattatgtaataagtaatacgtattacacaaataactccttacacatgctgatgcattcatatgtgcagattctatcgttagatttgagccacccttgcctcttttgcatcgtgcaagcaaaactccagttctgaggagaaaaatcattgcatgcaattaaagattccatacatataattgcatttgggaaataatatatattaacaggatgaatcacgtgaatagaaatgttgggggcattctttgttgtgtggagagatacattgctttcgagttatgtaagctagcatcctcttgttgctgtccttttattttggaagatatagttatcttaatttttgaaaaagaaaaaaagaatcatgccttataagttatatgttgataaaggaggagagtttgtgtgagatatgtacaatggggttttggggatcccgtaaacctggggggaaaatgttatcttaatttgcatttgatgtaaatgacatgctattttttttttctgaaccagtgcagtggttccttttttttttttaagaaaggactaccagtggttccatgatagtgatactatgacatgctgcttctttgcattcagtgagtataattttgttaggatatctcaatgtttgaatggaagggacatttgtatacagtgaatgttttctcactgaggaagtcaggaagttgtgtgctaaactgttatccctgtattttttaatatataatcttgtttatttgttggaactaacctggtttataatgtctactctgtatgtgctttttatcctgccaactgcatgggggccttcttcagtttacttgggtatgagcaactaagtcctgtcttatgtatcatttcgtatgccttttcctgggtaagtaaaggtaaataaacatgtggtaaattgcaggtggctatgacatagaagataaggctgctagggcatatgaccttgctgctctgaaatattggggtgctaatgctaccactaacttccctgtaagtgtcacgctttcctgatttcctaaacagccccccatagttactgcaaatatcctactgaggtcatataagcagtttttttgtgcctcctaaaatgtgtgcccttatcccgcacctcatattgtagtgatcttagtgtacttctaatgtcttatttacagttaatccatagccttaaaatttgagatctttgtcaaccttcaactgttcatttggattcatttatgctggttgtggactgagacatactcatgtattcttaatagaaagatacacatcattatcgtcgcaaaagaaaaaaggaaaaaaaaacacatcactatgtgctcacctttatgtggagctgtgtgcttagattggtctctttattttaggatgcattcagaactattatcatgtattgctatagttggtcatgatgcaactgaaatggaacttgttctcttcttagaaagaaagttacgtgaaagagattgaggagatgcaaaagatgagcaagcaggagcttgtagcctcactaacgaggtttgtatttaaaaccacgttcttttgctgtgctacaaccacaggaagttcaggcttatatacgtgtttacaactttctcaattctcatgcaaatctgcaggaagagcagtggcttttctagaggtgcatcgatctacagaggtgtaacaaggtaattttcaactacatgaaccaatcaaccaatggtcatcttctttgtcagttacaatctgctcaacttcctgctattttccccaggcaccaccaacatggccgctggcaggcaagaattggtcgtgttgcaggcaacaaggacttgtatctcggcacctttggtaggagcctgttgttctgatgccccttatatcgaaaaagtagtatgacagtatgctttttttcttaagaaagtatgctcatagtcatatatggacaagtgaccatattatagtcttaagtagttaagttatatggcagaatagtcatagataccttactgtttcttgaagtgctgttaatgctttgttgttccctttcaaataagttactgtcatcttgacacaattattatcatctgtgtaccatttcatttgttactggttttacagataatctacaagctatgcactattcaatctcgctctaattcccttactgtggcgacattcagaaaccactatattttgcactctgtgatgcatactaaaccagcatacttgcacattccttgcagcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatagctttctaccatgttgtatcctttttaagttcgcgagtaattctgcgacaccggatggcctcgacctgctcatctatgggttcgtggcgcggcaacctatcccgtggctgctgcttcgagcagacctgcttttgttctatcagccggagcctagaacatcaaagctttcatttgcactggctgtaacgagcagcaaatctgagcaacaacgcttcagagcttgccgggacagtactgcagattagaagcacaggaaagacagtgatgggtacaaaagaatcgcacgattttagagcacatcaagcagtccgtagataacagtaaaacgtttgcttttcgtcaccatagattaatacagagaaaaagaaaatgatgtccacagtatcaaatatcacacatttcactgtgtggaagcactcagtttaaacacattctttgtagtgctcggtagaactttattctgcttggaacaaccaagcaaatattgctggcaaagaacacatgaaactaatctatagtctactccacgcagcaaaatggtgcaaatggtagatcttggagagttcacgtctttatggtttcacttgagcaggagactcaccctgcagagcaggatcagatttgacagcatctagtgtcttgaagatctcctcagggagtgcaacaggccgatgctgcggaacatgtttcgggataagtgtgtcatcttcaataacctcgcattcatagtcatcaggaacaccccatgggtcccattctgccatccattaaaacattgtatattaaacaactgaggctgtaagnnnnnnnnnnnnnnnnnnnnnnnnnnnnnnnnnnnnnnnnnnnnn

SEQ ID NO: 24802 - DNA, 2084 bp, Oryza sativa
tgcaatgcacatcaaaattgccaaacaaactattcctcataaccaattttgcttctaatattctacacattattcagttgatcgacaaggtctatatgctacaattctctatgtccttcatacgggtgagcttggtcattggaaacaaactgaaccatacatataatgcaacagttcagaatatcacagagcaggctaaacagacttaagaaaaaaatgtttctgcaaagcgcttaactcatgcacccaatctgtatcagttgctaatggcagcaacaggactgatctagacagctatagttgtgcaccttatgtcgtaatcttattagatactcagtgtaaagggtagtggcatggttacgtgaattcttaatcactattaagttgctaatgccatgcaaattataatatacttcctccgtttcagattgtaagtcattctagcatttttcacattcatattgatgttaatgaatctagatagatatatatgtctagattcattaacatcaatatgaatgtgggaaatgctagaatgacttacattgtgaaacggagggagtagttacattcattcatagttctatacaaaaaacaatacactgtattgagatttgagagagcatcgatcagtgagagtgctctggattggtaagatgtgcatgggacatgggtgagtgattatttggttcagcctttttttccccagtcgttcggcatggtatttgtaaagtttatttcaattaggtgtgatgaatagactttagatagaagagaaatgctctacaattacgaagattgtggagcatatttcttcttactcacgcaagtaacatcaccatattcctaattccctctctatgccatatcatgtaaaatggaaacctatgtatttcatttgaattttcacaaaacaaatattacactgactcactgggattctagcaaagaagaaattttaaagcactgaagtaatacaccagtacattactacatgcaatgcatagcaccagcccaacgcctgaactagattccagaccagccagattttacatacatggcactccaccagacatacacaaagcaacagtatggtgaatatggcaatgaacacactctggttaagttacaagcaccagtcagttcacaaaaaatcttaggttagtgaccaaaaggtaaaatggaacatccatgatccttaaataagcgctgaaaaataattaaggcattttactaataggcagcacagcagacaacctaaaaagcattccatccccccccctccccaatcaacaaactggcaaacaccatactgtcaacgctgataatttgccctaccagtgctattaaagggagccaaaagaaaatcaaataccaatcgctacgatgttattgtccacggatcagttgtatatcggatcaaataactggttgaatcaaagaaatgggtagccagtggccacatctacacatcaactaccctgattcttgtcgacagatcagtaggaggaataaggaattaatacaagaagtaactaaataagcgacaggaatggagatggggcgtaggggagggggagaaatgcggaccgatcatcttggcgatgagcttgagctcgtcctgggcctcctcgatgagctcctcgacctggccgcagccgatgcggtcctcgatgcgcttccagtcgtcctcctcctggcagatctggaggcggtggcgggtgaaggactcgacggccttgcggtagccctcgtccttggggacggcctcgatctccttgagggtgcgggtgtagaggccgacgagcaccttccgcgcgttgggcaccacctccagccccacgatccccgtcgtctacttcacggcgcgcgccgtccgcagagccggcaccccttccccgccgctcaggatccgccggaggaacataccgccaccaccgacgtcgtgtctctctctacctggtgaggtgcgggaggggtcgcgaccgtgcgaggatgctggtgtggtacgtgcgactgatgagcagcggattgggaattgggggagagaggatggactgggcttttggctgtggaatgtgtgt

SEQ ID NO: 24803 - DNA, 826 bp, Oryza sativa
  unsure (1)..(826): unsure at all n locations
caagtcaagatgcataatggtttgttgtgtgtcctaatccagggagctacccaaaaggggcaattgcgttggatgatcttgcattagctattggcaaatccagttttcgttaatatgcatgcaggttggcaggaagtgcagacaagcaacagataagcaatctggtgaactagtctcaatccagtttaactgaaccgtttttgttcacccattaccctctactgggtattattccaatctgaatcctactaccaacaagttaaacaaaagtgttgcttgactaaaatgcattactaccttgcaattgatccttcccgttgatgacgatgaagatttccttctgtacttgagtgatgcctgtcctgagtttagaaaaccattaactggctctatctcaattgcatcagctggttctatgtccacatcaaatttacttcgagcttcctgcaaatgagaacgtatatcatcacaagtaaatcatgctgacagccataaaaaacgttttgcactaagctgacattgaacccagaagactccatgacactatgaaagtaagcaccatccacttcggtggtgtgaccagatcattcaggcctttaacaagttaactgttctctttttttctcagaaaaagagtgtccaaaaggaaggaagaattgatatgcatgaagtatgattgcatggatgttatgccatatatttcatagtaggtaaaagcaaccagaaagaccttatagcataaaaacaaaacaaaaatatnnnnnnnnnnnnnnnnnnnnnnnnnnnnnnnnnnnnnnnnnnnnnnnnnnnnnnnnnnnnnnnnnnn

SEQ ID NO: 24804 - DNA, 743 bp, Oryza sativa
ccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcagaagaagctccgtagtacgatggatgcagagaatgcccagcacgccaagttgggtaatgaattcgaatgcacttctcttttttttgtatttatttgatcacaccaagagaacaagatggtactcttttgggttttgagcatt

SEQ ID NO: 24805 - DNA, 5506 bp, Oryza sativa
aaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctctagatgtcagacctgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgttttcttcctttctcttatttctacctatcccctccagatggtgaagacaaggaatgatccccgtgactccagcgacgccaggggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgcccctgaggacgtgcgcaccgatgctgagaagcaggagaagtttttgtttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgattacaacggtggcagtcacaacaacagtaagcagcgcaaccacaactcgactccacccccactaatggcaccagctcagtcagatccgccaactgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggggaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatataccgaagtcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagaaatagccgaattcgtcgcactctgcgatgtttgtcagcgagtcaaagcagagcatcagaggcccgcaggactgctacaaccccttcagatcccggaatggaaatgggaagaaatcggaatggatttcataacaggtttgcccagaacgtcgtcggggcacgattcaatctgggtggtcgtggatcgactcaccaaagttgctcattttattccagtacacactacctatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtgtctcaactgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcacctcttcgccagctcttccgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattgtaaccaattaaaaatcaccaaagtgcaattttaataccaggaaaaaaaaaacctttt

SEQ ID NO: 24806 - DNA, 9017 bp, Oryza sativa
ggcttgatgccgggcctggccggtacatcggctcgtggagccgaagccgtggggcccgcttgccagccgtgccccccccttgagccgctgcggagtgggcctgtgtaccagcgcccttcccctctctctcccggttccgctgaccggtgggccccgcttgtcggctccgcgccaccccgtgctgacgtcagccctggaatatattgcgcaataattaattaagcactttttctttattagtaaaaacacagtgaatcttctaaaattcataactaattcatccgagctccgtttaagtccattcaagtctcagtaaatcaagaaaaatgtgtagaatccattaaaaatggttttgtttcctgtttcagtagtcttatagcatgttttgcttgtgtgctttccctgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcccttattacacgaatacaaggcactgccttaaacaaaaagggaaggtgcttatcattggtacattgtatcctcaacatgaatcatccctaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccgaagaaggaagaagggagtaaaccttttgcaaatagcattaggggaaggagaaaaaaaaggaactttcgcaaatagttttatttataaaatatgtccttaggttttatccacttggcttatcctacagtcgagatggctctgataccatcttgtcgcgaccgggaaaattgccttttcccgaacaccagtgtattaatccccgtcccaggaaaagccgggtacaccacacaaacatggtataaaagacacatctttattatatcgataatatttacattattacaaaggtacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgggattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggctcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtcccgggcgacgacggcggcgaaccggagcttgggggccacggcggatagagaggaggacggcgcgagcacgaatccgacgggaagagcgagcggcgagcggcggaacggaggaaaaaggcacggggaacattatatagcgccggaaggaaaaagagaggccgagagggaaggaaacggccccgccgatctcgggcgccattgatgccggcgaggttaaggggaaagattccgagcgaatccgagggagagaagagagggaaaagcggggggaaacggagagggaatcacggggagtaatttccccctctttaatgcgcgcggggacggcggaatccggaggaatccgcggcggcggcggcgctagggcacgggcggccgacgggaccggcgcgaggaagccgatgacaggtgggccccacccgtcagcgagggtggcgggcgggcccgcctgtcagcggcgcgcgcgcggggaaggggccgagtgggccgcggggaggagagagagggaaagagcgaggtgggccgagccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcgcaatcggcatgtggaatttttcttggattaaacatgtcaaaatatgctaacaggatttttagtggaattttcagagccctagaaataa

SEQ ID NO: 24807 - DNA, 341 bp, Oryza sativa
cccacttcctccgctttccccgcgcccacgccacgtcgccgcgcccacgccacgtcgccgccctctccccgcgtctcccggccgttccagcgcacgagaggggcgggattcgattttgaatctccccccaccttctctctctcctcccccacgtcgccggcgaaatcggagcgcctcccggccacgtccgcctccccctccgcctataaaatgctccccatgccctcctctctcgtttttcgctctcaccgctccatcccgtgccccctaccgagctcgcaccgccgccacttacgccgccgcccgtcgccgcactccggccgtgtgccgccgtcgctaga

SEQ ID NO: 24808 - DNA, 683 bp, Oryza sativa
  unsure (1)..(683): unsure at all n locations
nnnnnnnnnnnnnnnnnnnnnnnnnnnnnnnnnnnnnnnnnnnnnnnnnnnnnnnnncaaggtacccgtgtagtccagttaaaacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctg

SEQ ID NO: 24809 - DNA, 1235 bp, Oryza sativa
agaggaagggggggaaagaagtcttcttttagggtttttctttttataaacctttttaactttgtgaatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgcccctgacccctcgtgggttttcgctccgcgtgtatggggtagg

SEQ ID NO: 24810 - DNA, 18038 bp, Oryza sativa
agctttttctttggattgattttttccagattcggaacctagaccaaggaaagggtgggctcacactttgtagctgcttcatacacagatccaccaaacacagaagtagggtattacgcttctcagcggcccgaacctgtatacatcgccggtgtcttctgtgcttccggtctcgcgaaccttccacatacagattggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctagaaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtaaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgagggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggaggcggcggtggcggtggaggcgaggtgaagcggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccggcggggacggccggtgcggcgaccgctgcgccggcgccggcgccgccgcggggaccgggtgggagtgggccagcgggcgcgcctcgtcgacggtgtccgagtggggccccgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccacggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggcttagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcgccgccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctg

SEQ ID NO: 24811 - DNA, 16133 bp, Oryza sativa
  unsure (1)..(16133): unsure at all n locations
gctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgtcggtaaccctttccatataactcgaccagtaaaataaaaggaattgctaactggctacctgctgatctaccctataattcaccaacttgttttactcatctttcactcttacactcttacattcatcactcaacggttgagatcatccctgtgaaatccaacgctccatgtcatctccacctcccacctcgcaccataaccccaacccgactcccgtcttccacgcgattcttcctcccctttccttcccgtcttccacgctacagattgcgcctcctcaattcctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccgcccccagtcacaacangaagatcacgaatgcaaagaattgaccctgaaatcaatgaacaaactggaccagcagcccccttggtcataatatcggtgaaactgatggggacgacggtacattgtagcacatggaacctgtcttagaagcacacttcttccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggtggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttggacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtagccgaaggcctgggttcattttaggaaggaaggcccagcagcccagtacatgacaaccatgtgcacagacctagagtttgagacaatacaaaacaaaacatgggagggcgtcatttgccaaacatagtaccacctcggaagtcttcaagaaatgaatctagcttaaaatgcaaaacctttgaccgctaagcacgaccttacttgaacaggatctgttctataggctcgtaccgttgcatccttgactaataaggaggcaagcactcaagcttggttgatgacgcatgacctgtgggccagagcgtgattgacggcccggatcatttccgtgtgaattgatcccgcggctgtagaggatcgttccttgccgggctttcgcttggtcagggttggcccataggttgtctgacaggcatcattttttttttcagttatcttcaccactccattaattaggccgttttttcaatatttaggagaagcctgaattactaacagtaaaatctttgacaagcccaagtcatccgcatgacaatccaaacagtaatttgtagatttttgtaatcatagtgtgttattatccttcatcaattgatacttctgctgctcacattgatcattcatcaattgatacttctgctgctcacattgatcatttggactacctcgtaataaatggaaatccaagttcatgctacggagcattggactgataattaaggtgttttagtcacatcatgcatatacacaacaaatctgaggtacaagatctcaacaacgtactccctccgtctaaaaaagacaaatcctaactagtgaaattaagtgagcatacatagtggtactactaaggctatgtttagatttgacataccacatcgaatatacggacgcatatttaaagtattaaatgtagtataataacaaaataaattacagaattcgccccgagatgaatttattaagtctaataaatcaatcattagcaaatgtttattgtagcaccacattattaaatcatggcgcgattaggcttaaaagattcgtttcgtaatttacacacaatctatgtgattaattattttttcgtttatatttaatactctaagcatgtatccaaacattcgatgtgacattgtgtaaaattttatcaaagggattgccctgaagactgctatgcaggtccagacttggacgaaattaaattacagcatctttcatgattatgtcaaggccctgatcacatcagctgggtcctcagaaacataaacccccatgttaaattgcattatcatcagtttgggcacggatcagtacgacagtacactattggatacaatttccatctactaatgtttacaggtggagtttttaaccacgtgatggctatgtgaaggagtaagataaactgtaggagaaaagcatttcgtagtgggccatgaagcctttcaggacatgtattgcagtatgggccggcccattacgcaattggaggacaacaaagactagtattagtaccacctcggctatccacatagatcaaagctggtttaaaagagttgtgcagatgatccatggcacgaccttacttgaacaggatctgttctataggctcgtaccgttgcatccttgactaataaggaggcaagcactcaagcttggttgatgacgcatgacctgtgggccagagcgtgattaacggccggatcatgtcactggctgattcgatcccacggctgtagaggatcgttccttgccgggcctcgcttggccaggatggctctcaggttgtctgacaggctcccaattttttttttcgttttgcattgagttttctccgtcgcatgtttgcagcgtgttcaaaaagttcgcagctgtatttcacttatttacggcgccacattttcatgccgtttgtgccaactatcccgagctagtgaatacagcttagcttcacacaacaccggtgacccgctgacctgctcgtacctcgtaccgtcgtacggcacagcattgctggaattaagggtgtgatcgatactgcttgctgctgcagcaaccgtggctgcaagagctaaaaatggctgcagcggcagcagctgaaaaacagccacagccatagcggcagcagcagatagcagttccgatcaggccctaaatccaagtcctagctaaacaggatgctccattgaacagccaaaccggcctcacatggtctatccaaggacctgccagttagccacgaaatatttcgtgaaaagccagctgaaggctgaagccctttttgcactgaaatgagtatgcgtgcgggcctgatgatccgtggcattgttgctgcggggacatccatgcactgcagggtaatggaggagctgattgagccatatgtctcgctgcaaaggcttcctcctttcggtggttagcccagagcctctcccagagatcgacccagaccagcatgcagtaatcgaatcccgttcgatgattcgatctactaaattcgcaaaggctgtagcgcgcacatggcgccaacaggcaacagtccgggccatttcgccatgccccgggggatccctctgacgcctcacttgagattccttgaaagttgcgaacacatttgtggttttatcttcacttgtgaaagaagacgtgtcatcgtatgatctctactttcttttcaagaaagtcttctgggtgatcttatgagcactctgactatctgaacgctgcctaataattcacataaagctcgggcgccagttcacagttttcatacctggactactgctactgtgttagtgcagtagtgctatagctaatgatatggggcatccaattagttgggtcctcacctggtcggtccatacatgaacctgacgcccccgtgctgtgctggcttctacgttttcatcaccgaaaatattgcagtcccacacgctctctaggttaaggagcaactggcggcttggtgcatatacagtagtactcttgatcagtgaagacctaggtaacagggtactatagcaggttcctgtgcacaatgatgtgaagcaaaatataaatgcttaatttgtcaacattgtatacaacgcgcgtcaaaggaatcatttcaagaatgatcccatcttctgatgtagtggtgtccaaggctccatatacagctgccccagtgtataatgcatggaaagtacagaactatgtacatctcattgtgcaggaactcgtcacgaaacgcaatcatatatacagtaaaacatttttttttgtgtgtggaagtgccctttctgtgatcatgctgctggtagtgcccaataagctaagcaccaccaagtatattcccattgtcagtagtcaccagggcattcatcaagtcggttgatatatattgtcaggtagggacatcggagctagctagcagcttggccccggccgccggcgaccatcacggccgggatgatccgacgccatcccggctacttttcacagatcatcgcatgcttgccatggacgacaatgcagagaaaatactcttacctgttgctaattaaacgtctaagtcaaacacagaaactgaaaacgaatgtacactaagttttgcctaattagttcttgttgcgatctacgcaatggtttcgtcagcgacgaggaaagaatgcacacaggaaactgatgcaataatccgaaggtgactcgacaagaaattttttttcgcaggacaaaaggaaaaggagagttgtgaaaacgatcgaagtagccgggggtcaaaaagggtttgacccgcccacccaggctatgaatgcgatagacactggcttgacaggcccatcagctggcccggtatacctaacacaatcacgatggggggttggtgggcccagccggtcagcgagacagatagcgaatccgcgggcctttgggctttcgtcagagcccacctgaactgttggcatgtgcagcagttttcggggtccatcgagtgttgactctgctgaagaaagggtaacaaaacagatggagagttttccttggtttcacatacacagagtgagtacatcattaaagtaagtgaattcacaacatagaaatgcattcaattattcatcacaaaacctgttgttttattgcctttaattatggacaggatagtgtttgtttgtttatgacgtaacgggcgcgcaccagtatatattgtcactagacagtgggttttgttaggtaagtagtactgagaatgtagcctcatcattaagagttcaagatcattaacacggcgtacacttgttttgtctcaatagcatgtgttcccactgtgatgagatcagtctcgtgaacaatcccgtgcatatatgggttattaaaagcatcatcagacgtatggttgacctcttgcttggttgggttatctgtccactgtcctaaccacgtgtgttaggcgcagagatcgcaagcttgctagatcgatctcacgtacggccacactacattaccatacagttacgccgaaattaaaacaagatgccagatcactcacccaacttagctaagctccaatcgatccgtgcccaacccaaccgtcccggcagctgtcgggacaaactgagtagactccgagcgtgtcgatctaattctaaagtcagagcacactttgacgaacaggttgacccactgcgacccaggaatcaaacagctagtaggaaactagcatttgtctcagcctaatagcccaaagatgccctcgtgtgtcctactgtccttagcccggccgtgtcaacgcccagcctaaaccggccaacacgtcaacgatccgtgtcgcagagcgtgtgcttttcctgacgcgacggatgccggcgctactgctacttcctacccctccgaaaccgacgccgcggccgggttgggtttgggtcttgggtcagcgtcgacgtcgtcgctggcctcgtcggtttcggaggcacgtgttacaggccgggaaccctcgatcgatcgcgcggccgcgcgcacgcacgcgcgtatggtttgctccgcgatgttgcggtgcgcactagccagcggaggactcgtcgcgtgtacaggttgccgtggcgatcgagcgcgcggcgtgcgtgtccacgtacgtacgccgccccgcgcgcacgcgcacgccgccgtgtttcgcacaccggcagccggaccattctagccggcgcgcgggcgcgagcgagcgagcggcaggtcggtcggtttcgggagacctcgtgccctgggtggcacggcagtggcaggggggacagcgtagcgtagcgtagcttgccatctacgactggacgactccaccaacaaaacattagactctataaattaaaatctgtatatatgtttgtggctagcaaaaatggtaaattcgagtataaagttacaggcaggataagtaagtgttcgcaagaggaaattgattgcacgcttctaacacaaaccatgcacgagcatgataataatactatatatttgtagttatgggtcaagctaccatcccaccttgtgctaataaccaatccttcaacgaaaacgcatccaagagatcgatcgagattactactactactactgctgtcatcatctccaggttctgcaaagtgcgaattaccggtgaagtatcactactactcgatcaagtcaggcaggcaggggaggaggaaagagatcaacctctgaacataaactagtaatttcacctctgaaaaaaacacccccagcactcgataggggaaaaaaaacggaatgaatcgaaagttgacctccattccaaaccccaatcattccgatcgggcggtcaaagcttcgtcgatacgtggcagcgacgtcgctggcccccggccacggggagggagggacacggcgtggtgtgtcgctggacgccgcgattcagatttcagaggaggatgctgtccctgtcccgccttttgactcggcgttccgatcgatcgatcggtcgatcggctaagcgagtagtagcagcagcagtggagtgccgtgcgttgttcagagttgcaggtgcatgcgtgcgtgcgtgtgtgcgcgagagagaatgagaacgggtggcgtttgtggtgtgtggcttggcaaggcgggatggagggtgagtgggcggctggctttttccgggcacgcgtgcgacccaatcgggccccgcgcttttgacgccttcgccgccgcagtcataagcgtgacgtcaacgcccggggtcttcattcttcaatcgcttaaactggctactatggctaactaattgcataagctgtaccgccggtccgccgcccgccgtgtgttgtagcctaggccggccaccgtctgtctagaaaagattctaagattctgtttgaaacatatatattatcatcttttacaatattccaagattttgtttgaaacagattgtcgagtaaattattacgacagattatctatttaattgtaaacatatgttaagtattttgataaatatgtaatttaaaacatatgggcaaagcaatgcattaaaaaatttattccgtagtaaattacaggggtatcatctaagtaatattagctgattatattgacatcgcatgtctattattatcagtcacaaatcgacgagcctagacgactgcataggatcactggccttagttatggtgtagcagaaagtaacttttctttcgcgaatgctcattgcatgtcaatatattagaagagtttttgttatacaactcaatcagtcagacatgcctatggggggagggagaaaaaaacaaaagctacaaccaggtaaaggaaagaaaaaaaaactactacggaaaaggctactccgatcagcgggagggtggaggcagaaccataccacactcctaataagcccccaaaagcagcaacaccagcagaagaccacatacgagtatacgaccctccgagaggatagactccagaactactgagaccgaggagagcgcagagtcgaataccctagagttccactccttccatagctaccaagagacgagaaggaccggggagtcgaagttggcgcgaagatgcttagataagcagaccctagaagacagccactagacctgaagcgagctgtcacggggggagggcaacctagccagagggcgacaacatgtggtgctagatctgtcgagcgaatacacagttgaagagggtgtggttcgccatctcaagattctgtgtgcaaaaggggcaggctgagtgctatcaatatcacgcttctggagaagatcagccgtccagcaacgctgctaaaatgcaaaccagatgaagaatttacgtttaaggagaaagtacattaattatatatctgctgagtactctaaattaccaactagtactcaattatgacttatgcccttgccttcatttcaaaattttaatagtactagcgccgtgtttagttccgaaatatttcttcaaacttccaattttttcatcacatcaaaacttttctacacacataaacttctaacttttctgtcacatcgtttcaatttcaaccaaactttcaattttggcgtgaactcacagctagaacaataaccagtctcttcattcagaggatctctctatgtactacggcgaatacgatggtttcctgaccataagtagaagaataatgtgttgactatgcatgatgggcggatgcacgcttaatttggccatattgcaccgtgccatgcatctaacgtcctgattggatgtatatgtgtgccaggagcgagcggcgaggaaaaacaaaaacgtcgaagagtacaaatacgcattgactgtcgacctgcaggtctgaactctgagagagaatataatacatggacaaaaatccaaaaaggagaaaggcagaatcataggaacccaagacaaatcgccggccgatgcatgcctaacgcgacatgaggggttcttgctcttctatcacaatctgctttttccaacgaaactgatatgagtacgtatgagattaattacttctcattaagtttgtaatttgcgaagttatatgctacgactgtactttggacagaggtgtattgttctttgatttattttgatctgtcactcttctatcttcacttcttacacacatacgcatgttttcaggcaactaatacactactagagaattaatctttgttggatcgctaaaaaacggttcgaataagaaccgggactaagattatctttatagtccctgttaaaaagctgaagggaattttttgatcttagtcctggttgataacatttttagttccggtttaaaaagtcatcaggccttactatctttagtcccaccaaccggaactaaagattaacatttagtcccggttatttataccaaccaggaccaaagattgaaaaaaaaattcaaccgcacactcctcggtggaagggaggcggtgcccgggcgggcaggtggaagggagggtggcataggcggcggccgagcgggcggaggggtcgtcggcaacgctgatgtcgatgtgcggattgttggttttgtgatgtgtggacttgtgttgtttgttgagcatgtgaattagtaatgtcaatgttctatgaattcgtgtagtcattttgatccgtgaattttgtgatgttggtgagtttagctgtgaatttgtgacgttggtgagttcggcgtgaaatcaatatgctgacaacaaaaatacaatgaaaaaaaaggaaaaaaaactttagttccggtttgtaacaccaataggtactaaagatttatctttaaacccagttatttgaatcgggactaaaaatggacatctttaattccggattgggcatcccggtaacatatccaggattaaaaggtgtttcgaactgggagtgacgtgggtttctccagtagtgataggagataatctcaacttgtatatatggatgtgactctgtgagaagtgcgcgagattcacagtcacattttttatttttaaaacttgtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcttggtacaggccgggaattaggtgccgcagctcattacccctttacggttaggtgatatcatcaaacattccctctaatcgttctaatttttatttgtttctgttgctatcgctaagacttcttttgagaggtcaatgcctttgattacatagaatttattcgctagtctttcactgcttgttttatttgcagaaggataataagacattaatttaaactgattcgacatatttatcctgattctatcgtgaaaagcatgcatgcatattgctatcaattaatcaattattgaagtgatattaatattgtgtaccccccaaaaaaaataaatataagagaatctcaaaattgctgacaaatggcatgtctagctagtactagtgtgtgctaccactactggaacatcgtaaaataaaaaaaagaaagaaatggaggtaggaatttctagacatagcacaacagtatagctagatgtgatatgtttggcacaaataaagggaattttcttttttgtctaatctccttttaattaattccaaaggaataatataatctatattcctatatgagttacactgcacacatccaccccccctacatttcttacagatgctctttctgaggaacgacaattatgatccaactaattaattaccagacaaaaaacaaagctggtacattttttttacagtagtacacaagcagctagggctataggtgtccaaacgggcggcacggtccggaccggcacgggcacggttccggcacggcccgtttcagcacgggccgttaggcacggctgatgaaacgggccgtgccgtgccggcccacgtgccgagccgtcggcccaagcacggtccggtgatggccgggccgtgcccgtgccggcacggtacgcccgcgggccacgggacgttcggggcacggggggccgtgaaggcaagccggcaggccggcagcctgcagtgcacagtgtttttttttaaaaaaaaagcaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgattggctaatgttaaaaaaaagaaaaaatgg

SEQ ID NO: 24812 - DNA, 8871 bp, Oryza sativa
  unsure (1)..(8871): unsure at all n locations
ctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaattctaccccactgtatctttttcttacctgtagtggggataggagggggtctctgctggcgaacttncttgaactttactttatatctttcaaaaacctcatataatttacatctaacctcagtataaaagaactataatctacacctatagtatttccaccaagtgataaaatagcagacaatccctttaatttacacctaggatctaaaccaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaatttccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggagcttgaggtgacctgtaccaccagaagaacgagcagataaaatttgcctacatattctacaacgggctttcgatacctcccttccgtcggggcatgtttcctttatctcgtcgaaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccagcggcccaagcacggcacggctactcgtgccgtgccggcacggcccgttactgtagcaggccgtgccgggccgtgcctgctacaggttcgcccgtgccccgggccgcccgtttggcccggcccatttggccacctctagctagggcatgtcaaaaccctaagactaccatgcatagactacatttatgcatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattctcctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttcaccgactggacccagcctttcatgtgagttatatatacaagccaattaattaactcgtactagctaccatatcatatggagagctagcttagctgagatcgatcctgacatgtttgcatgcgattttgtgtacgtttcatcaggaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccggtcttgaacccttcttgccgattcngcatgcccgcngcttttgcngttgcngccgcngccgcccaaagatcaagctagcgttcgctctgccaaacgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttaccctttttccagagaaaattgaacttttttttatcacaccaatgctcttcaaaagaaattcaacgcaccacatgtccaatacaattctggttctgttgagggtgttgaaatttcaaatagcatgagtaaaaccatagcttttaacccccaaaacgaactttttaccaagattcatggttggtatacagagtcaaaattcaacagaaatgctcttcaaaagaatttcagtgccaaaaagtagagggagatatgtcaaatagttgattttcacccaatccattaatatttgtactgcacgaatacaattctatttgaaccctttatttcttagaactgagtgaaccatcatgtgtatctgtcatggaatttgattcaagtttcacttgtatgagagctacaaccatacatgttattctccttagtgaaatggtaaaccaaatgcgacgaactcctgtaaagctagcagacaagaacaattcaacatcatgcgcaaaaacacaataatagaattcagtccttactgaaccactatgtacatctagaagatatatattataaaaatatataaaagtttggtcaatcaataaggagcattaccctttttctctttatttaccaaaacatttagaaatccatgagctagacatctgcattgcatccaccatctgcctccccggtttgcctttgccctgtattgtcagctcagagactcacatagctgcattggttctctgcatgctcaattctgttagaacatttttacatgactagccaccagaatgcacaatatggccggcttgcgagagtacctgacagtgacaaaagaaggctacactgcaaactcatctcagtctcggccacctgttaactgaacctatcagatccaacaaagatcagcaagacaatgtttttgtagctataatatgatactattgctgaatgccattttctttttctgctgacaaagtgatgaaatgtggatgattgggctgagttaggctgcaatgttgaagaaagcagatctctgaaatcttacaggtcatggtcacttgaaaggggctttcctaccttcctgatactgagagatttgcaagagcctcacttgctgacattgtcatttactggaagtcaagcccttgtacttccaacggtttctatcagctgcatctcaaatccgactgctcacagctgtaaaattattcactttttttctgaatctctgatgaaagtcaagcatgtgcttccatgtcagatctcctcctcgctttgctttgagatctcgacgagttctcgttaacctcgatgggtgatggacacagacgggttggtcgccgtcagttgtagtagatccgacgggattgtccgcggcggcggcgaccgaggtgacggccggcggctgcgaagcgaggtcagggaagcggaggagatggaggacgagccgccggagagcagaccgccggcggcgagggattcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctccttctctatctccggtcggtcgtcgcccacctcccgccagccccgcgccgtcgtcggccgctggccccacgcgacagagacgaagagcaggcgaggagtcctggcagcaggcgcgtggcgcgctccctggcgaccaacaaatggacagcgcatcggcgaggaag

SEQ ID NO: 24813 - DNA, 4982 bp, Oryza sativa
cacgtgtcttttcacagtggcacgtacggtggcatgacacgtaagcaaaagtggcaaatagttaagaaattacctctacaaattattaaatacaaacataagagggatatttgaataattggcaaacctaaaagtggcaaatagttaaattccgctccaaaggtaggcccgaataactaactatacgggccctttcttcaacttgggtccaaacaaatcggcccgtacccacgagtgggccgatgcagcaggaatgggcttgttcaagttttagattgcagtcaggcaatggacaaatggcatagaagattagaagatggaactatactgatgttttccatccattccattctgagctaacccttacggcatgtttggcgacttaacaaaaagggattggtagtttagaggaggaagttgggagtttcatttttatttctcgtcccttggtagtagagatgagaatcatacaaagtttgagtgggaattaaagttcaagtgatgacatacaattcagatatatcctgacatacttaagaagggaatcccctccaaattaactgttactaaacacatattgaaaagttgagattttgctctcaaactctccttcctaattcattctaaaactccgacacccaccatccaaacaatttcctccaaccaaacgcgcccttaataagatgattgcatttcactgacataactaggatctacaatagatgtcaggacaattgtccgtcgtccatttggcaacggatacaaaatttgttgataatggattatattcgtttcaaaagcagaagcaatgaatcaccattcctacaataacgcatagctgcagaaaatgccgaaatttacagacaaggataaaacaaatataaacattcatctcccctccaaggctgtaatgctcacgccattcacggaattttccatattctctcttgcatattcagttgcgcgttttttgtgcacaaaaaatataggttgctttggttgaggtagcggtgcagtattgttctctaacatgaacacaacagatgacatcagcggcctatcatctggatggtcctgaatgcacaagagcgctatgtggatacatctcaaaacttcatggagtggacaactctccacaacgctcgagtccaccaaatcccttgcatttccatctttccataagctccaagactacaccaacagaatataagaatcagttacaaaagtatgcatcgtttgagctgaagaaattaagcattctgctgctcttacataagctataaggtttgggaagcccattatgagatggggtgagctgatcctgaagccacttatgatctccaaaagtagaataccaaagctatatatgtcagacttgacagaaaagattccttccattgcatattcaggagacatgtacccactgtttgttaagcggtgaggaatgcaccgtttgaatcagtaaacatgtaaatttgatcacattaagcattagataattcatgcatcacttactatgtcccaacaacacgggtggtgtttgcttgttgctggtttccaccaaagatccgtgccatgccgaaatctgatattttgggactcatttcagcgtccagcaagatattgcctgctttgagatctctatgaataattgttaatcttgaatcttggtggagataaagaagccctcttgctacccctttaattattttgaaccggtttggccaatcaagcactgtttttcttgtagcatctcccaatattaacatgaacaaagtgtatcgtcagccatcattcagtatatatttttactaattcactaatcatttaatataaggccggaaatcagaacataccaaaaaggaaggcatccaagcttttgttcggcaagtattcatagatcagtaacttttcatcttcatgaatgcagcaaccaacaagtttaactagatttctgtgctgcaatcttgcaataaggacgacttcattcctaaactcctctattccttgcccagaacccttactgagccttttaacagctacttccttgccaccttccagaattccctatgtgagcaaccaaatgttcaattaaacaagtaaaagccaaatattaactggaaatgtcaagctatgacattaaaaaaaaaagaaatatcaagatatatcttctccttaccttgtaaactttgccaaaacctccttttccaagcatattataactggagaaattgtttgttgcaattacgacctcttcaaacccaatgaatggaaaatccacatcttcagccccaagttcatttgaggcactcaagtattgtaccataattttgttctggatttccttgcttcgctgtttgcctaacaagaacagtattatatagaaattgttttactaacaaaactacatggactgcattttgagaagtgatgtgagtgttgttgtaccccttgatttgcatatccacacaaggcatatgcatgtgaggatcagtaggctagccacaactggaaggacaatcttcactacatcagtctccttcttgactgctgcagaaatatagtccatacaagagaatgggactttcaggttctcttcataagctgcttgcaagtgcatggactagatgcactttactattagtaatgtttcattttaaccatatttgatgctactacagacttcagatgaattgtgaattttacaggcagatttagtgtgtctgcaaacatcagaggaagtggtaaattggcaaatctttacacattgggcaatagagtattgggtcccatagtagcagaagtggcacgccaaaagataggccacaagttgctaatgcagcaggataccaatttgagtcctgtcaatggtacatgaactggactgaccaagaaatgcatcggctagaaaaaacaaattactgaaatcggtgtcaactgaacaattggtcgtaatatactaggctatgtttcgtgaccaccattatctttcctaatataacttcctcaactaaagagtaagagcaacaagtgcctaattcagcaaggtgcccattcagtatgaaatggattagaaagcatagatcagaaagaatgctttataaaacagtttagaaagctctgggtcaagttaaaaagcataaaaaaaaatgcgtaatcaaattaattaatacttaacagtgcataagtggagtaagtatgggcattaatcacaatgtagaggcatatgatgggcagggaatgataaaaagtaccagttgggctcggaagccggaggtacagattctcaccaccaccagtgacctttgccaggtctagaagctcccccatccaaaccaagcacctggatgtgtcacccatcatgctggcagtgctcaggttcgcgtaagcatatgctgtgcaagagcagttgtgcctgcactcttccatgcactcatcaaggcttctgttcctgatgtacaagaacttgtcaggtgttttcatgccaggcaaggtcaagaaactatctccatagctacatttcatctgctcctttctcacacatcctcttgaaatgttaagaccatcaggcttgaatccatcaaggcacttgcatgttgggaatgcctccgcagcatcacaataaccaaatggtccacaggaggcatatctttcgcaagtataagagggattgctgaataacacagaccatgcaaacaagttgctgttccagatcagcatctttattgttcctgtgtagtcgagcatcaagcgcatgctaggagagtcatcagaaacagagtacatcatgtatatctcattccctttgttgatgattgtctggtatgtcacagagctggtattactctggaacatagcagagaccaacgcaccattccatgccccactacgccagtatggacttgttccattccaaaccaaaacctggaaatccgagttggggtcaccactgagggaaaagttgccggttgatggatcatcagggcccttccaagaaacaatgcgctgagcaacctggccattgtatttcagcaagagcttcatgccagggaggatggtatcagtcaaatgatcaaagctctgccacaagattgtgtggttaggagatcgaaggaccaaattaccagaattaagaagaactaccgtggctccagaacctccagtggtgatgttgttccttgcttcccaaagagtgtggcctcccgattcagacaacacaaggtcagaactgttggagatgaagagcatggcagaagaaggggcagtgattgggttgtcacggttggcaacccacaccacggtgcgattgggaatcttgtggtaccatatgccaacatataaggtagcatttgagtttgttggggagaagaaaccaagagcaaaaacaccaccatccgagattagcatgtcaccagggtagagtggctttgcaggtgttagctgatcatctgatttgcacaaagaaatcaagaacacgagtacgaaaacggtagcgaaagccgtgcccattaggccttctattctgtgtaaggttgagtaagcatggaagcaattcttccctccaattgtaggaagctcttatcagcgaggacacgcaattggtaggaactatgaacaacaagccaaacaagggtcggtctcatccagctgaacaaagttgactcaaatgatttggccatccagcaaatcgtctgcccaacttgagccagcaactacataatgccgtctgagtgaaggttccttgaatttcattaccagggacagtaagtcaaatacatcggcacatctccatccagaaatacaaagtcgaaagttcatcgaacatgtgtgagtatgacagttaaaaggggggaatattgagaaactggctggctcaccaagtcaccatcggttttagctcgcggcggaggcgactgaagcggaccttaggtctccggggaaatctcgccgtagacggccggcggctgtgatgggaggtccct

SEQ ID NO: 24814 - DNA, 1340 bp, Oryza sativa
ggccgtttcctcaccatgcggcccagtaaatcggcccgtcacatccaccccacttcgctttcgtcagagatcgccgccgtcgccgtcgccgccgtcgccgccgccgccgctggatggaaccggatctgcctgcgcgtgctcgatagcttgcaagaccgatcagttggcgaatcctgaatgccgcagcggcgcagccgcctcggctgcttcccgtcgggcggcgctcccatggaaggatggggattggttccgttaacgcagatggtgcgtatttcttcaggccttagatccatgagagttccagtgcgccattgattaatagggtttatccagatctccactgtggaatgtggattgtgattgagagtattgcttcctggttggtggtggtgtgcaggtttcgccttggcctggggctttccatgaataaggcggcgccggcgtgctttgctgctttggacaacgcagcagcggatgcccttcaaagttcaaactcgtcacctgtaagcagactgcttctttcctatgcaatgctatcaaatgataggatttggccaaacgatttgcatttattagtctgcaaatttcagagcaagccaaggctgcagtagcagaaatagttaagtttctgaaatatggatgtatggaagcattccttttatgcaaccaagcaacaaagaaaatgctggttacaatgtattgctcagaacattttctgtgtataaatttgaattgctaatgtataagtgtacaactacaagctacagaagtttatagactaaacagggaatggtgtaataaacatttaacgtccctctagtgctgtgatactcacgttatttacagatctttccttgttttctctagtgtctttagttccatagaccctagctgtcaaataagcagactcctttggggtaggaagagcagctgtctcgttctctaacatgaacacaatggatgacatgagtggcctggcagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccgaagcatattcagaagacatgt

SEQ ID NO: 24815 - DNA, 6224 bp, Oryza sativa
aatggtgtaataaacatttaacgtccctctagtgctgtgatactcacgttatttacagatctttccttgttttctctagtgtctttagttccatagaccctagctgtcaaataagcagactcctttggggtagaaagagcagctgtctcgttctctaacatgaacacaatggatgacatgagtggcctgccagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccaaagcatattcaggagacatgtaaccgctgtttagatcattccaaaaacaatgtaatgtgcagtttgaattagttataatgaaaacatatatcattaggtggtctacaggttacttactatgtcccaactactctggtagtattttcttgttgcttatttccttcaaagatccttgccatcccaaaatctgatattttgggactcatatttgtgtccaacaagatgttgcttgctttgagatccctgtgaattatcgttaaccttgaatcttggtgcaaataaagaagccctctcgctatacctttgattatcatgaaccgggtcgtccaatcgagaactgattttcttttagcatcttccaagattaatgtgaaacaaagttaattgtcattaaccatgaatatcctcaagaatgtttgtattatacgaccacaaataagtgagtaacaacgtaccaaaaaggaaagtatccaagcttttattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcctggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctgggctgtaaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacctgaacaagcatagcaggtgatcaaatcacaacaaaactgcctgtgcaagtcattcttttcaacatctcatgagtgaattgcacatggaaccacttatttatttttacccatatgttgcaaatcggattaggggtacatcaatctgcttatgcaatgcattcttttacaagatctataaacctcagctcctactgtagtaatgtacaactgcagaaactgcttgagagtttaatctcttacagtctagcggccttctagcgctgtcaggctcgcgttattaacggaactttccgagccttgtctttcttcttcgtcgtaatgcctttgcacgaaatatatagggctgcttcggtattgggcgtgccatgtcctcgttgtccagcatcgacacaactaatgacatatgcggcctggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattagtaaagatttcttaacttgttttaactatattgtgttcgaattgttaacataagtattggtagcagcatgcacttacataagctataaggttcggaaaatccatcacaatatgatgaggggagctgatctttaatccacttacaatctccagtagcaatacgccaaagctataggtgtcagatttgactgaaaaaatgccttccattgcatattcaggtgccatgtagccgctatttaaatcatttgcaagcaagcaggaaaaaagtgaataagttcaagcacatgaatatgttgaactagtcggctagagaacaagtccacttactaggtcccaacgactcgtctagtacttgcttgctgttcactgtttccaaaaatccttgccataccaaaatctgatatttttgggttcatctctgcatccaacaagatgttgcttgtcttgagatctctatgaattatcatcattcttgaatcttgatggagataaagaagtcctctagctacccctttgattatgttaaaccttgtttgccaatcaatcacagacttcattgcgtgatctaccaagaaaatggataatggacaggaatgaaaccattagagaattcgataatgttgactcctccattagagtatgcactttgtcttaatggaaattcaggtggggaacctctcccctccggtgaacattccaaaaaaaaaaaatcaagacttttttttaatgcatccttttctgaaaaacaagcttttcatttaatatctgataaaacttacc

SEQ ID NO: 24816 - DNA, 2639 bp, Oryza sativa
cttcatagctaatatcagggaactctagattttgatcccatgagtcatgaaaagcactcaagtatcctagctccgtttttttaagtacttccttgtttcgtcgtatgcctaatataaatatcaaaacatgtcaacacaacaatattacatttagcagctgcatattgcaagtagctgttatctcttgctttacctcttgactcgcatttacagagtacaacgcatgagcatgctgtcagtatcagcaggcatgctatagctgggagtacaatctttacaatgttcttgttgtttactgcagaatgacatttatcgtcatgttcatggagaatgtggggcaattgctagagaaaacatcatgagacggcgcatacctgcaggagagccggcgagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctcctcctttcttcggcatcctctggaagagttgaggctaaatccatcggccggctcgaagccatcaaggcacttgcactcctggaagctgccggtgatgtcgcagtagccgaacggcccgcaggcgccgtagtggagacagccatggcctggtcgctcgaatgggctcgtccaagtcgatgatacgttgttccatgcccggaagctcacgttccccgtgtagtccagcttccagtgtgtcaaaatgccatcagctgcgttgtatatcgcgtagatctcctcgccattgtcaacgatctgggaccatatgtacctggtgaggccggtggccgtcgcgccgttccagacaccgctgcgccacgacgggctcgccccatgccagatgacgatatggagcccccactggtcagggtcaccgctgagggagaactcgcaggtggacgggtcgcgacgacccctccaagcaactacgcgcaccgcctcatggttcttgtatgttcgtccatagcttgaagccagggaggccagggaggatcgtgtccgtggggtgatcgggcaaccggagcacgaagttgcccgtgttctgcagcaccgcggtggctccaccacctccgatggtgaccgtgttcgccgtggtccccttggagtcggatagcacaagcccggaggtgttggtaacagccagcctcgccgtatgggtggtgattgggttgtcgcggttggcgacccagacataggtgcgctccgggatgttgttgtaccatatgccaaggtagagcaggcttggggttgagttggtggtggtcagggagaagaagccgacagcaaagacgccgccatccgagatgagcttgtcgccgccggggaagatgagtggctttgccggtgttaggcggtcatcggattggcagaaactaatcaagaacatgaagatgactacatgcagtctggtcatattctcttgtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgaaaagagtggtttcgctggaatgctatcccttcaaactgattcattaaaatgctattctaaattgaaggtgttcaccaaaatgctattttcgtttttttaggtaaatagaaatgttttttctcaattataacttttttccggaccaaaatacccctgatgcgggcccacctgtcatactccctctactctctcctcctcttcatctctctcgagggagcgccggtggttggaagcgagcagtggccgacagcgccgttgaagctcggtgtcggcctgtacgacagcgccggcgactcgccaccggcgtacgacggcgcggtgctcggcggctgcgatggcgcgcggaggccccgctgctcgtggtacagcacctgcaccaccgtctgcaccggccacataagcatttagtggagtgattaacgaaggatttagccattttttagtgatcgatgtgaatggcagcttctaaccttcaagtagatgtcgatggcgtggtacatgccgtcctcgttgaacctggcgtgctccgggatgagctcggcgagggcggtgaactagtcaatggacaggttctcgtcggaggcgatctcggcgaggtagctctccatgagcctgccgacctgggcgacgtcgttgtgcggcggcgacaccgctgagctgaagtcgtcgtcggtggtgcagtccagccgtggcggcgccgccgccgcgtcgccctcatggtcgaggtagccggccaggatcctctgcacggcgtcaatgtcgtaagccgttgtggcggcggcgtcgggcgaggaggacgg

SEQ ID NO: 24817 - DNA, 3310 bp, Oryza sativa
acacctccagtttaagatagcattttagtgaattagtttgaagagatagcattccagcgaaaccactcttttacgatagtataatcccaattttctcgttgagagtggccagatgatcagaacgacacgctagtagttgtatgtcaccgttaagattgaagacccgatttattgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccagaacaaattcggcccaccagtccgcgaccggaactgtgagattcgtgggccgtgaaagtgctcgtgatgggctattgggcctaggtcgattgatctgtggacgaagacgaacgtgcttcggttacttcgccggcggagtggtggttggcggcggtggggggcggtgagccggcgacggtcggcaccgcacgtcgaagcgcccggcgtccgcggtctgccgctcccggtggagctcggcgaggtggcggaggcgttgcagcctaggagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatagaaagtcataacacaccaaaaaggaaggcgtccaagcttttgttaggcaagtattcatagatcagtaacttctcatcttcatgaatgcagcaaccaagaagtctaactaggttcctgtgctgcagttttgcaattagaaccacttcattcctaaactcttcaatgccttgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgttttt

SEQ ID NO: 24818 - DNA, 1339 bp, Oryza sativa
cggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatgtggccttgggagtccgacagcaccatgcctgagctgttggtgatggcaagggtcgctgacgaaggggtggtgattgggttgtcgcggttggcaacccacacaacggtgcgctgggggatgttgtggaaccagactccaacatagaggctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattc

SEQ ID NO: 24819 - DNA, 1210 bp, Oryza sativa
gtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatc

SEQ ID NO: 24820 - DNA, 2192 bp, Oryza sativa
tgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcagacctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccggggtgttggatgggttaagtgcccaggtggaggccttgcaggcggagcgtgccgagctcgacgccgcatgggcgcgtgtcgaggaggggcggcgatcg

SEQ ID NO: 24821 - DNA, 11137 bp, Oryza sativa
gctaccgaactcaccatcgccgacatgcagcgcgcgctagactcatccgccggggaagccgaggccctccgcttggcgggcgagatagggcccggcatgctttggaatgcagtctcccatctggatcgcgccggtcgccaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggtacggggttggcccgagcccgaaacctgacacccgacccccccctcaggggtagaagcgtcgaaggtgctcgatgttccatgggttaggcaactcagtgccgtcgcccatggccagccgtatggagcccggccgggggacgccgatcactcgatacggaccctcccacattggtgagagcttgctcaatctagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcaaagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggttaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcagacctccgaccaccgcgcccggcgcgtcgcctcatgagtaggggccgcggccaaaagctctcgcttcatggccttgaggctcggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcttgtaatggttaggatgaagcctggcatatatctgatcagggctaacgtgccatctctgggaggtaacacgctagctccagctggggacgagcgcctagaagccctcgtcctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccactgtgctcacctaacccatacacgcggagcgaaaacccacgaggggtcagggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccatacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcg

SEQ ID NO: 24822 - DNA, 6773 bp, Oryza sativa
ggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggttacttcgtcccctccaggctccaatacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcatccaactgacgttaatacggccgtgcgtcatacacgttgtccataagccgatcgagagatgggacggacggtaggtacagtgctactgcaatcgcgccgtgtcgtgtgactatccctgtgcaccgtgttcattggggctgatgccgagcaggcaggggcagcccatcgcgcgcgctagaaagctagcaggccgaggtgggccgcgagcccgcgagggaggagaaaattgcatatgtactactcattaaaaactggcttcgctataatatcattctcaagatgggatttgcccaaacgccactcataatatatgggtattcgctga

SEQ ID NO: 24823 - DNA, 7574 bp, Oryza sativa
tccaaaaaaaattggaattggtgaaaagtattttcgaaatggaaaaaagcccgaaagtggcattccagcgaatacccacgtgttaagagtggcgtttgggcgaatcctatcttgagaatggcattatagcgaagccagtttttacgagtggtacatatgcaattttctcgcgagggaggggatcgggaatgggcgaccatgcgccgagagcctgggagtgaacgggaaggaaagcttacgcggcgccctcatgcgcttttttttggctatttttttgcgaattttttattttagaaattgaatctttcatcttcaatttcatttggaagttttgaatttgagttgaaagttttaaattttgaaatgaaagtttcaattctgagttgaaattttcaaatatagatttattttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcggcaaccccctagccttcgccgccgcgcccaccttttttctcgacgccgaggacgacgacgacgacagtgccacg

SEQ ID NO: 24824 - DNA, 7735 bp, Oryza sativa
tgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggtaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgataaattggttgtcattatgccataccgagatccatcggtgtcgaacaatagagaccacttctccttaggctcattctcaatccactgagtgaaatttctgatggacaaccctgacctccttctcattgttggtgggtcatcatgtaatgcaccaaaaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttccaatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaaggggg

SEQ ID NO: 24825 - DNA, 9763 bp, Oryza sativa
gggcagcccatcgcgcgcgctagaaacctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggcagaagtttttacccggttctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctcttcccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaaga

SEQ ID NO: 24826 - DNA, 20158 bp, Oryza sativa
ggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcattcacgacaaccgagcgccaacgacgacgatggccggcactttttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaggtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcacaaccgaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttctccgggaggtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctttccgccgccgccgccgccgccgccggcggcggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttcttctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgctttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggtgtgccatatagccaacataggtcaaaataagcaccaaaaaggaggatcatataaccgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgccgcccccgcccttccccaaccgacgccgcccaacctgatgtcggcgcagcccccgcccttccccaaccgacgacgcccaacccgacgccggcgcagctcccgtccttccctgatcgatgccgcccccgccctttctcaacagacgccggtcaacgcgacgccagcgccgctcccgcccttccccgaccgacgcctccttctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccaactacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgtctcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctcctt

SEQ ID NO: 24827 - DNA, 4499 bp, Oryza sativa
aggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgtgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggtaatacaaaaacctgcaatccctgaatttatttgaaacatatttcttatatcaactttctattgcagccttgccttggaggtgattccaaaacgctgatgtttgtcaacatttctccggaggcatcatccgttggggagacgatttgttcactgaggttcgcttcaagggtaaatgcttgcgagatcggaataccaagacggcacacacaagcccggtccttcgattccaggctgagctatggctgaagttgctgtggccatcatgatgtgatgataatcgatcagcattggggatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgttagactgtaacgcacagaaagaaatgtacgattgcaaggtttgtctaagaggattacctaacaacaacagtcaatttcttgtgtacc

SEQ ID NO: 24828 - DNA, 1468 bp, Oryza sativa
ctggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgatttttagcttggaaacaactttggaagtgatgtggtggcagaacacaccaatggaagagctatatctgcacaggctataaagaccatattgtttgtgctttgctgcactcaattggcttggcattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggctggcggtaatctcgtaccatgtgccgcgccggtcttcacccctcttttatatggtgcagtgtgactggggcccaccaaccattgg

SEQ ID NO: 24829 - DNA, 690 bp, Oryza sativa
cctctgaattcatagtggtttttttgcctcctgtgtaatttcctctggtgcctggtaaatatttttgttcacattttgtgtcaatgatgtgccgattttacattctgaaatcaacaactgtgtataattttcaagcacaaagcgacttctattctagtagtatcttcttgtatgttcgaaaaacattttgcaacttctttttaaagttcgtttgggttaaccaaagcgaacgaacttgctcatacaaaattaaacaagtcggcagctctgcttgatgcgaaattaaatgaaaattaaaccgcttgcaagttatatatatgaactcatgaattgaggttgtatgtcatggactcatggtgtatgtcaccgaggaggcggcacaattgcgcggactaggacgagcggcacagctggggaggacctcggcgcggcggctggagctgaggtagcggtggcgcagtggtggtgggcggcgccggtgtcgctgccgattctcttctcaccttctcacgctcgctagattgaaccgaggagaagaaagagtctcaggggcataatagtctgagaaaaattgaaattgatgaaaaatattttcgaaatggaagaaaacctgaagtggcatttcagcgaatacccatatattatgagtggcgtttgggcaaatcccatcttgagaatgatattatagcg

SEQ ID NO: 24830 - DNA, 574 bp, Oryza sativa
  unsure (1)..(574): unsure at all n locations
nnnnnnnnnnnnnnnnnnnnnnnnnnnnnnnnnnnnnnnnnnnnnnnnnnnnnnnnaaatattgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattac

SEQ ID NO: 24831 - DNA, 26698 bp, Oryza sativa
tgtacacgtgggttgatacgtggagggggtcagggaagctcgaccccaagcgaggcgggcctcctccctctagcttggagggggcagccgccgcgccaccccgggctcgacccccctcggggggagccacgtgggtttgggggcggcccaaccccaagctgggagggagcagccgccgcaacaccccgggctcgacccccctcggggagagccacgtgggtttgagggtggcctcctccctctagctgggtgggggtagccaccgctccaccccgggtttgatcccccctcgcggggagccacgtgggtttgagggcggcctcttccctctagacgtgatatctccgggcccatatcatcgacaatagtgtttttggttttgtattggtatatgagggatgtgcgaaaaatgaaattattttggtactgagggagtaaaatgctagtaggtcaatttggtattgagtttggattgacatgtttcctcagcccaattctcttcttcttattctactacttagttgacaacccagttctgctagcggcctacagccatctttttcattgctattgggcctacatatcacgagtacttactttacggcccagaatacggtagcccacaatctcctacagtctcaacctcagaatagtaaggcccgtcaaagattatgggcccccactacctgtcattgcgattgtaacacagtgaggcccaaaatgcagtcaatacggaggcccacgtcggacgggccacacacaccatccgtaccacactttttctcgggtttggtccccgctttttacagaaggtttagcacgtagaaataaaaacttacggcatgtttgctttgcggtcttaagttgtcacagtttgtcacgtatgattgaacaattagacaattgcttaggcagttacagttctagcaaaattccctccaaacaaacaagcctcacgcgttaatgactcagagagatatgacaagactcatggctgtgtcttatgacataaaccggatatgtaattcatttccattatctaaaaaaagagaaatatgacaagactagctacacatacatgcatattacatcattaatcatttttaaataatagaaatggattagatgtccgacatctgttataagacacacaatcacaagtttatattaaaaagagatgaaatataaaaacaaataaaaaagcttctacttatacttcacttacttataaagctcgttgattgaagtctgtgttgtagctagtttcaaatatgtagtttgttattatctcaattcttctctttcaactaagtacaaatatgtggcaactaatattagctttctttcaactattttttttccaaatttctactagcatttaagtgagaaataaactactccctccgtttcaaaatgtttgacaccgttgactttttagcacatgtttgaccgttcgtcttattaaaaaaaatgtaaaatatgtaaaactatatatatacataaaagtatatttaacaatgaatcaaataatagaaaaagaataaataattacttaaattttttgaataagacgaatggtcaaacatgtttaaaaaagtcaatggtgtcaaatattttaaaacggatggagtatgaaatagagtttaattttatacgtgtagtgagacttactgcatctctagcggtgagcacgtcgtacgtacaaaaaccgattatccaacattcatcacaaggcggcatatgcaaattacaagcatgttgcaggttgcacagggctggccgtacacttctactgctacctctgaattctcaggaccatccatgatcaaattgatcgagagacatgcaggttaatttctctgtgcccacatgtactctctgcagattcattcaggcccagacaaataatcccctttcctggtttcctccatattctcctcgataccaaaaccatccatccatgaatccatgtgagatgtgatcttggagcccccggttttggtatcctccagccgctgttagcctacagtttattgctcgagaattctggagcattcggatatcgggagtagattctgattgcatgttttgtaaatggttataattttatttaaaaaaccaacaagttacatattacattccacaaacatgcatgttaaaatttaacttctacaaattgcaacagaaaaaaagctatatgtagttaatgtatatttgtacaagttaaattcaaccttatatatatttgtatatcttgttgatttttttattttcttcatacttatttgaatgacatacaaataatgaggggatgtattagagtatagaataatgtccctacggctatcatttcagtatgcagcccatgtgtgcgtgtgtctgaaaaatcctaaataattcaggccaatttgcacacgcccagcaaacaattcaggctgctagctatagctagctagctgaccgtccaatcattgcaggatagatgccgtcgtcttcttggagagctccatgatcgagtggcagtagaatcccagtgcgagtgtcgttgatgcgagtggcagccatggtccatggttggtggagctgcctctcgagcgagcgagcttgctcactgtgcaatgtacaatgcactgtactgtgtcatagttgctgaacccagacattggcagctggtccaggttcgatcatctatatggatgcagctgcattatattcacgaccatgccacatatgtaggcacaactacataagaacttgtatggtccaatatattgagtacaaatgatttaatagtataaactactttattttttcacttaaaatttataagtttttttacacacacctgctatgtaacttatattatttaactggtaattggtcataaccaaagtacatagatttttttaaataatgattagaattgagcagcaatcgttcgactgcaatgcgtctctcatgcgcataaatgagatccagtgacggcatgagcatgtcccaattaaatcggattaactctcaaccacgaaattactcgaaagtgctttttaattttctatcctttttgcacatctatatactactagtatatagaggcagtatataccgtaaagttctctctctctttttatattgcatgaccatgcatgcgtccatgtgacatgtccagcttgccaacaaagaagctaggctactgcagtgatgctgatcgagtgatcatcgagctcacggctcacctataaataagcagctttgcctctcaccactctccacttcacttcacttcactcttcagatttcagacaaacacatacagcagcatcaccagctcagttaattgcaagcaagaataaacaagctcgatcgatcactgtgataatatggcggggaagctgtaccagctgatgtcgaggatgcacctggcgaggagccggtcgtcgtcgtcgtcggcggcgacggcggcggcggcggcggcggacgtgccgagggggcatttcgcggtgtacgtcggcgagaggcggaagcggttcgtgatcccgacggcttacctgaagcacccgtcgttcgtgctgctgctgaagcgggtggaggaggaattcggcttcgactgccaccgctgcggtggcctcaccatcccctgcgccaccgagggcgacttcgcctccttcgtcgccgaagccatcgcctccgacgaccaccaccaccactagctcgctgttaattagttaattagtagcttctagttaattagctagctatgacggctcggatttttgtgttctcttttcttgttgctgaggattaattggaatccttcttgctgatgagatcgttcgttgtactacttgtatgataacatcatttgatggaaagttgttgccaatttcgacccatgtccaagtaatttttcaagaatgtggggtcggagtccaattctccgaaccccatgtttcaacgtttgcccgaactaaatcggtgaaaaaaaaagaaaaaaacaatcagacagaatgatacggtcattaacctggatacatacatcattcctacaggatgggggaatagagtaattttcatctttcaggatgcagataatcgaatagggaacttagccctcaaataacctaatctgaaattcgcttcgacagagatttaaactcagaagcttggtatgctactcaggtcacttaccactaggctgcgtgcaatctagttggactcttctctgtacatggagaattaaacagacacagaaatccggattaatgggattatgtttcatttttttctctctcatcgtttaagaacatcatcgtttcagccatcctgaacattttgtcaggcatcgttggatctgcaagaacggaacagaaggttcagagtgaaaagaagtgttggtggggttcggagttttattctcgcgaaccccttttctcatcgtttttatgcactaagtcaatgcgaaaaattatgagaaatttttttcagaggctttttagggccaggtgtgaaaaactgctagtctgcaagaacgtagcagaaggatcaaatttcagagttaaattttggcgattcttggggaaaaaaaaacctgtagggtgggggttcggaaaatgaaactccgaacccctagtttccttgttttcccgatcgagctaaatctatgtgaaataaccatggaatggaagagacgttagagtcttagagacagggagtatagtgattttaactctctattaatacgaagatacacaaatccaatgcgttgtgatttcaacctgcaaatagccgagctggacactgcgaggaaaagagactgaaatcctgataaacatgagctgcatgcattcataaacatcactgtccagatttgcatcgtacattcagagcattggttgaaagcttaaaattgtgggggagagatagagagagagtgagacagtcctagacttggtgcccatcacagagctttcaagactgcacagagcactgaatttgctgtgctttcctggattcagacttccgtatcatttcctggtatacggacggatgaaatgaaaccggatgctaattcattatgccgcgtgcagctaaatgattatatatgtgtttcaacttgtcattttttgttacggagagacagcgggtgcactagatggtcagagtgctgttcctggagaaagaagaattcagcaacagttgcatatgaaagtagcaggccttattattttctccgtttttcccatttaaaacaggcatcatcagttaataattatgtaaaacaaaatatggtcatccgttatgtattaggtttggtacccccagcattgatcctatcctaataaaaagaagttgcagcaaaaattgcttatcagctatatgagatactttttgcaagctgtttttttggcccaaaactttacacccctggatctaaacaccttctaaacagggcctgaaactttttggagagagacagattgggacagtcctagacttggtgcccatcacagtgctctcaagacagcgcagagcactgaatttgctgtgcttttcctggattcagacttccgtatcattttctgttatacggatggatgaaaccggatgctaattgatcatgccgcgtgcaactaaatgattatatatgcttcaacttggcattttttttaaggacagacaccgagtgcactagattgtcactttgtcagagtgctgttcctgaacaaacaagaatggagcaacaatcgcatatgaaagtactaggccttgttgctttttttttcttccgtttttcccatttaagtgctcatctgaaacacatggtctgtctcatgcacaactcattgacgaaaagatagtcatcggttaattatctaaaaaaaaagatacccatcaattatgcattactgcattaggttcagtacctcagcattgatcctcttctgacaaaaaaaagatgcaccagaaattaaagatttgttgataagattgcagtttttttaaatctaccataagatgcgtttgtagtccaacggttaggataattgccttccaagcaatagacccgggttcgactcccggcaaacgcacttttttggtactgaagtttgaaaatttaaacgaaaccgcttcatcttgcaggttttcgaacttttatttgtactgaaagtttaaaaaaattaaacgaaatcgcttcatcttattgaaatttatgacttcggtgtgtactgaccaggaactgagaatgaacttttaaatacagcaacttccagcaaacgcacttttttggtactgaagtttgaaaatttaaacgaaaccgcttcatcttgcaggttttcgaacttttatttgtactgaaagtttaaaaaatttaaacgaaatcgcttcatcttactgaaatttatgacttcggtgtgtactgaccaggaactgagaatgaacttttaaatacagcaacttccagatatttctctgttacagtgttactattattgagtttgaacaacaaaacttacaaaatacggcccggcgaaaagaaaaataacttacaaaatacgagtacatgacaaattggtaagagcagacaactcatcgatcttctcattcaagtttcagactatctgaactttctgaaatcgtgtgagatagttgtgcagatgctgaagaagctcctgtacaatgtgtacattggaacaatttttcagccagcgtatgtgtaaactacaaactagtcaagcaagaggcgtcttaaacttcagcgcggtcatgcctaacttattttgaaatattggccaaaattcaactttgagcaccgccaaatcaggtcaaagactaacaaaaaaatgaacgaaaaggaatacatttcaaggggcagccttcaagctgctgctctcttaacagtatacagagtacttaataggcatcgctgcctgtcagattcagacttgcatccatgacatagaaattaagtgcttcctgttctcggttgactttttccacagtggacagaaattgtcaacttcgaactgaaacacatgcctgctgtttgattaaaactgaaacatatgcagctagctcttgaatcgaaagacaagcataggtgccgttgatgctattgttccctatccagagtcaagaactttaatggaaacacatgggatgcatattgcacataagcataagctaagtttattgttcatattaagacgtgtactttatgaactactcctacatcatcataaaaaagaacgaattaagatgccccactggttgaatatttgtttttcattcagatgtacgcatagcgtttgtagtccaacggttaggataattgccttccaagcaatagacccgggttcgactcccggcaaacgcatctttttgttagctgaatctttggcaaacgacttggatttcatctctgcattttctaatttgttaagctcgatctttggccaacaactcagactgccatctgcttgtaatctagatttcatcttaggacattctctctttagttagctgaatctttggcaaacaactcagatttcatctctgcatttcttctaatttgttaagctggatctttggacaacaactcagactgcacatctgcttgtaatctagatttcatcttaggacactctctcttttgttaagctgaatctttggccaacaattcagaattcatctctgtttttcttttgttgcatctgctctttttttttgttgctcttgtaatttatatttcatctctattgttttattctttttttggttgcacctgatattttgttgttgttgttgttcttataatttagatttcatcttaatatatatccttagctgatgcaaagaccggaagttttacttcctttgtccaacctcagtctttaacttcagtaatcgaactttgactgaaaacaaattgttcagcaagaacctcaaagtcataattcactgcacaatcatgcaacacaacctcccgatccaagatctgcttatgcagttatgcaaccccagtcatcactgagcctacatccgaacaagtctgtcagggaaatgtgccggatcatgtacttgatctcggcagcatgccgcatgttctcttgcagttgcagccatgatagattgatcgacactgtcactcatttcgcgacgagtcgccttagctgtccagcgatcgatcatgcgccgctgcaccgcacattgcgcaattctaggccacagaagagccaataccatattaccatggtcaggaagctgtgggtgccgagctggatgatatcttgatgcagcagatgtcctctgggatgtaatgtactactgtgcctgaactctgaacacctctgaagattatagccttttcagtctgaaatctgaacattttggccttcaaattcagagatttggctccattgatcctccattttcaggtcctaatgatttggtggtcaagcacatgaggatggatacccatacggccatgtctctgagtatttgtacacgagttgaattgaaattttgcacacttgggggtccatctgcatgtccacttgttgcagcagcagcatgctggctaaacaacaagcattttctcatgcagcatgccaagtgagccggttttgttgtgacgtgaacgaacggccaccaccagttcttttttttatgcaggatttatattggaatggccattgatattgatatatttttcgtgtttgtcgcgcgacgggatatgcgtcttgcgtggatttcattaaaaaagtactagtgtttctactttctgcaaaaagaaaaagaaaaatcagcaaactactgaaccctgcactgacagagaactgaaataaaaaaattctttcagaaaatgattgactgaaaaattagactatgacaatcggttagttaggtatgttatctgaaatgcaaacatcagaatttgaaaaagcaccaggacttctcacaagggatgacatgaaagctcaacaagagtccattttagcagcatatgtgggcatgctgatacaagggattataatcattaaaagtcctcatagaaatccagtctcattctagtgagaaaggaacacatcagagaaccatcatgtgacactgtctcttggtcatcagtcatcaccacgataaaccttgagaaacacttaattccatttagtcttaaccctgcactaaaacgagcactatatatacggcatcacccttgtcgacctgctgcaaaattcagaagaattcacatcgaaaattcagagtttcagagactatagtgcgcagacagacagttatcaattgccgtaactatcactgtagcaaatactgcaaggacgagttcagactgacatagtgacagtgaatctgtgatccagtgaagcttagctgcagctgtgagagagtgagctagaatgggaggtaagctgcagcatctcatggagaggcttcacctggctgggaagggcggcggcggcggcgcggcgagggacgtgccgaggggacacttcgcggtgtacgtcggcgaggctcgggcgaggttcgtggtgccgacggcgtacctgaggcagccggcgttcgtggcgctgctgaagagcgtggaggaggagtacggcttcgaccactgcggcggcggcggcctcaccatcccctgctccgagcgcgacttctccgccctcctcggccgcctcgcctcctcgccgccgccgccgtcgtggcgttgatcacgacgagctcatgacgatgacttagcacatcgatcgatgaatggctagctagccgtgttcctgttcttggtttctttcatccacggcaaacgttggaattcgtaggatttttctatttatcagtggcgtgtaagtgtaattatgcagccattggtgtgccgaatcagcgcttaattttttaagagtgaatcagcgcttatttgaaaaacattttaggacttgttcatatgaattttacatgtttttttaggaatcagttcaattcccccaaaaattctttaaaattcttacataaaaaaattaaaacattataaaacagtaatactgttccaacgaaatagctaaccatgctaacctcataatggtacctatgagtatcgtgtatggtaccatgatactagatccaataccgatattgcgcttacgtcacactaccgttaccacacataagttattatgttagaatggtacttactccatctacttttgatagagatattttcaaatatgaagaaattacttttgatagacatatttcaatccaactacctattcttttaatgactttcttgaatttaatgcgtgactctccattcgtccacactgcataggcatcgagaaatgtaaatattaatgaattgcttgtttatgtttaaataaatgataggtataattatttatccttggtcattatgccaagatgaaatataattatcaaaagtagatggagggagtatatcgttatgtatgcccctatgtagtttgccctcagtttttatttatgggccggtccatatccgacacgccggcccttttacttccctttgttttaaggcccacaaccatgtcggcccatgtgaaagccatcttcgcttttctctccgaagaaatggctctcctcttcctcttcacctccaccaccctctcgttctcctcctcctccccgcgccgccacgcgctcgcatcgcatccaccagcgcccaaaaaccctacacctgcaaaccctagccgcccgcggtaatggccggcgtcctgcggctcgccggcgccgcgcggtccccactggcccgcgcgctggcccccgccgcacggaggatgggggcgtcggcggcggcggctatggaggacgaggcgtactggaccgagtgggaggaggaggaggagaaggcgagggcgcgggagtccgcgcccgtcgcggagatgtgccccaccggcggcggcggcggtggcccgcagtgggtggtgatggggaggcccgggccgcagaagcacgcccacgccgcccgcctcgccgaggtgctcgccgtgccgtacatctccatggggacgctcgtcaggcaggagctcagcccggcgtcctctctctacaagaaggttcgcccgcatttcgctccaagccacccgcttctttatacgactcttttttttcctcgatcgatgtttctgcgcttcaatttgttgcgatttgagtttgtcccctcgattgatttggcgatcacatatttttttcgcttgattatgtcgtttcgagtcggaatcgcgccacacattttggaaggtttctttctcccagcaattttggaaacttttcttgaggcgaatctctaactctaatttgagcttttccgcgaggcttttgctcaattaatcataaagtaggctagattcctgcgtttcctggccactctttgggagtgcttctggaaatttcttgtcacatatctttggatcattacgaaatcttcgatatttgcctcatgtttttccgtaagtccgtagccacaacttttcaccagagcaagcaaatccattattttttccttattccccacgaaattggcaaaccaaacaatttccgagcgttgtttaacagcattattactctttgattcttcgatttctctggtgcttgtaaattataatggatcgcatgatgctgagagaaagggcgtgtggcggccatgtcctggtcagcgtcctcccctctgcacgaatggctgcgggggcatctccgtaatttgcttgcgtccacacgatgccatgggggcaattcggggattccacacaattagggtttcacgtcgtaaagtttggaactttcgatcttggaatctttgtggcgggcggccgccttcttttgcaggcttcccattttgccctctttgttgtaccttcgtttggctggctctcctgtagctttccctgaacagctgatagttcaggtagtattcggtagagcttctcaagttatcatcgcagacaatgccaagttgagaaccatatatggcttggttaatcagctagttgggtagagcagtttgacaagttgagaaccatttcacaagtgggcaaagatatatattctgaatggaaattttgtggctttggggatatgttatacaacaagtgtttcagggtattggaatatgctgaattgtttctgcatttgacatggacagattgcaaattcggtgaatgaagggaaacttgtgcccgaggacattatatttggattgctgacgaagcgtcttgaggagggatacaataagggtgaaactggattcatccttgatgggatcccacgcactcatatgcaggcggtaagttcctgtttgccttgtctgcttgaactaaataacaaagttctcggtatcatgtaattagcattgacattagatgtattgaatttagttatgtccaacacagttactaatttcattgatctgtctgtttttgaatgtttcaggagattctcgatgagattgtggatatcgacttggttctgaacttcaaatgtgctgataactgttttatgaagaggcggtttggtggtgacatctgcccccactgtggacagctttttgattttagcaaaactgcgtcttcagaccgtaatccgagccttgggagctgtacatggccttctcaggtgcaacatgctgcagttttaggtctggaggactcgagaatggagaagatgcgtgcttatgctgaacaggtattttcaggccacccaaacttattgggtctattactagcattgatctgatgagctttgcattgcaccatgcacccaatgaggcctgctttatgtatcacctgattgcatacctagggatggcaatgggttgggttgggttgggcacggacggagcaggaacatgcccgacccataaccgaatgggccaagggagagatggggccaaaaatcagccatagatatacaaaacttgggtcgggcatgggttacccatgggcaaaatagaaaacctggcggcacccactaaggtcttgggtcgagcgtgcccctgggcaaaaaatcgaacccatgcccatcgggcacagcgcccgcgggtacctggatccatgggcaagattgccaatttgccatctatatgcacacccctaaaaacttgcattttcagaaacaagaagtttaaactctgagaggaattgtgaggcatgatactagttcttatggagttctctagctttgttcttgtagtacagtaacatgataaactctaaatgtgaaactctcaatatgcagaccaagctactggaagactactacaggaaacagagaaaacttatggaattgaagacatcagctcgccctggagaaacatggcagggacttgtcgctgccctacatctccagcatctggatgcatccccgacgccgcacaaactcactatgtaaatatcgtttgtgtgttgtctgagaaagatcaaagaacttgagtctaaggatctagattgtgatcctagcctgcaacatatgtagtattcctatcctatgtttgtggattctgacttctgaggagtcagccggctgtcatttttgtctctctgttttcatagatataaatgtaagcgattttgcggacgcacttatatgtttgtaatgaagaatactggacttgcgagtgcaagtataccagcttgttttcctccttatcagttcttctatactgtcttgtttacatagatgatatatcgtatctcctgctttgatcttagttcttgagtattccatcagtgaagccgatgaaatcttggaagcgtctgtaagttttggaaaagaatacagtttcctgtgtaatatccatttttgctaggtcacctgggcactgagaatagttgtaaaacagagattgtggagtgactatctgcattccagtttggtagctgttcatgatgaacctctgtttctatctcaactcaaggtgttttctgattgtggactgtttgacctccagtttggactgtaggaatttcgtcagtttttgtaaaacttgcattcacatgcaagagctacacaggaaattgatgtacagtttctccatatattgtcaggcgaaaccacctccagttcagtgaatttatgattcaaatgcacacgagcatctgcaaattcaaacttctgttttgaataacaaaaaaaaaatcaaacttcctttcgaagcatatttggattcgattttgtcagatcacatctgaatctgctacaaacggcacagattacacccccccactcaaacggacggtccagatccccgcacaattaaatcgatctcgccatcaaaatctctccgcatccaaccaaacaggtcgacgcgaagaggaagccgcagcacaagaaaaccaaaccccaaccgcggcgacgcgaacggcaagcaaaacccccacacttcccggcggcggcggcggcggtgacggcggcggcgatggagacggtggagacgctggtggcgcacatccagggcctctccgggagcggggaggagctggcccacctccacaaccttctccggcaggccgacggcgagcccctgcgcgcccactccgccgccctcctccccttcctcgcccagctccacccgagcgcccactccctcggcttcctctacctcctgtgagtcccgtccccttgatgccgccgtccgcgaaaaccctaatcccgtatgctcgccgaatccaatccgtcgcgctaatctacttttcccccaccttgcggggggttgtttcgtccgtgatgcagggaggcgttcgcgtcttcggcttccaacctgagggcgcagggcggcggggacttcctggtcaccacggccgatttcctcgtctcctgctcggcggagcagatacgcttggcgcctgataagtgtgcgtgctgttcaatgatcaaatcgaatctatctaattctgtcatgcatcgattattcgttactagtactagaacattattcgtggactaaacattccacctttttttttcttcgatttgtattttgtatgtgcagttctgagtgtgtgtagggtgttcaagaatgaggtcatgcagctcaacgcgccgattagagggattgcccctctgcgggcggcaatccgcaagattcagacttcgtctgaagagctgaccccgatccatgcggattaccttctcctgtgcctgcttgcgaagcagtacaaggctggcctaagcgtcctggaagacgacatactcgaagttgatcagccaaaggacttattcctctattgctactatgggtatatggacgaatgtgctttatcctttatggttttttaatatgtaccgtttgtttacttaacggttttccttctcttgcaggggaatgatatacattgggctgaagaagttcactatagcactggattttcttcacaatgtgaggctttaaacatgttaattttgtgtttgatgtttaatggttcagtgtttacaatgttatgcatttttacaggctgttaccgtcccaatgtcatcattgaatgctattgctgttgaagcttacaagaaatacatcctagtttcgctcattcagaatgggcaggtatgttcaccacttcctgctttgcgtcctctgctgctttagtgtgtggaattgtgggacttttagggaaagcttgtttttccttagctttgaccagcgatctggtgctctctaattgatatacaccagctctggctaagataagatttgtggtaaaacatatgtgatatatggttgagaaattcagataccattgctagataaaggtgagtctatatttatggtaagcttgtgaaacaaagtataatgcatgtaatgataggaacatgtacacaggtgatgaaagataagtttagtcaacctctaattccaagctaattgggtactgtcctttttcctgtgttaatgggataataggctggatgcctaggtttgcatccgctgaattgtgatcacaatcttagtgttgccatctttaattggtccaatattttgggctctcaaatgaaaacaactacggttttgtaaatgggttaaaaattggcagcagaaaagcagtatggtacccaactcatagggatccaaatccataagcaggtggtttaaccttgatagacagagatatactactctagttagtttatcactactaaatttctgatcatgcattctcttcccacttcttgtatcaggatatttagttttcccgaaaatgtcgaatttgcacacgtgcactcagctttagcttctggtctttaatgagagctcagatctcctaaaatttgttatgttgatagatcatcctgtggtataagaactgccagttgaactgatgtggtatataatcttcataattgtattatgagctataagctggacatttctacatgtgctcatcaaaagatttattctctccaatttactggttgcccctccatagcaatgctaataggttgttatgttcaatagtttatataaaaaggaggattacaagctgagatttatgccatttaaatgacaggttccatcatttccaaagtacacatcttcaactgctcaaaggaacctcaaaaatcatgctcaggtatattcagggaatcctagtttcatctgtcccatgaaagaatgtatgcttgatagtcgcatgctgtttaatgtaatgctataagtgttagccatgccccatgctttgtctcatcgtttggtttttgatttagtggtttttgattcatttttggcatggtcaatgctttaccttctttttttgttttgctgcatagtttgttctcggtatcaagtacatttgttttactcactagaggcaatgctcacatttttatgttctacgttaccgtctatgccaccctagatataaaggctaaattttgctcttgatgcaagttcatcctttttagtgtttaactgcatacaccctttttaggttgcttctgaagtcattagtgctctgcgctgttcttttatttcaggtttatgttgacctgtcaacatgctacagcaaaggtaactactctgaattagaggagtatatccagctgaatgctgagaagtttcaatcggtgagtatttcctttgtcagttgcttgagctgccctccttactatatctatttccttatcaggaactgtacttaagttgctatctacttgacgtgctacgcattattttgttgacagttctgcatggcaaacccatttgtagatttatctgaaccacctccttcctttcctctgttttttttttctttttcaggacaacaaccttggacttgtgaagcaagtgctctcctcaatgtacaagcgaaacatccagaggttgacacagacctacttgactctttcgcttgaggatattgccagctctgttcaacttaaaaccccgaaggaggctgagatgcatgtgcttaggatggtaggtgttttttgccccatacagtctgatcacattatctgtactatcacatatttttactttttgccaatccagattgaagatggtgagatccatgcaaccataaaccagaaggatgggatggtcagctttcatgaagatcctgagcaatataaaagctgtgagatggttgagcatattgactcgtctattcaaaggtatgtgtcttctgtttaccactcttgactgctacgtatatcttgggcatgtacgcaaggtgccaagagaagagaatcaaggacccttcgtgctgctcttcagctcttggcacattgcatgtagctttcacttacaaaaatcgtatctagtacaatatgcaaccttatgattttggagaacttcactgaggtatatcatggccagagggcaaccttgtttgttttcatactcagtttctgagtttactcttagttaaattggtggcgtactggctgttttttttagataatggaaaattttacattgccggcacactaggtgcacacagcctaatttttcaaataaatctaaagaagcataacagtaaaacagaaaagagaagggaataaagcaaaagaaaagaagctaccaataacttagtcagcataactgcatatccttctaatagtgcgccacccctaagctgagttggaaattaatatgaatgaaacattaatcgtttttgagttgtatcagatgattcagtctcaaaacatatgtatgtcaggttgatggctttgtccaagaagctgtcttctattgatgagaacatctcgtgcgatcctgcatatttaatgaaggttagctcagattttcatcagaaaggtttcagctttttttttttcgttgtcactgcccactgtttcctaagtttatggatttgatgcagactggaagagagcgtggtggaagattcgattacgatgacttcgactcagttccgcacaaatatttttgagacgacctctgcattatgtgactcgaggtagtacattagtcaaactagttgttctcatgattgccagtttgatccgtacattccgcccatcaaaatttaaaccctgtaaattctggcgttaaagaatggtgcttttgaaccagagactgaatcagttggtagtttattcaatcagctatcctcttggatgcattttgctgcaattcatccatttttctgtggagttcttttcctttttgttgttgctgttcacgtggggtaaggtttggccattgcagcgaacttcatataaggccgaagctaacactaataatgatgacgtggaaattaattcacgtttgcatgatgcctcaggaaggttatgagttatgacttcacaatgtgtgcttctgtacttttgttagcatgcaattgctacagtcagataaacattttcactcaaaatatgtctaccttaagatggtctatagaaaatatttacacctttaattgcaattttaggaccttaagatggtctatattatttatatactaccatatagaaaatatttacaccttagaatgcaattaaaggatggcaatggtttgggtatagcacgggtagagtaaaaccatacccaacgccgtccgcccgaaccctacccactaaagttagcgagcaaaactttcctggcccacccgaaccctacccactaaagttaacgagcaaaactttccctgcctgttcagtgggtatacaagggatctcacataaataataactcaaaagataggtaatttaataaaaagaaataaaataaaaaaattatcaaattactagaaaaatacacgtgcgttgcaacgggtgaaggatattttaatcttattattgttgtatggtttagctaaggtgaaaattcactgtgggaattcatattctttttacaaaatcatcaaccgcaattaggggttcgatcgtctcaagttagcatgcaagtttttttaaagagacttcttatacgactcctgtatttctaaaaatgaacaaaattaaataccaactcaaacacggatctgtatttccaaaaacgattgaacttaaaaaccgattcaaacacagatgacgtatcaaaagtaccggcaaaaacatctttaatttttataatagtagagatcagttatcaacgataatttgaattacatcataactttttatatcagttaacatcacaaataataccaacgctcatgcaaatcgggtcgggtatccgcggcaaagttgccatccctttcatcttctgttataaagtcatcacgaatgtgcactcataagtcataagtcatcaccgatctcaaagcaaattaatggcgtgacccacaagtaatttttgcagtagattagattattagggcaaagttacggtgattacgcgcaaacggcaaatcgctcccaaaccctagctagctagctaaacccaaccatgacgtggcctcggctcaccgcccgcttctcgacggcgatcgccgccggtatgcgcccgccctccgccggtccattccctcgcgagaacgccatgcatcagcacgcctccgccgccgccattgacgccgtcgctgccgcggccgccgcccggatcccgcctcctgttctggcccagccgtgcggcggcggccatggcggcgcgcgagggggcctcctcctcctccgggagcagcagctcccaccatgaggccggcggaaggagaagccctctcgagctctccctgctgctcaccgccgccgccggcgcggcagtcgccgcggcggccaccccgcgagacgcgcacgcggcgtccgccggcgtcatgggcggccgccgctcgtcgtccccatcatcttactgcagaaggacgtcgtcgtcgtcgtcatcgtcgtcgtcctcttcgtcgtcgtcgtcgtcgccgtcgtcgcgggaggacgagtccgtcatctcggtgatagtcgcgggccccgtggttgtggcgtacggcgtggcttgcgttggggcttacgtggcgtgcggtgtggtttacatcgccgctcacctcctccggcccaggtcggcgaccaccgtcgttaagctccaggttagttagtctaccatatcacacccaacctagctttgaattgatgatcacgtgctaatctaattgcatctgtcacaatatgaggggaaactattttcatccctcgaggggatatcccctcattgtatgcatgtcattcaaatggttataaaaaaattgagaagatatattaacatgtgatatatcgctctacaaacatgcaagttcaaattcagcttctatatctcgcaacgaaaaaaacaaatttgactaagaatatacgttaactagttgtagtttaatttattttttcgttgcgagatgtagaagctgaatttgaacttgcatatttgtggagtaatatatcacatgttaatacattttctcaatttttttttcaaatttttgcataattatttgaatgacatgcaaataacaagagaatatctcctcgatggatgaaaatccactcccacaatatcagtactaatctaaattgtatttgtcacaattttactgatctaaaaataaatatactgtaaggatatatttaatatggattaatttgaactcatttgatgttatagatattattaatatttttttctgtaaaattgatcaaatttcaagggagttgacttaggataattcaaagtgactaaggataatagcatatgaagtgttttcattgcattggtcttgcgtgtttccttactccatcattcaagaagtgcttcatatgggttgtgtgtgaagtttgttgggttgcagttgattcgtacgtgccaaatattctccccaaatctagcacaaaatattgcatatttcgccgtttcaagttccctgtagtactaagctaacaaaaattagttattttccggtagtagagctaaaaataattgtatttgtcacaattttactgatctaaaaataaatataccataaggatatatttaaaatggattcatttgaactaatttgatgttatagagactagcaaaaatataatttcatctgttacaatttcactaatcttatattgtaattgtcacaatttcaatagtctaatttgcatttgtcacacaattggtatgtatgcatctatcgctacactaatctcgttgggggtttgcgattaaattgtctgaattttttttcaggttgcatttcgtgggctgacaaaaataatacagagggatctcaacgggattgctaggaaggtggacacttccaaccggagttgggacaagttcatgttgaccggtaatgcggtttctaaattcttgtttgcacctatatatggttaatgcatcctacgttcgtaaccagtcttttctttagctttgaattgaagtctgtcttttgtttagctttaaagtcatcagcttcagtctttcttttctttttcagttatacatttgattctatatatactgcaatttgcgattagatatacatttgatctgcaattctgatcaaatggtatatacccaattcaacttcaacagaagttagcttggggtagcatataggtatctcaagagccagaccgcagctgtgaagtggcgatatcttgaactgaactcgatttttgttcttctttcttcaatcatagctagataggtcatttatatttgacctttcatgcgcatgtgtgtgcagaacatttcaacaatcatccaacaatggtatctctgtaatctgcatatatgtctctagtagatatgtacaatttgtatcactaatacatcaactgctagcttagctttggctgtgtatatccactttggatatagaggctggattttatccattatcttaaaaaaactgctagcttagcttgtttatcattccttggtagttttgtttatgtatgttccttgctcaccatttgtacagagaccatatgctccttgaaccgtcacaaagatatctgcatctcttcaagcttatcggtaagaaatttacacaattttattactcttttggcgatatataacattcttattcctacctaattaattcttccctttgagatgacaaacctcatgtaatttgggcgtgccattttaacttaggctgacttgcaaaagagactgcttttctggggtgattgctgggagaaacattttgataaaatttctatcgaggagaggagcaagtttgatgaagaaactctatacaacgtgcaaggaatcaagatgaagaaaaaatatttgaaacccggcctcggaaaagaaaacgagtatctggtggtatgtatatataaactctccatggcttatcaaatgcatttacacatgaatttcttttgatcgaggcatgttggttacattctttaacatatatatgatcttgggatgattggacaaatcatgcagttaaccattcttcttgctgctgagggaaaattggagttccccatagtcagaagcgcttctgatctgaccacagtactgggaattctcaactctatacatgcaaacaaaattgaggtataattttcttaagtttgagcagatgcttctacagatgagattagggaacagtaatagtttgtcaaatgcttgcttactcaatcattcctaattggatttgcattggacatattgtttcagggtattcaagttttatggactccacaaaagataggtgatatccttccagaagagaggctactaaaggactatccatatcttaagcccttattgaaagaatccgattcccttggagttgccagtgtaactgaaatcgagcaatctaaccaaagatctataacggaaggccaagattcctttgcagtttctagtgtgaccgaaactatgcagtctaaccaaggatctgtaatgcaagaccaatattttattgaagttgctaatgtgactgatgttaagcagtctaaccaagaatctacaaaggaagaccaagattctaagcagtccaactaagaatctacaaaagaatgccaagattcagcaactacttgaagaatcatcggggatttgaaaagttatgtcataggtgctactctcagtaaaaaaaaaagagtcaacttctggctatgtatctggatatagcttatgtccacatatatagccataagtagacttttttttgacggagggagtatggtgtagtcacggtagcaagatctcaattcttaaagaaatgaaatactgaaaaaaaaatgacaggtgtaatgatttgaatgcattcacttatagaagcattttacgaactcattcctctttgtgaatgagaatgatttttaaatagttcacaagcatatggaaattcgccactaagtctaatatgtgagttgtaatttgtaaatttacaacagccacagatataccatgcatgtccgatagtttggtaatggcattataaaagcatattcctctgtttcatactatatataaaggacgttttgatatctattcatcatctaaattaaataacatttatataatttggacacatatatgaagcatatatatttggatttaactcggtaggatgggcattgttagaaacaacgatcggaaacgatttggtaccatgagataccggtaacttgaggtactttttgttggaccgaaacaaatctcatggaataaaagaaatcatggaataaaagaaaagaaatagtttgttggaccgaaacaaatccatgggataaaagaaaagaaatgggaggtggacggaacagtggtctgacggtataagagagaaactgactcaaatcgctcaacgatgcattttaaattgtgttttgaagtttcattatttttctgattaaggtataaattttatctcggttttcgttagcatgtttttcaaactaataaacggtgcattcatatgtaatctttctatatataagtcattttaatataaatcgagttttcaagtttataataataattaaaatttcattagtcatgtgccaatagttttcctgtagttcatggcctaactttatcttttatctaaacgcacaactaacgagtgccaaaataaagtagaatttacgattgaatctcgtgtttgtttccggctgcacatgttagggccattttggattgatttcaaaatgtgccataccaattgtttggtaatttaaatagtagtttgattggtttggattagagccaatgcattggcaatacccatacctaatttggtagtactctagaactttcttcactataaaaagcatattggtagcaaaccaaacacatattatatgaactctatcctaccaaagaattgggggttcctaggaggcgcgtgcgcgtccgctgcttaacttgcgcagccgcgccgtccccctgacgactagtccgcgcgctgccgccgctaattatgataattagtgttaattactgttattagtattatttttaaaaccgtaacaaacataaataattcagttaccaatcattttagaaaagtaattgaaagttttaaatttgtagtcaaaagattttgaaatttgagttgaaagttttaaattttgatttcaactttttaaaattttgacatagaaattttcaagttgagttgaaagtttttgaaattgaagttgaaagttttcaaaattaagtcgaaagtttcaacaattaagttgaaagtttttgaaatttgacttgaaagtttgtaatttgatttgaaagtttcgaattttgagttgaaagttttaaaattttgagatgaaaattctaaaaatgtgagttgaaaactttcaaatttgaatcgaaagttttaaaattttgagatgaaaattctaaaattgtgagttgaaaactttcaaatttgaatcgaaagttttcaaatactgagtggaaagttttcaaattctgaattgaaaaatttcaaatttgaatcaaaagttttcacatgctgagtggaaagttttcaaattctgagttgaaagtttttaaaattttcaattttaaaattaaatcttatgttaaaaagtttagttaaatgttctaatcaatgtatgtatgtatgcagtgggttttccaattacaattagcatatactactactaattgagtgtgtcactattgaatcatcgttaatcattgttgaaaagtcactaggcccagcaggctcatgtcagacatgaagctgaggcgttgccgtcgcgaaacgctcgcgacttgctgatctcgcgcgtacgcgcgaattaccaatatcgaaagagttggtagtgccaaaattaatctagatattggtactactattgaattggtaggatagagaaccaaatagacttgtagtcatcatcacgaatcttgaagcaaattatttgcttgacacacaagtaattaattttcgcgagattagctattttttgggctaatttgtcggaacaatttactggtgattacgtacgacagatcgctcttgaacaaacccttgctatctaaaccaaaccatgcagtggcctcggcttcccagccgcttcgcgacggcgatcgccgccggtctgcgccgcccttcgccgctccccctcgcgagaacgccatgccgcgcgccgccggcctcgccgtcgccgtcaccgtcgactgtattccgccgccatctcttctggcccagtcgtgcggccatggcgccgccaccaccgccgcctaccctcgcgttcgcggcgagcgagggcgcctcctcccgaagcaggggcccactgatctctctctactactgctcggcgccgccgccgccgtcgttgcggcggccacaccgcgcaccgcgcacgcggcgtccgggggcgtcatgggcggccgcgacacctccccatccccctcctcctactagtcgtcatcgtcgtcgtcgtcgtcgtcatctccgtcggtgagacactaccactactacccgccatcaccgacgaggtcatcatcgccgccgactccggcggcccataccaccagctgccctatatgtccgtacgtgctgttggccgccgccgtcggtatcactatcatctttctctgcaccttggccagcaaccagaagactaccgtcgtcaagctccaggtgagtttatcgaccatacaaaaatacccaacctagctttaaagtttaaattcaattggtttataaccttaatccctcaatattcatatttaaattttgaactggtcaccttttttgtaaattgttttataagtaaatttcacaaaactacaaatactttgatc

SEQ ID NO: 24832 - DNA, 12230 bp, Oryza sativa
gccccaaccctccatattcttcttgggccgcctaccaccacatccaattcataattggcccataaataagcagccaaagtgtctaattttaatcctgcgtatgtgatgcttttctgagtcaatttctcgacactgctcacccccgtccccttctatagttaggtgcctaatgtttttctctctctcccttctaagcaaaataataatcatcttattctgggtatgcgatatcttctcatatatttattttttaaaagatatctatcaaccattctttatgaattgattcatatttacaaattgatatgtttactagtatctttttgagagaatctattatatgccactgactttgtcacgcgtctacgattttaatatctatctttttatgtatggcgcaaaatttattactttattttaatatcatttttgtttttttgtttgccttaatttattgattatactatatgtttatatgattacaacataaatatgatatttttgcgtttagttgttcttattgagatgagcatcttcgccccatttttattttaatcctgcatccgccactgctttgatcaatctatcacaaaattacatatttaaaaaagtatattagaaaactacatattaaacaatattttttcacaaaactatagatttattaatatatcatattaattagtaaactacagatttaatatcagttttatcatataactataacttttataaactcaatagtgttatatatggatataaactctaaagtatacttggataacttcgttactaaatctgtaattttattatacgatactttattaaatctaaagtatactttgatattttgattaaattatatataattttgtgaaatttactattttatactccctctattcaaaagtctaatatctattccattctatggcttttccaaaagtcttaagttctatttgttatcactatgtgttaaattaaatggttgatcgaaacctaaaaagctatttttgtatttattggttgcatgttcattaattttgtcacatggtggatgagtattatattccttggtcttggtgccaaaagaaataggtattagactttttgaatggagggagtaaatacttaaaaatgatgtcatgatattatgttgcatcgtaagcacaagctagcgtaaagttccgtttatcgtagtctaaccaattgaaaaattattaatgttcaaagttgaataatgccggtcaactgtgaagaacgtagagcgtattaatttagaccattttgatcagtgatctaattgcatttaatttgtcccaattattgtgtatcactaatatcattgggggtttgtaaattgtcacaatattcaggtagcgttgcaggctctggcaaagacaatgcaaaaggatctcaatacgattgctgccaaggtggacactactaaaacagcgtcgctacaaattcatgttaacgggtaatataatgcgatttgttgatttctctaaaccctaaattcattcttgcagtcggctgttatacattattgattctacactgcacaatttgatacttagagtagaagagaaatttatatatgttcatgccccatttgtgcagagacgatatgttccttgaaccgtcagaaagattactggttctcttcagccttatcggtaagaaaaatatacaattttcagaacctttaatttcgagacaaacgcaacgtttttgtgttccactaatttatgaccctgtgaattaactcaccgtgttttgttatttgggtgtacatttaattttaggctgatgtgaaaaaaacagtcgacgaaatcgattcttgggaggagcattttgataagatttctattgaggagaggagcaaaactgatgaagaaactctatttaacgtggagggaatcaagataagtaaaaaatactccaaaaatcctgaaagctgcagaaaagagtacatagtggtatgcaaaattttcctaagcttgcatatatgcttacaggattttttttttctcgtcagtggttgccttggaactctatatctaattaatgatcgattgaggcatgcttttttactaagatatttgtttggggattattgtcaaatcatgcagttaaccattattcttgctgctgagggaaaactgaagtttccccaaatcagaagcgccgatgatctgcgattagtactgggaatgctcaacggtatacatgcaagtgaaattaaggtatattagcatgcatgttattcatttcatttacacgtcctcttatcttatatatatgcaccaattttttaaataaatgaaaatggtttacatatctgatttctgacaatcggcacacaaacacacaaccaatatttaaaattaaggatactgcatctcctgcaatgcaacctcattaattcttgtgagtaatcattcactctcaaattaatcatatcctaatcctaactatattggacctattgtttcagggtgttcaaattctatggactccacaagaagaggatgatgctctttcagaagagaggctactaaaggactatccatatctgaggcccctaaaacaagttttaattggagagtcaaaacaacttttacttggagagtcaaaattcaaacaaattttgtttggagagtcagaagagaagcaacttttgcttggagagccaaaagaaccgtcagtacaagaagatcctaataatactaagggataggaactttgttcttgctgttttacttgcatgcaaaaaaatgtgaattatatggagtttattagaggtggatgtcagttcgatctatgtacccactcatattcaaatctcaattaatttcatcatacctaaaataacatttttaaaagtagcagggagtacttaaaccaaacaaccttaatacaaaatcaacttaaaattttcatatacggtctatattttaaaattttaagagtaaatttcacaaaactacagatactatgaccaaattatcacaaaactacagatttaactcagtgtatcacaaaactacacatttaacaccaaatttatcacaaaactacaaatttaagatgaagtgtcacaaaactacatgtttagtaactaaattatcacaaaactacatgtttagaaccaatttagtcacaaagcaataatgtttatagctccaacataacaattgtgctataaatttaaacttcaaaagctgtagttttgtgataacttcaatattaaatatgcatttttgtgatacttaagcataaatgtgtagttttgtgataaatttggtgctaaatctttagttttgtgatacaacgccttaaatctgtagttttgtgataatttggtcaaaatacccgtagttttgtgaaatttgctcaaattttaaattagtgtgtgctcaacatgtatagcggtgggttttgtgttactaatcacagtagttagttttgtgtaatttcaaccataaaacatgggtttcgtgacatttgttctttagaaacataaacgaacaaacagattgactgctgctacttgtctgcttcttacacttctgacacatcatactgaatttacaattgaattttctggatcacggcaagaatatcttatttaagacacactaaataatttggagcagtgacaataatggtaaattgcgtctttccgaaactttaattattcaataattattaacagtgaaatttggtaatcggcaaagacatcatcggcttagaatcattatcggctgtagcatctcggaatcagccgatgggagttatcaagtcgccaatagtcggattcctgctatattcggttaaggaaatcaatctactaaaggaagcttatctctaagtgaccgagtttaaagagaatacggcatggcaatttatctattaattaggaataatttgttagtttctttttatctttaggaaagtgtgtttagtgtccaataaggactttatattttccttttatctttaggttagtttctttcttgtccgacaaggacttgtatcaacccatgggtataaatatgtacacccggggtctatgtaatctatctctatgatcaatacaattcgacgcatcgccaccctttttacttctatttttgttttttacgttctggcggaacttggcacccgacgcggggctgcatcatcttcaatctccggcgaagggataagtccaatgttccgtcggcccaagcaattgtctcatctacatcggcgttatttaaggctgcatcagtacattcgacctcttggattgctctagtttggatgatatatttgcctacatatttatcatatgtctctattaatctagtcttagcatatcaatttagctctatcggctgcttctcattttagggtttctgccgatatcggctaaatcgcgttgctagattagattagctcatacatctaccaccctaaaaatcagtcaactgcttgattgtctagatattatgtttcttttcatacttagtgctgcatcagttaaatttgatctactaagtcatgcttagaaccataatctctagcctacttcttgatgccaataagggtttcatcggggtttcagccggtgagttatctggacgttgcatcggctcataaggattgcacatacatataagttggatttcgccgatgacaacaaaggtttcactgtttaatctaatcttgtggatttcatgacatcggacctctagacaatgtgtgctttaaccttcggatcgatgcttatttatcatatcattgctagctgattggtttatactggattatattgttattttattacatcatcatcagtcgattgcctttatatcattatctacattggacatatagccgattgcttaaaccctatcgctatcggctggtatcagcatcgactattattggctaccggctagaactactccatcggcttgtcagccgatcggctgttttgatctactatttgcatatcttgtcagttgcaggatcaaactgactgacacgcccacatctcatcatatttggacctgcactggagctaagcatatctcctaggtcggggtgttcgattttttcgtcaacaataatttaatcaaatgcatattcacttaactttatgttaattttttagataatggaaataaatcatgcttcacttaaaaagagctacaaccacttattacacaaacttattcaacaaccaacacacaccatagagttcacaatacacactccgaaattaacaatactcggagcacaaaatagacaccaacacaagataaagaaaacacaattattgaatcctagttgtaaatctccacccaaagttgacgaaaatatgcatgatcgttgactcaaatttgcgatgtgcattatttattagcttgatctgagcccaaaccagaaccaatgcatataagattttgatgatgatttgtaaaaaaaaaacatattatttctattaagtcatagaagaatatataacagatgatcctacgaggataagtttctttaatacatttgaatggattaggcttcgtttaatccagtatgtattcagccttcactcgttaagccctaaaccctaaacgctctgtctctctctccttctcgaccacggcaatggcgatcgccgcgcgcctcctctccacagcgccatgccgctcgccctcgtcgtggccgctgccgccgtccaaaccctacctccgcttcccctccgcgccgctcctcctcctcctccggtcacccgccgccgcctcggtgatccatctgagtcctccgccggtaactcccctcgccgtcgcgtgtgatgatcggcacgcgctccccgactcggacgagccgcgcaaccggaacccacctgaccatcccgctccgctgctcgccgccgccgccgccgccgctgccgcggtggccagcccgcacgccgcgctcgccttgtccggtggatccatgggcgggtgctcggacacctcatcctcctattcctcctccttctcctcctcgtcgtcctccgattccttttcttcgtggtcctcgagcagcgactcatggaggtcatcgtcttcttcctcctcctctccgccgaagaagaagaaggtggtggtggtggagagcgcagatctggagactcacgaatcggtcggcacggcggcttctccgccgccgccgcctccggtggccctgaccccgtgggagaagttctggatcagcgtcgcggtggtgctcggcgtcggtgggctagtgttcggcctcatcttcctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttagattgcattgggtggtgtggctgcggcgaagtcgttccagaaggatctgaaccggattgctgagagggtgcaaggctctagccgacgttggtacaagttcatactgagcggtaatgcctattctgaatttcttgcacatcaaatctatttattctcctcgcaaaaaaaaaagaatctatttattctgaattcttgcacatcgaattctgctttggtggttccatgctaattacttaattgcagatggattatatttgacactagctagtagctttaaatataaatcgcacttaaaatgtctttaataataagacaagtagcaacaaaattaataatatttacataaatttattgaaccaagacaaatggtcaaactttgtagccaaagtcattcacgccaaatatttattatcggagggagtagtatgttagttttactgttttaaaccggaataatatcctggcttctgaatctgaagataaacaaagtcacaacgtcagtctcttatctaggttgccctctaatgagggtttcaagtgtgcaatcagctccacatataggattagttggcaacttttatggatcattaggagtaggaaggggaaatatatatttgtgcttaggccacacacggcacgcaccttgcagaaagttcagagatatatatattgagcatgtttttccatgtgtgcttatggatgtagatctgttcaagaagtactactatcaagtaatagcattttttgcagaaattaatctatttgtgcataggactcaatttagtattaaagtgatggtaaaatattcttttttgtcgggatgaccgaaggagatggtaaaatgtacctataataaggttataaaataatgttactgttaacacttcatataacttagatacttatgaccactatcaattgtccaatgtatcatggtagcttattttttatgttctggtgactcatcttatttcagataccatatcttcattgcaccgccacaaggattactgcatctctacaagcttatcagtaagaaataaaaacagttttaacattcttttggtagactgacagacatagtttgtgttcgcttctagtttctctccctcgatttgacagcctttgtatgttccgcccactgcaattacgtactgaatcgtataattttgctgaaccatttattttaggttgatataaaagacagcgactcttggaatggtcattttaagaaaatttcgttggaagaaaggggcaaatttgatgaagaaacgctttctaatttggaaggcgttaagagaaataaagaatactctacaaagatggatgggagcaaaaacgagtatatagtggtatgttagacttgttactttgtgaaatgcttcttgaaatatttgccatcgatctgctgattatgatgataaaaggacactttcttgacaaaaaaaatggcgttcttatttgtttgatgtctaatgactgatttgttctgatctccaaatcatccagttaaccattcttgttgctacggatggaacaatggatttccccaaattgatcacaaacgctgcagatctgaaagttgctttgacaaagctctactctacacccgaaacaggtcttgaggtatggggaatatttccatttgtatttcgtaaatcgtaagctagcacaactgcttcttggtatattattgaacaagctagggaaaacgcagcttgaatttactagttactcatatcacttttaccacttttctgataagtattattatctgtttgttgagtgcctaatgaattggacaaactaattttgttcagggtattcacgttttatgggcacctcaagacaaggatgatattctttcgaaggagaggatgcaaaaggattatccatatctgaagcccttgagtgtctgattagggcggccttctcttcgtgtccttggaggaaacccatacaagaagtgaagaagagcattatcatagtcccagttattttgtagttagaacttagaagaacacatacagatcattaggcaattacactattataggtctatagtctatatactcctatatactggtaattgagatcagctcattgttttggttgccagtcaggaatcagggcacctttctaagcctcaggaaatgctctgtaaatggtgatgaacttgtaatagagcacagtggtacacaagaattttcagctgattaacatgatcaaggttgattttataattccatggaactattattgtatttattaccatattttcatataaaataatctcaaaatggaggaaaataatcttagactccatactccctccgtcctaaaaaaaaccaactagctatgtatttggacatgcgtcatgtctagatgcatagttaggagttttaaggacagagtgagtatgttactccagcagctatagtgatgttgatttgagaaatttaatatgctattttttaaatatttacatatactccttccggtctgaatatttggcgttccccgacccatcgccggaggagaactcccgtgctcgccgccgacgttgctacagctgtggttggccagctccccgtgttcgcctagaccgttaccattataattgtcatattttcatgaaaaattcttaacatggaggaaaacgttccaagcttccatatgacactctaggagctagagtgatgttttatgagatacagcactcttcccttgctatactcccagattaacatgacacttttaatacttcctccttctttaataatgacggataacattgatatacttaaatattctgagtaaatttactttacaccattataaaaattagaatacaaaatgggtctgataatacaattttttttttataatataaatacagattacatgtagattaaggggctgtttagttccccaaaaactttttctaaaaacatcacatcaaatctttggacacatgtataaagcataaatatagataaaaagaaactaattgtacaatttacatgtaaatcgcaagatgaatcttttgagcctaattagtccatgattaggcataagtgctatagtaaccaacaagtgctaatgacgaattaattaggctcaaaagattcgtctcacggtttccagacgagttatgaaattagtttttgtcggagaatgaactccttcaccagggaaccgtgaggccccccctttgtgagttcggccgggggcagcgggtgagattcgagggcttggtgagcgaagctgtgtcatcttgagggggttcaatcccccaaagacaatgagacaaaatgggtttatacaggttcgggccgctaagaagcgtaataccctactcctgtgcttgattgattgagtgtacaacacaagtgcttggggttgcgagactcaagcgccagttcgctcgaaagtcctccccccctcttctcactaggcctggacctccttttatacctcaaggggttatcacatagacccaacaacctaacttcgtcaaaaattattaccatctttgcatatgcatgtcttgttccttaacttggaagccgcatacacgtcgcctcggtcgtggggcctaccaaacaatgctgcctgacacaaggggcgcccatgtcattcatcatttaatgggtgaagacttttaggctcctattacaccgggaaacaggaacctatctttgaccagagcgtgagaccgactctggctgggataagaggatgagaacctctgaccatcattatttgatgggacatgtcaggctgcacgccgcctgacacacgagcagcgcataagtgcactagccagtcacatcggtcattcgaccggttgagtacactgcacgccgtattaaatgcggagtggcgcgaccgctcaggtcgctataaatgcgggtaggtgagcacctgtaggcggacacctaacccacagtacgtggtgacctagagagggggtcgggggagcccgacccctagtcacgggagggggcggtcgccgcccgacctcgggcccaatcccccctcgggggagggccacgtggcgtttggggcagccttctccctctagtctcgaccagggagtggccgccgccgtacctcgggcccgactccccttagggaggcccacgtggcattgggaggcagcctcctccaaaaagtctttgggaaggagtggccgccaccccacctcgggcctgacttcccttgggagagggccacgtggcattggggggcagcctcctccctctaaacatgatacccccgggaccatatcaccgacagtttttcattcgtgtccgaaaaccccttccgacatccggtcaaacgttcgatgtgacatccaaaaattttcatttcaccaattaaacaagccttaaacggacaaatcttcttcagggaaaaaaaaaagaaaagagaaaaacggtcacattagagcatctccaagagtatggccaaatgccactccaagctaaattatagccaacatatgaaaaaaaaaagaccttaactctctggccaagccatcccactggccaaatcctgctagcagctggccaaatctagccagccacaaccgctggccaaacggtgggccccatgccccctccccttccatccagccggccaccgccgcccccgccgctgccgcggccgcatccggcgccgccgcccccatgcccagccgcatccttgcagatgtcggagatgcacagcagcaggcaggaggagggcgtcctcctcaccttctccgtcgccgactgcatcgcaagactgcgtactactacaaaggtgaggcagagcagcatcaggctccaagaacgattcaagatggttgagacaggaagtaaaacatgcgcagattcgaaggcgaaagtatgcgggtcttcgaagggattgattccaaccagatcaaagccaagaacatggtaaagtctgcctttcttcagaaggttttgggttttagccgattgccaagaagaaaaacatcaaaaattgcaaacaaacaaacaaagaacttcgccgtatattcttgcacagtcatgagtactcagtaatcactaatcagtgtaccttcagtgaccagcccaagaagctccaagaaccgccattgaattcttgcgcgcctgcacggattcaaggagccaaaagcctaaaagaaaaagctgcagcccggccgcatccagcgccgccgcccccgcgcccggccgcatccgccgcggccgcctccacgcctggccatgcccccacgctcggccacatccgacgcggccgcccgcagccctcccatcgtcggcgtcgctcctctctgtcttgccacgccgctgcatccgaaaagtgccaagaaaagagaaaaagggagagaaagaggaagaaggtatagcagaggctgacgtgtgggtcccagtgtcggagagtgtagttagagaggctgttgaagtgggtaatgagtttagcttgacaaatcaattggaaagctagctatataaatgctcttacatttggacacgccaaataagatgacagagaggagagagggatgccgcgtgccaagcatgagcgcgaccgcgtgggagtgggagtgtgggacccaccccttaatccccaacagctcacgccgcacaacaaaaatgaaacgaaacgaaacgaaacaaatccaccgccaccgaacggacgccatcacgccgcgcaccggacgcgccgcgccacg

SEQ ID NO: 24833 - DNA, 1261 bp, Oryza sativa
agctcggtacccgttccgctcctacgaggactacctccgccaccagctcaacaagacgctcgacccgcgcctccgccgcgtctgggccacccgcgactggcaccgcaaggtggacgccttcgcccgggccttcgccgcgctcctccgcgacgacggcggggggaagctcctctccaacgcctcccgcgcgctctgcgtcggcgcgcgcctcggccaggaggtcgcggcgctccgcctcgtcggcgtccgcgacgccgtcggcatcgacctcgccccggccccgccgctcgtcgtcaggggcgacttccacgcgcagccgttcgccaacgacaccttcgacttcgagttctccaacgtgttcgaccacgcgctctacccgggccgcttcgtcgccgagatcgagcgcacgctccgccccggcggcgtcgccgtcctgcacgtcgcggtgcaccgccgcggcgacaagtactcggccaacgatctgctcgacgtccacggcctcgtcggcctcttccgccgctccgacgtggtcaggatctccaaggtcgacgccttcggcctcgacaccgaggtcatcctccgcaagaagaggtcttcaccctaaccaccaccacatccacatgcaactctctcaattctccacacacaattcaactctccaaacagaaaaaggaacacaaattttcttccaatttccactccgatttttttgggttcgatttgttctttgcaaatgctgcaagtgtagttagttaattaggtaggcgattattttctactaggacatgcatgcatcgtaggcaacaagttactaaaaaaactgaaaatttcccggttaaaagaagtgaaagaagaaagttaaaaagattagtagtgatttggttgtcactttcccttcttttcttgatcactttcaccaattgttcttccctttctcttttatccttgtccactttacggaaagattctttgattgatttgggtgggggtgtgtgatcagtagctgtactaatcgagtatatcggcggcataactgtgtccgtgcactgcacatcagctagaataatactgtcattgacatttgcagctgagacattgatgtggatgcccgtactgttgttgaggtgtaatgtgggggatagtacgttggaaacttggaattttgcaggaatgtatggaacatgtataatctctttgctttatggataaagagagagagaaaaaaattcattttatgttcattttctgcaaggatattatt

SEQ ID NO: 24834 - DNA, 5759 bp, Oryza sativa
  unsure (1)..(5759): unsure at all n locations
nnnnnnnnnnnnnnnnnnnnnnnnnnnnnnnnnnnnnnnnnnnnnnnnnnnnnnnnnnnnntttgcaaatgctgcaagtgtagttagttaattaggtaggcgattattttctactaggacatgcatgcatcgtaggcaacaagttactaaaaaaactgaaaatttcccggttaaaagaagtgaaagaagaaagttaaaaagattagtagtgatttggttgtcactttcccttcttttcttgatcactttcaccaattgttcttccctttctcttttatccttgtccactttacggaaagattctttgattgatttgggtgggggtgtgtgatcagtagctgtactaatcgagtatatcggcggcataactgtgtccgtgcactgcacatcagctagaataatactgtcattgacatttgcagctgagacattgatgtggatgccgtagctgttgttgagttgtaatgtgggggatagtacgttggaaacttggaattttgcaggaatgtatggatcatgtatattctctttgttttatgtataaagagagagagaaaaaaatcccatcttatgttcattttctgcaaggatattattgtcacgagcacaacagggccatgaaaacgttcttgcattgcatggagtacataaatgtgagtgcttggattacccctagaaatcacctgcatttattcaaatgctaatgttttagtgccagaagttgcaatgaaagtgacaactgagagcaggtacaatagcaaactatacaatagcaaactataagtcagcaataaacacatttcgatgagataaaagaagagagagaaaatcagtggactacagatttgtagccagctgcagtacagactctaagatacatatgtatgacaggtgggaccaagtatgaattgtgtagtattccctccgtttcaaaatgtttgacaccgtttactttctagtacgtgtttaaccattcgtcttattaaaaaaattaagtaattatttattcttttcatatcatttgattcattgttaaataaactttcatgtacacatataattttacatatttcacaaatttttttaataggacgaacagtcaaatatgtgctaacaagttaactgtgtcaaatattttaaaatggagggagtatatgttatacgtaactattgtatgagttaactactaaattgactatacatgatttggagaaagtagttgcctataatattaaacttgctctgagaagagggatcttttcagtgttctgaatctttcctactgtgatgggaatgacaaaatttatcacagaaattacggcgggtattcaggtaaaggcatcagctggagcaacccttttggctcttttgggtgagagactgacaaaagagtactagaaacttgcaagagcatagtagcctagtactcctgtactgtgcatggagtgcaaattaagtcaattatttgggacagctctcttgacctgaaatgagaaaccatctttgcctaagagcaagtttaataagtttaatagtatagctcactactggctctaaatcatctatagccaatacaatagccaattcatacaatagttgcttactatactattaatatctggtcccacctgtcatacacacattacgtcttggagtccgtgctgcagctggctacagatttgtagcccgctgcttttatctctcttcctttctctatttaaaatatgtctatagctggcttatagtctactattgtaccgctctaaacgaaatttcagaaacatgcattcatcccaatactgcggttttttttttctgttcacacagaactgtacagtgtacaagaggcagggaaggaggcacatgcatgtgacaattttttaggagaactaaaaagtagttgtatggggagtggggattaactaaccacctgatcaggcggcctaattaatagcaaggccagctcagtgcatgagacaattgtcccccatacaccaagacacgatccacacagaatgtgtcacatggcctctcacacacaccaacaatttgtactaaacttcggtaaatttttgtatagctgatggatgcctgccacagagtactccactagcttagctcgtgaaactgaatttgagctccaaattcacgcgcaaaaggaatgggggaaaaatgaacgttgatttttacaaagtgttactcctgccagaatattactatcataaatttatttacgggtcacaaatttgttagaaaaaccatgcgctcatgaataatatgcacgcacaagttaactttcaccaaaaatttagtgagattaaaatcgtgctgctaattttcgtctctttaagtgtgtgttatgggacgtattcgtgtatgtgtaaacgtggtattgtgtgtgtagttgtgtgtacgcatattcatttaggccccctttgattcaaaggaaattcataggaattttaaaggatttaattcctataggaattttttctatatagcgctttgaatcaaaggaataaatcctatggaatcctataaaattcctatggaatgcctcttcccatgcaaattttgaaggaaatttaacatgaggttctacctcatgttaagaatcctttgagtctttctctctcctcaaattcctgtgtttttcctgcggctcaatcaaacggtcattcctatgtttttcctgtgttttgcaatcctctgttttacacttgtattcctatcagaatcctatgtttttcctattcccccgtttttttattcctgtgattcaaagggggccttatcgtataatcgagaaaaaaatataaacaaagtactacctaaaaaattatcgaacagagtgggtaaggccttgtttagttaccaaatttttttctcaaaaacgtcacatcgaatctttgtacacatgcattgagtattaaatatagataaaataaaaaactaattacacagtttatatgtaaatcacgagacgaaacttttaagcctattttgtccatgattagccataagtactacagtaacccacatgtgctaatgatggattaatgtagacccccgtttttataacaggaatcaatcgtgtaaacagtaccatttccctggatcaagtagtctggtacacacgaattcatagctgaaataccaagtgcacatacacgagtgtctaatacgaattattacatcataagcccgtaggcatagtcttaaatcatcggaccgagcggtccggaatacatccaaaagcagaaatagataaggcagcggaattcaggcagcggcatgccattgccacaggcaacgaccatactaagacctactgagtgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaagcaagttttgcaattcttttcacaagcctaagacctagcatagactgatcaagtttttaataccagtgttcatattaaacaatgacggttctgtccaccatccattgtgatcccaaggatagcttcccgtcattgagtcgttatggttttctgaggacgtccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagattcggtttactcacactgcagtggatgtacactttacccgcactccgcgactgcccaacacatgagcctcatcccaacacatgagacgcgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatgtagggcacgccttttgggcctacctcaacggctgtcccatcgtaacgcacctgcctcactcaggggtgaaccatctatgcagggatactgcctccgctcggctatctaatctgttaggtctatacccattcgagaagtacggttgtacgggggtcgtttcatgcttaacttcatggctcggtccttaattaactggggacggtactagccttttccagataccacccaaatcctccatccgccccagtcgaaaacagttgttttaattttatttctcctttcacaaatcatgtcatcaacatcatggtaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaatatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcaaaaattgatttgaattcgattagaattcaaataaaaatccaaataaatccaaatggaagtcgaacgcgaaagtcgattcttttatattaactttactattcgcgtactagggcaaacccaatttcgattcaaactattttgcgggtataaatgttttgttctcacaagtttttaatttaatctacccgagcattatatccatataataggttagaaatttctatcgcgagctaaatatcggacggaatcctagaattattatacgatttaatttagtctatgactaaataattaaatataatacacgggtaaaattcctagtaattaaatccgaatttctaccgtgaaccgatgacttatagagattaccaaaaataatctataataatctataagaattcatctaattgtttagttattaattatatctaaattactaccaattttaatctaatttgatcaagaaacatatttttataattaactcggaatttcgaccgaaatactattacgctcgaggaatttccaaaaataatctatgattaaccccgaccatttttatttcctaaatcctcctaatttctcccccaatttcccttctattttctccttttcttcttttctattttccctctttttctctccctctctttctttttctctcttttctctccctctctttctcggctctatcccacccgagcggcggcggtggacgcaaggggaaaggagggcggctcaccggcggcggcagcggcgacgacggcggcggcgacggtggcgcacggcggcgcgggagcggcgacacggcggcacgggaacggcggcgcggaaacggcggcacggcggcacgagagcgacggcgcggcggcacgggaacggcggctcggtggcacgagagcggcggcgcagtggagagggaagaggggaggaagggtgagatggggtgggggaaaa

SEQ ID NO: 24835 - DNA, 513 bp, Oryza sativa
tatagggcgaattcgagctcggtaccccttcgtattaatagagagttaaaatcactatactccctgtctctaagactctaacgtctcttccattccatggttatttcacatagatttagctcgatcgggaaaacacgaaactaggggttcggagtttcattttccgaacccccaccctacaggtttttttttccccaagaatcgccaaaatttaactctgaaatttgatccttctgctacgttcttgcagactagcagtttttcacacctggccctaaaaagcctctgaaaaaaatttctcataatttttcgcattgacttagtgcataaaaacgatgagaaaaggggttcgcgagaataaaactccgaaccccaccaacacttcttttcactctgaaccttctgttccgttcttgcagatccaacgatgcctgacaaaatgttcaggatggctgaaacgatgatgttcttaaacgatgagagagaaaaaaatgaaacataatcccagttaat

SEQ ID NO: 24836 - DNA, 617 bp, Oryza sativa
  unsure (1)..(617): unsure at all n locations
ctatgggaagatatgtgttaaaagcatactgacaatatcttgcaccttatcaagaacactagttaatcccaagatatacctgtttcctatacatgacacatcatacatcagttcagacaaacatgtgctttttgaaaagcaacattgatcaactggctgaataagacgtatgatggatcagcaggaaacatagtaggaagtatgaaaatgttcttgttatagataagatgacaaatgaatctgcctcccaaccaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcgnnnnnnnnnnnnnnnnnnnnnnnnnnnnnnnnnnnnnnnnnnnnnnnnnnnnn

SEQ ID NO: 24837 - DNA, 416 bp, Oryza sativa
cgccatcccgtcgccgcgtgcgcgttccatcgccgcctcgagccgtgccggtgccgcgccgcgcgccgtcccatcgcctcgcgccgttgccatgtgccgcgccgccttacgccccgagccgcgccgcgccgtcgtcatctccgcccgcgcgccgcgcgccgtcacattgccgccgtgcgccgccgtcccattgccgctgccgcaccgcgttgccgtcgcgtcctgtcgcccttgagccccgcgccgtcccgtcatcgccccgcctgtcacgccgctcccacgccacccgtcgcgtcgcccgtctcgagccccgcaccgccgcccgtcgcatcgccgctccgagccccgcgccgccatagcgtcgccgcccgcgtgtcgccatcgtcccgtccagagcgccgccgtcgcgtcacgcc

SEQ ID NO: 24838 - DNA, 579 bp, Oryza sativa
ttttattaaattctgaaatgtttgctaaatgctgtttatgcaaatggaaccctattatgccatcctttggtatccttgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttatcttattttccgttgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacaggcgagcccaactccaccgttcaaccacgaagccaccgcacgccccctttgtcaaggggtgggcaaggcgggagccggcccacggagaggactacccaagccttgatcactcggggtagttctttcttcactccgaggtggtgaa

SEQ ID NO: 24839 - DNA, 693 bp, Oryza sativa
  unsure (1)..(693): unsure at all n locations
agctcggtaccccatttaaagcggtctatgcaaccgcatcatgtcacatttaatgcggcgtgctgcgcatttgaccggtctgtgaccggttgaatgaccgatgggacggcgactgtgtacccccgtcctgtcagtgtgtcaggcggtgagcggcgtgctccgtcccgtcccatcataatgatgaggggctttacagcctcttaccccagtcagagctggtccaaccactctgaactgacccgggttcccgttttctggtgtgaacgagaacctggaagttctcatccattaaatgacgaatgacaagggcgccatgcatgatttgatgggccccgcgtagcaaccgacgtgcagatagcttctaggctaaggcagaagacatgtaattaatatagagaatattttcccttctccctaggtagcactcgcagcacatgtagtatcctcttagagtataaaaggaggaccatgcctagcgaggaggggggatcggactgaggatccctgagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24840 - DNA, 528 bp, Oryza sativa
ggccacgtggcgtttggggcagccctctccctctaatctcgaccagggagtggccggcggccttacctcggcacgactccccttaaggaaggccacgttgcattgggaggcaacctcctccgactagtcttttggaaagagtggccgccaccccacctcgggcatgacttccttgggaaagggccacgtggcattggggggcagcctcctccctctaaacatgatacccccgggaccatatcaccgacagtttttcattcgtgtccgaaaaccccttccgacatccggtcaaacgttagatgtgacatccaaaaattttcatttcaccaattaaacaagccttaaacggacaaatcttcttcagggaaaaaaaaaagaaaagagaaaaacggtcacattagagcatctccaagagtattgccaaatgccactccaagctaaattatagcccacatatgaaaaaaaaaagaccttaactctctggccaagccatcccactggccaaatcctgctagcagctggccaaat

SEQ ID NO: 24841 - DNA, 603 bp, Oryza sativa
tccagacctgtgatgacatcagacagcctctgagctactgcagagactttcctatacctatggaccacttgatcggtgacattctcaaaatatatccaaaatctgactatttctcaccacccccagcactggcatgtgccccaggccaccacctcctctccccacagggctccccgctgctgctgcggcccctaccaggctattctccacatggtagccaaagtgaacttctatgaacttctacaaacagatcatgcaactcctgccccagaaacccccaagccttctcttcccactctgtgaaatggccaaagcctttaccacatggatgaagtcctctaagacctgggcctggccgacttcactgacctcaccttgcaccactcccattgcctggaagcccctcaaagacacagagcacactcccttccgtgggatttgcacttgaagttccctctgcctggaacttgcctgtcttcctcctttgcttacttcagggctctgctcacatgtcatgctattatcaaggacgtgcctgacaccctgtatgacagcactgtcctgcagaaccatctatgatatggaaatgcgttataacctgag

SEQ ID NO: 24842 - DNA, 662 bp, Oryza sativa
  unsure (1)..(662): unsure at all n locations
attgtgatcccattactatgggcgaattcnagctcggtacccattaaaaggttggttgaaattgaaacgatgtgatgaaaaaattgaaattttatgtgtaaaaaagttttcacgggataagaaaattggagggttaaaaaaaagtttggaactaaactcggccaaacgaactttcgctagcttaaaacgaaagcttcctgagatttttcatgcacggtatagtgtccctttctagcctgtagaattttggatgctctggttgaacgtgcaccgactgttgctgttacagtgagatggattggatccctcagctacctatgaatccctgatcctctctgatcaatgagagatgcatatgattgagagccttttttccagacatcatcctgttcctggttggtgcatccgtaccaggggtggggtgccactgccatggtgttcatctctcattgtntntcccctgggnganannnaanacatccccccccccagagtttgagaggacgggggggttagntgcccagtcttggggggggggggggaaaaccctttttaagnttttnnnnnnttttttgttcccaaannnaaagaggagaggggggaaaagaatttntnnaatttnnccannnaaaggannnncgggggggtgccatgaaaaaaat

SEQ ID NO: 24843 - DNA, 676 bp, Oryza sativa
  unsure (1)..(676): unsure at all n locations
cgtgtgtgtnnnagtgagtaatcgcatctttataaggcgaattcnagctcggtacccgtattggtgacgttgcttacaatctgcttaaaattccttaaacttagattgggacagtacgtaaggtttggttgatttctgggtgggtggtactgtctcgatcgatataggttttaccaggtacttatgtcgaacgaacgggtacgaccacagtttctagaatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagatgtccaatttnttataaggganaaanaancaaagacacacccctgagtttacagatattcacataaaaaatantttaccgcatagaaagggtcttggaattctaattcatgttgctcattnncagtttccnccnnnnccnttggtggggggggggggggtggtggatttttttnaaggtgtaagataaaanaaaaaataaattggacagaanacgc

SEQ ID NO: 24844 - DNA, 669 bp, Oryza sativa
  unsure (1)..(669): unsure at all n locations
atgtagtatcgactcttttataaggcgaattcnagctcggtaccctgtctatgactacgaggacaagatcaacttcgcagtgttcccgtcactgcaaggtggtcctcacaaccaccagattgcagcccttgcgggggctctgcagcaaaccatgacacctggattcaaggcctacgcaaagcaagtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaaaatgtgtgacctttgcagcattacacttaacaanaatgntaacgggagggnnncaggggggagggaagaggaggggnnnnagggggtaggttagggacnccnnnnnnnnnagaannnaggnaatgaaggggagggaagttgctgccatnnccntnccctcnnnnctaagaggggnaagggnaaagagagaaaaaaaaaaaacaaaaaaacgatgtgtttcgattgtatacccnaaaaaaaaaagtcgtatgtgaaact

SEQ ID NO: 24845 - DNA, 681 bp, Oryza sativa
  unsure (1)..(681): unsure at all n locations
gtgtgtatnnagatagtaatcacatatctatataccgcaatacacctccttaccctgagcgagggagcttgggaccatttctatgtacccatctgataatactggtcaagtgtttcctaattaaacctagcacctcangtgcgtgaattgattctaggtctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctcatattatnaaataaggncnnaatanaagggagggaggggatgtggccnnnnnnccagtaatttgtgtaagttggtttttttttgcctaccttnnnttgatncgatggcatgtggtccaatttaaattcgatatggnagcaaagaaatatgtnnaatttnnaaccgttataaaaacaaaaaaaaatattctgttaaataattttgtttgggtgtaaataaacaccataaaaaag

SEQ ID NO: 24846 - DNA, 363 bp, Oryza sativa
  unsure (1)..(363): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcttgtgctggatggcgaggtccatcgcgcgggacagcgcctcgtcgcggcggccgttgcggtggagcctgagcgcggcctcggcctccgcacggatgaggtcgtcgtcgaggtcaggcgccattgccggagacggtggggggagnnnnnnnnnnnnnnnnnnnnnnnnnnnnnnnnn

SEQ ID NO: 24847 - DNA, 555 bp, Oryza sativa
  unsure (1)..(555): unsure at all n locations
agtgagtatcggcatttttatanggcgaattcnagctcngtacccactagaagacgctgggaacctcttctcgtgcgggtcgcccaacggcagcgtcagtttttattggtgttgagggaccaacctaaaccgggcctcggtcttnncctgggtgatgtggtggatcgtgagggaaacatanacgaaacccggacacgtcctcccgtttggggagcanaggatgctccaggtgtggccggccaccttgaactttgaggactcgacgaagttgcccaccatccgtgcatgttagcgatccccgtgtaaccgtcgatcttgagcatatggcatccggtggtcgccgtggtgctgaccgtctacacggtgacatcctcctccgttggcaccatgagatccatggcacctgggtcgtcacaannnntnggtagggggaggntaggagaggaggggggtgagnccccagggggggatggggggtgggggnncntgaggnggagggggggggggggggggggggcggccggcctgggcttgtgnnnttttttgtttttcttc

SEQ ID NO: 24848 - DNA, 567 bp, Oryza sativa
  unsure (1)..(567): unsure at all n locations
cggtgtatanatagtagagcaccctattactataggccgaattcnagctcggtaccccaatcaacctcaattaaagaaaaaggatccagaaggagaagacgtttggcttattccccagttgagctgcctgtgggagtggagctgaagccatcgctagactgttattccgctgctgttttcttttcttttgtaagtatgtaacgttattattatgatggatttgtatattaaattatcagtttgtgtacctcggctgattcctggacgaggattttatgcacaaattagttcggaaattntnagtgaatttccgggcgtggcacctcctcttctatcgcctctgtcctggcgggcttcttcctcctctatctccccatctcccctctcttcatctctctcccctctcctttctcttatgggggtgtgnnngtgaggggggggaaggnagggggaggggggggggggagccccagggggaagggagagggggagagccntgggggggggggggtgggggtggtgtgaagtaagncgtgaggggaggnnaaggtgttggccaccttcctt

SEQ ID NO: 24849 - DNA, 556 bp, Oryza sativa
  unsure (1)..(556): unsure at all n locations
tttttgtatgcacattactatagcgcgaattcgagctcggtaccctccttgagaagaggtgaatttaaactatgaatttggaaaggtttcactatggtctggagtatagcaaatccttactaatattagggggaagtaaggaaataatctagagagtgaaatttgagagaatttgctcaaatttagtaaggttcggaataaagggtataattagggtaaattagtagggttctaaagaagtaatacttgaaccacttaggaatcaaatagatttttaaaacacactaaattaatcaaaagccagcatgatgcagtcaaattttagttttaaaatttgaggatgttacaatgtccttacggaatgtacgcataccagcggatgtcgttcggttgtgtaatgcacccgtgtcgttccaacggtgtatgatgtctatcttctccgacatgattgangaaaaggggaaggggggggggggtggctnnnccgncgggggggagggggggggggaatgttttnaanaagggctncaagggggggcagcggggtcatgaaaaa

SEQ ID NO: 24850 - DNA, 655 bp, Oryza sativa
  unsure (1)..(655): unsure at all n locations
agtgagagcacatattgactatanggcgaattcgagctcggtacccagtctgccgcaaatctcgatatttcccccggaggatcgttcgcacacaagacaactgcctaatgaagagaactcttagatttgagcggagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcgaaaagaaggctcatcccaagaatgagccgttcgaggaggtgatgtttgtatcttcgttcgtttcttctggacctatttcccatcttcatgaaactgaacgaatagnntnaccctaaggggagaggggggagagggttncccgcagggggttggatatccntnaatattttatttattatttctgggtaggtggatactatacntatttaatactggtggttccgtacttcnnncctcnnaagcggtcggtggggagttgggtataggncgcgtttgggnannanacncnaaggggggggggagtga

SEQ ID NO: 24851 - DNA, 644 bp, Oryza sativa
  unsure (1)..(644): unsure at all n locations
ttttagagtcgcactatccactatangccgaattcgagctcggtaccccacccaccccaccaatccccaccagatccaacggcccagatctccccctcacctttatccaacgcctccccttcgtcttctccctggagtagtaccccacctcaccccgagccttccactcccccttctnctcctcctcccttctttttacccacccaccctttngnccncgcaaaacccatccaagaagagcttccccccgccacttccattgcgcttctccctgaaaaaacctctctcggcaaggaatacaaagtgaaagacctcttccaagccgacttccgccccctccaaaaccaacttccccaaggtccaaagcccgggcctcattgcgttccccccccaatttcgccccttccaacccttccaaaatattggaagtaaaggaacggncccctcccttcccacccnnanccttacgagagaggaaagatccnccccccaagagaaaagaagctttttaaattntnntncccccnaacccccatntaaanctagtagnaaagaataagatatatttttagtnnnnnnngggacgctgttgtttgtatttgtataaaaaaaaattaaaaaattaaaannccccctctgaccta

SEQ ID NO: 24852 - DNA, 670 bp, Oryza sativa
  unsure (1)..(670): unsure at all n locations
gctgtttnnttttttgagtcaccgatccactataggccgaatncgagctcggtacccagtgcgcagcataaataaactattttactactgttaggtgatatggcagtgtaaatagatatgtaccatatatctagaaaataggagtaagattgattctactacccattagagactgctaccaaaattgttaattttcttatatttctcatgtaaagcattcagacatattttcagtaatttatacggttcagtttctcttagggcgttcacagtgggaggatgtgtcgttcagccttggtgccgaaaaccgaatattcgacgacacgtcagccaaccgcggagccaaaactggtcacacgaacttcgctggaatcgaggtatgcggcacggggagaaaagcgggggcgcggcgttttggaagtcaatccctcgtcgctccgtggtttcncccncttncatnntttagtgtggnnnatggtgcgggaggggggtggaggnnnnnnagtggggcgggggggaaaaannnnnnnnnantagtntnnnttgagggagggagatggtcnnnncacncnnnnnncccnccccnnnnaaaggggnaaggaaaatgaggggggggggctttttctnnntctttctttcttttccttttttcttgtgggggagaaaaatt

SEQ ID NO: 24853 - DNA, 679 bp, Oryza sativa
  unsure (1)..(679): unsure at all n locations
tttgtgggatagtannnnnnnnnnnnnnnnnnnnnnnnnnnnnnnnnnnnnnnnncgcacccgggcgccgacgccggccatcttccgcgccagctgcgcgaacgggctgatgtggccgaacgccaagaacgggaacgtgaccgcgtgcaggtctccgtctgcaccgccgccgccggccgncgtngccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctggtcctacctaaccgctcggacattnttgctgttcttttttttttacttactagcaaaaatgcccgtacattttgaaaggggggaaggaggagggnnnaagcgggggggggggggggggggnccccccggggggtgggggaattttggagaaanctnaannttaacctgctaagtgaggggctaanntttctaanaattttacaaccttcnnccnnagtacggggtngnnnnnnnnaaggagggggggggtggggcggggtannancnnntttataattttaatagaaanccaggagggagggaaaga

SEQ ID NO: 24854 - DNA, 508 bp, Oryza sativa
  unsure (1)..(508): unsure at all n locations
tttgtggagtagcnnnnnnnnnnnnnnnnnnnnnnnnnnnnnnnnnnnnnnnnnagttttgtcatgtcctgctcattcactaaccaggtaaaatatgatgacctttatctattgtctcactaaacatgctnagtatagctgtgagttacatgattgaatcaattctgtgcttgttgcaggtcattgctcagcttgagctgtggaaagagaaaagcactggcaagtacgagaagaaggtgtacgttcttcccaagcacctcgacgagaaggtggccgccctccacttgggcaagcttggtgccaagctgaccaagctctccaagtcgcaggctgactacatcagcgttccagttgagggtccctacaagcccgcgcactaccggtactaggctgcccagcacgactaacggctgtggcatgagaagtgtcaacttgaagttcgccatgacgactcttgagtatagnnnaaggggagaaggaggaaagagncnagnaagggagaggtgat

SEQ ID NO: 24855 - DNA, 576 bp, Oryza sativa
  unsure (1)..(576): unsure at all n locations
tttgtgnatagaannnnnnnnnnnnnnnnnnnnnnnnnnnnnnnnnnnnnnnnnagccttcggtctcttatccccggtcacgtgcgctcggcccaagtcagcccaggccaagccgcccctcctcctctctctcagccgccgacatatggggcccacatggcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgctgggaggggaggggggggggcttgnagaggggggggganatttnaaggggaggcgtgggaagggnttttcagtaaaggatgatgaaggcaaaatgagggccggtc

SEQ ID NO: 24856 - DNA, 1208 bp, Oryza sativa
ggcaaagcttttcgataacctcgcattggcagtacccgctccatgaacttaaatcctcatgcactctaggcgtccatgtttctagcagtgagaggagttctggcgctcccgggaaaaaagaagtctcacacgcatattaaattatggttcaagttaagttctctctctcacacactcatggcagtcctaccaatggcaacaccgatgtagggcacgcctctcggccctacctcaacggctgtcccatcgtaacgcacctgcctcactcaggggtgaaccatctatgcagggatactgcctccgctcggctatctaatctgttaggtctatacccattcgagaagtacggttgtacgggggtcgtttcatgcttaacttcatggctcggtccttaattaactggggacggtactagccttttccagataccacccaaatcctccatccgccccagtcgaaaacagttgttttaattttatttctcctttcacaaatcatgtcatcaacatcatggtaatgtggcgctcatgtctccacatgccgcatctcaattaccttcccgaaggtaattgcccaagcatatagcatttgataaatatgagtatgcatgattctagaatagcatttctaagcaattgtcatagttgaatagagactcatacgtaaacatggttacaaagatttaagggttaacaataatcaaggcatggcataatcacaagtgggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcaggcgctatagttacgtgcaaaaattgatttgaattcggttagaattcaaataaaaatccaaataaattcaaatgaaagtcgaatgcgaaagtcgattattcgcgaactaaggcaaacccaatttcgagttttaatatcctaaactattttgcgggtataaatattttgttgtcctaagtttttaatttaatctacccgagcattatatccatataataggttagaaatttctatcgcgagctaaatgtcggacgaaatcctagaaatattatacgatttaatttagtctatgactaaatgattaaatataacacatggctaaaatccctagtaattaaatccg

SEQ ID NO: 24857 - DNA, 767 bp, Oryza sativa
gggcgaattcgagctcggtaccccaccattctcattaattaacttgtataaccatttactcaagagacatttcttttgaatctctaaattatgaacacccaaatcgccctggtctttgggttgacaaattatatctcatctagttaatctttacttttttcttatgatcatccccttgccaaaagaaacgtgatctaaaataattaatcttttgaagaacccctttcggtatctaaaagaatgatattataaacatagctaaacttgaaaggactgaattgatcaaaaccaatctacccccgacagacaaaagtttacctttccaactactaagttttttttctcaattctttgctcaataactttccaatctttgttactcaacttcctaaaatgcattgaaatcccaagatatttaaaaagaaaaaaccccagcttacaacgaaaaatactagaatatcgatcataacactcatttgcctggccaaaacaaaataactcaattttatgaaagttaattttcaagccagataaattctcaaacacaaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattgggtaccgagctcgaattcgccctatagtag

SEQ ID NO: 24858 - DNA, 757 bp, Oryza sativa
aattactatagggcgaattcgagctcggtaccctgagcgattgatcttgggaccatttctatgtacccatctgataatactggtcaagtgttccctaattaaacctagcacctcaggtccatgaattgattctagttctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtcttccatcatttaaccattggagctagcttttataatttcaagcctcacttgcaatctacaatattcacatgatttcattaacccaacctataatttatttctgtaattagttgagaaattttcta

SEQ ID NO: 24859 - DNA, 684 bp, Oryza sativa
atagggcgaattcgagctcggtaccccctcatttgagtaattgtagttgattgcataatcctattatttttagtttttctccttttctttttattactattattttggtctatactggctctatacacttcagtccttcacgctgtttttcttcccttttcttttgaacgaacatgcttaccgctgcgtgaagaggccatgcaccagtactgcggactgcggtacatattgcagaaaaggccgtggggcgccagggccaggcccaggcccaaggtcgcacagtctagctagatgcaaagcccatcccgcacacgcacgcaggcaaacgtttacgttttttttcccgatctctttcgatgcgaatacttcacccatcacacatggcagtttttgagtgagctctaactaaatttgtagggtgccacgcgcctaatgaaaaacaagagcctagacccagaaatcggtatcagagatttactttcattgcagtgattttgttgcagctagcgttcgcattttttggttgtgcagctagaagcacctaaactagccacccagtcccgctttgcgcgaccctgagcgctggcataaccagcatataggagttgacgactgatcttgatattacaggataatttttgtgagactattctctctggtttcaaatataaggatttttatatt

SEQ ID NO: 24860 - DNA, 702 bp, Oryza sativa
gtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacatgacggtctgaaggtctgactcgtagtcaacaacagggtagccttcctcctcgagttcgtgcccggcgagatcagagacagcgcaatgtctttcctatcagtatccagagacaccgtaggggactagccgtgcctatccctgaagtcgatatccggcgtcttgtcttggcgtatgttggcttctgttgttttgtagattgtggtgggtgttgaatgtccatgttgatcgtccccccctcctagggggccttatatttatacccataggtgtccccctgtttaagtaaaattagggaaaccaatatggaaacaatccgagtagtccttgtagtttacatgtagaactctggttgtctttccttatcgggaactcctcctatattcgcaggttatttccgtatagaacatggtatgtggtgggtcctgccgagatttagtcaactactattaggtatgtggtatccataatcctgaca

SEQ ID NO: 24861 - DNA, 309 bp, Oryza sativa
catctcacccttcctcccctctcccctctccactgcgccgccgttcccgtgccgccgcgccgccgttcccgtgccgccgcgccgccgttcccgtgccgccgcgccgccgttcccgcgctgccgtgccgtcgctcctgtgccaccgtgccgccgcttctgtgccgccgtacgccaccgtcgccaccgccgtcgtcgccgctgccgccgtcggtgagccgccctccttccccctcgcgtccaccgccgccaccgctcgggtaggagggagagccgagagagagagaggaaaagagagccgtgagagagagg

SEQ ID NO: 24862 - DNA, 768 bp, Oryza sativa
  unsure (1)..(768): unsure at all n locations
gtgagaatcgacnnnnnnnnnnnnnnnnnnnnnnnnnnnnnnagtagaataccctcgtgaacctcttctcgtgcggctcgcccaacggcagcgtcagcccgtattggtgttgagggaccaggctaaaccggacctcgggctgggcctgggtgatgtggtggagcgtgagggaaacatagacgaaacccggacacgtcctcccgtttgggtagcagaggatgctccaggtgtggccggccaccttgaacttggaggactcgacgaagttgcccaccatccgtgcatgttggcgatccgcgtgtagccgtcgatcttgagcatatggcatccggtggtcgccgtggtgctgaccgtcgacacggtgacatccttcttcgttggcgccatgagatcgatggcacctgggtcgtcagacaacatacggtggtgttcgatttgtttgtaaagtacgttggtagggttcagttaattaaatatatggagaagttaaggtagatgtcggcctgtagttcgtctcggataagagccattttttgggactgaataagtattactactacatgttggatatcacggatcgttgcaaactcttcaagtctctgtccggttcgtaaacgaacaagggggagatattactgatttcttaaggtgctatgaaaagctagtaaaaactaatgtgttaatgaaaaaaacggatgaatatgaaaaacataatattctgataggaatgtaagtataaaatagaggattgcacaacacacggaaaac

SEQ ID NO: 24863 - DNA, 729 bp, Oryza sativa
  unsure (1)..(729): unsure at all n locations
nnnnnnnnnnnnnnnnnnnnnnnnnnnnnnnnnnaaagacaacatatatatgctgcatttgctggaaaaactaacaatggaaccctaagaaaaaaatgttacttcctccgtttcatattataagactttctagcattgtctatattcatatatatattaatgaatctagaaatatatatatatgcgcctggattcattaacatctatatgaatgtggacaatgctagaaagtcttataacctgaaacagaggtagtacaactgaagttacagcaatgtttaatgtgaaaagggctagagtgcaagctatttggcgaagagtgaagcaatgtcttgcccacggaataccaatcgatgtaaggtctatgaaaaaaaagaattgtgggtgcaaaaagaatgaaatcaacatgacagatgttgctaatgttcccttgcaactaaggggcactttacggtcatttgcatcagcctctggtataccaaagagcatgttgcatatgatgttgaaaggagtgctgctaagatgtcactcaaacccacttaagccatttgtgaaggaagagaataaaccatcaaggctggggtggtgtctttccatgttagattggcatactttgccaatgaacccaagttcattgatatgcgaaacactgtacacatagataaaaaaggttcaatccacttaaaggacaggaccctttacatgggccatggggaggatgaccataca

SEQ ID NO: 24864 - DNA, 778 bp, Oryza sativa
  unsure (1)..(778): unsure at all n locations
nnnnnnnnnnnnnnnnnnnnnnnnnnnnnnnnnnnatctgactgaaccaaccaaccaaatgagagagacatgctttgccagtagaaaggaaaagaggagaaaaactgagccgtcagagcagaatccaccaaccccccatggtgtgcatgcctgaactaatggcgacttaatttggtggtagctcagctagctgcaaccaggttgactgatctgcagatcttgccaaccaatactatacttgatggcaactaatttctactaattagtaaagtgagagtgagtgagttagtgagaggagcaaggaaagatggacgatggatggcaagggaaaatggaagaatatatataatatcattgccgacgacatgctttctacgcgtgatctcatcgatcgatcggtcggtcagtcggtgggccgagcaaaatgatcgagttgatgtgtgcctgcctgcctccgcctccatgtggtcggtggttaatttgggatcagaaatgctatggtgtaaattaaatactccctccgtttcgttttatttgacaccgttaactttttagcacatgttttaccgttcgtcttattcaaaaacttttgtgaaatatgtaaaattatatgtatgcataaaagtatatttaacaatgaatcaaatgttaggaaaagaattaataattatttgaaatttttaataagacgagcagtcaaacatgtactaaaaagttaacggtatcaaataaaacgaaacgaagggagtatgggtaccgagctcgaattcgccctata

SEQ ID NO: 24865 - DNA, 759 bp, Oryza sativa
  unsure (1)..(759): unsure at all n locations
gnnnnnnnnnnnnnnnnnnnnnnnnnnnnnnnnnnnnnnagttgaggcggttcacctcctggtgtgtgctctttgatccatgtactcttctcctcattggttggaattatgttctcttatttgtgttttctcttaatttgcacaagtaatcacttgcatacaaatactcaccaataattatggaattggttagtacgtaataaatccataccgctagatttggtggtagactttggtaaaatttatgcaggaattgatggtcaaatttggtagttgaggaccgtcaacagcgacgatggttacgatatataggagtaacatattttggtcgggtcatttctcccagaccccaattcgtcgatgtcttcctcatcggaaaattcgtagcagcagtgtcttgatgtagattgggacgatgacgattctgatttgaagtggagcataattcggtcaggtcatatctcctaggtctgaagacgtcgaagattttttgttcagaagattcgccttttggacccatctcgtcgaaaccttgaagcaccaaatccccctacagtatttgtagagtatggggattgtaagtgacagggtatacgcgagatcgaggtaaaagagacgggagatagtgacttttatataggttcagatcccttaactgatgagtaatttccctactcctattggctggaagttggtgttgccgtttatatatcaatatcacataagtataacattggggatgccttaatctagtcccga

SEQ ID NO: 24866 - DNA, 578 bp, Oryza sativa
  unsure (1)..(578): unsure at all n locations
gtnnnnnnnnnnnnnnnnnnnnnnnnnnnnnnnnnnnnnnnnnnnnattgggatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttggtgctttgggtatattattggattttc

SEQ ID NO: 24867 - DNA, 642 bp, Oryza sativa
  unsure (1)..(642): unsure at all n locations
gcgacgagccaggctaaccccaccagcgccgcgcggcgatgccggtggagatgatctatgatgtgaaaactcgcccatcttccgcttgttcctcacccagaggcggcgcttcgcttcctccaacaataggtaagtgatgccccgcccctcccctcattccttcttccagaaccataatcttttgcttccgcaatgccctattgcttcaaaactcaaaaatccttcctgtcatgtcattggaagtattaattttgttttatcaggctgacagttttgcccaaagcaaaatgttactccctctgtttcaaaatatagtaatttatagctatttatctagacaagcatttcagacatatagctaaaaattactatattttgataccaaggtgtagttaactgctaaacggcatgacatttcataactgtatacacaatggtacatttcagatggttagtaaatggcaattgcttttgtgaccgaagagtcttttttaatacagtatgtgataaagatgaatataccgctgacgggttactaggtttgatgacgggggacctttggttatctacgtgttttgagcatcgtacattcttaaaaaaaattaagnnnnnnnnnnnnnnnnnnnnnnnnnnnnnnnnnnn

SEQ ID NO: 24868 - DNA, 730 bp, Oryza sativa
  unsure (1)..(730): unsure at all n locations
nnnnnnnnnnnnnnnnnnnnnnnnnnnnnnnnnncgcaccccggcgccgacgccggccatcttccgcgccagctgcgcgaacgggctgatgtggccgaacgccaggaacgggaacatcaccacgtgcaggtctccgtctccaccgccgccgccggccgccgtcgccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctgctcctacctaaccgctcggacatttttgctgttcttttttttttacttactagcaaaaatgcccgtacatttgcaacgggtgaaacaattctaattacaatatacgtttttcatgcataaccatatcaatgataatatttatatagattggttatagctaaaacaatcagaaaattagaacatcttcaatgtaatggcccaaccttgatgatgacaactttaccgatgctttgctttacctaaaataattggattatttatatgacaccatgcatataatttaaaatactcttccaatgtcattcttgcaaccaataataagatcaatcaaatcctacagtgcctcgcatggtcaattctagacaaaatagagttattt

SEQ ID NO: 24869 - DNA, 612 bp, Oryza sativa
  unsure (1)..(612): unsure at all n locations
ccaattaccagtacataaaagtaaccaacatgtagatcatgattttagatgattttaaagacttgaacggcctcattctgacttcatatgaattagtcataaattttccaggatttaattcaattaaacctatttaaaaaagattaaataaatttataacacaatttatatataattttaatatatagatctttattttatacacttttgcaacttgaaacacattaatctgatttacaatgaattagaaatggattttttaagattaatctgattttacccttatacagaaaaggatttatgatttatgacacaattaagatttatttttagaagggaaaaggggctttatgacgtcagcatgacatcatcaccggctgcggcttgggacatcatggtcgccagcgaatttggcagagaggcgcagcggctcggactcggccgagcggctggaggaaggagaagaccccgacatgtgggccccatatgtcggcggctgagagagaggaggaggggcggcttggcctgggctgacttgggccgagcgcacgtgaccggggataagagagggaaggctnnnnnnnnnnnnnnnnnnnnnnnnnnnnnnnnnnn

SEQ ID NO: 24870 - DNA, 746 bp, Oryza sativa
actattggcgaattcgagctcggtaccctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaagatgtgtgacctttgcagcattacacttaacaagaatgctgtctttggtgacagcagtgcattggctcctggcggtgtccgcattggtgagtgcattccccttcacagaaaatattatcatgctaatgtagtaacatcttatagtccggatcttgctgattgctatggaattgattcatggttacaaaacacaactctgcaaaatcatgaattaatctgatgcgaattgcttcgctccatgtttcactacagagcctctgtccatagatgatagttatatcgaacacaagtgctactactggacctttctttgcacaagcaagtatctcagacggattctggctggttttca

SEQ ID NO: 24871 - DNA, 759 bp, Oryza sativa
  unsure (1)..(759): unsure at all n locations
nnnnnnnnnnnnnnnnnnnnnnnnnnnnnnnnnnnctatcaaagagacgtagaggatatatatcgatgaaggagatattctgaccagaattaccggaaatggaaggaaaaaagggccaattgcatatttgccactagtttgaaccggtatcgtggatttgccactgtaaaaagtgtaattgcatatttgccatcaaaatggttggaattcaatatacttgctattggactgacagtttagataaacaccattagaagattggtttttatgaaaattaggacaagaataccccttcccatgaaattgaaagattaacacatcatatgattcattcaaaatcttgcaattgacaaccctgactacacaacagaacattgctacgaggtcacaaaatcttcctagcagttcctgctgctagtgatgtagtatgtgttggctttgttgctgctgcccaaacagcctgttaatgctgccgccattgccgcccaaaccgctgttgttgctgtcatccaagccgcaaggcacaaccgcttgctgctaccgtcggcccaacccgtcaccgtggctgctgttgctggcttgctggttgccaagctacctgaaaacctgaccgccgcagcgcctgcttcttgtgagaataacatcttcatggtaggacaagaccgtgaagcataacagatgttattctccaacccctttggagatgtaccttaaaccatgtactttacttctatctcagaaaaaaaagcctgagagttc

SEQ ID NO: 24872 - DNA, 759 bp, Oryza sativa
tatagggcgaattcgagctcggtacccccgtttttctctttacgaatgtttctttaatttctaacagaccaaatttggctattctttataagaaatattttggatactttaaataatcataacatcttttaacttttaattatacgttctatttgtatcattacgttatttatgcatgattaaaatcacaaattaaaatttgatacacctgttgactataattgcacttgtaaaaattgcattcattttattttgaccctttgcaagtcgttcaaacatagtaccacataaagagttgaaataccctagcccgtttaatccatttattctttacaaacactctcaagccaccacatggcactctaaaaaatagagaaattccaagaaattctaagaacaaacaaaatatttatcccatgattttaacttaagtcggtggacccactattttcatccgccagatcaatttaaacaaatccttccacctacaccattgtcccgtaagtagccatggcaaccgatactcctataccgccacgtggcatcctacagacgctcataaaccgccacgtggtactataataaattatataaatttataaaatttctaagaaaaaacaaaatatctatccactgattttcattaagttaggtggacccttattttccaacaataggtttatctaaagaaaaatcctacctaaccccaaaccggggtataccatgggcctgtacgttacatacgtttctttttatagg

SEQ ID NO: 24873 - DNA, 751 bp, Oryza sativa
  unsure (1)..(751): unsure at all n locations
nnnnnnnnnnnnnnnnnnnnnnnnnnnnnnnnnncttttctaaacatattctatctatataagctatctactataaccaatcggatatacatgccatatgggtatgcggtacccataatctttccaatttcattctagctctgcccctgtctacaatgtgggtcttaaaagacccatagagttccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggctggagaaaacaacggaagaaaaaataacttagtttataaaaacaagccgcttcgaaaaaaccataaggaaaaaaaaccgtttataaaaataccggatcaaagaaacaatcggactcaacgcgagaaaaaacccgcaacggtttgagaaaccgtccgacttagcgcgaaaaataaaaccgactgtttctttaaaaaaaaagttagagaaaaccatatgactcaacgcgagaaataaaaaaccgctcaaaaaaagcagtctgactcaacgtgagaaaaaccactttttataaaaaaaatggttcggcatcgtgcaatgccaataaaatgtctgatttgaaaagaaaaacgttcgattccagaaaaaaaaaagatttctaacgtgtgta

SEQ ID NO: 24874 - DNA, 332 bp, Oryza sativa
  unsure (1)..(332): unsure at all n locations
nnnnnnnnnnnnnnnnnnnnnnnnnnnnnnnnnnnatgaatgtgtcaaaatgtgtttccgagtgaggggggttccgttttagttaacacgagggaggaacgaaagacaaacagaaatcaactagcaatattcatcatcttccctagcgctgaagccagtgtgcttcgggaggacgcactggcgagaagggatggagggtcgggagaagagtggcgcactgggaggagatagctgctagaagggagggggcgcacgggaggataggagtgctgggacaatggggcaacagggaggggaggcgccagcaggggtaccgagctgaattcgcccta

SEQ ID NO: 24875 - DNA, 493 bp, Oryza sativa
tgattaattattgcaaggtgagtacatggaatactccgcaagacacacagcaaatatgcaagtgcaaaaatataccaaaggatggcataatataggctcatttgcaaaagcagcatttagcaaacatttaagaattgtaaaacagtagagtaattaatcatcaatattaatcaacactgaatagcacacccatgctgcacaggcccaaccaaaccttgacaaccaaccctggtcgtacagatcaaacctccaaactaggaataagccattccaaaccagaagccaaattaattatcacattattatcattaatgagtagtgtgggactaatcacgaaaaacattgctcaacttgcccatgaccacgggcatagctattcgaatagttttactctggccagagatgtactactgtacccacaagacacaacccattgtcatgtcaccgtgtccgcgcagacacgtcaccatggcgagtgattgtgacaagaccc

SEQ ID NO: 24876 - DNA, 742 bp, Oryza sativa
  unsure (1)..(742): unsure at all n locations
ctgtctgggcatcgcgccacgacgctctcgggctttgtataaggaaagagaaagagaggttgccatcaatgcgagcgcgaccgacagggtgcggccgaagaacacacgggccaagatgggacgatgcatcgctcaaggtcatcagctccctctccctcacctccatcctctcctcatcgaggaacctggccaccgaccgtattctctctctaggcgtgacgcccatcgtctctacttgctcctctcctaacggccgctttgcaccaccccttctccccaatggccaccgccctttccccgccgctagtcagccgtcgtgcctagagagaggagaagagaaaggagaggggagagagatgaagagaggggagatggggagatagaggaggaagaagcccgccaggacagaggcgatagaagaggaggtgccacgcccggaaattcactaataatttccgaactaatttgtgcataaaatcctcgtccaggaatcagccgaggtacacaaactgataatttaatatacaaatccatcataataataacgttacatacttacaaaagaaaagaaaacagcagcggaataacagtctagcgatggcttcagctccactcccacaggcagctcaactggggtataagccaaacgtcttctccttctggatcctttttctttaattgaggttgattgnnnnnnnnnnnnnnnnnnnnnnnnnnnnnnnnnnngactcgactactcaaa

SEQ ID NO: 24877 - DNA, 438 bp, Oryza sativa
cgaattcgagctcggtacccagttttactctggccagaggtgtaccactgtacccacaagacacagcctcaacatcatgtctaccatgcgtcgcgatactagaaagtacccgaatagaggctgtgacaataccccctgcacaacacaactcaccacagtgcaccattcctgaatcataatcaccccctctataaatataaccagaggcatggactccccagcgacccccacggacttctcgccgcttctcagtctgatgccccgcaatgaatcatgctatacaaaaggtaaagccgttgcccacgctggcttgtggttggtacggttaatgtttcacaacagtagctcgcgaaccggtccttaattgtcatgagcacgaccttcaaaaccatgtgctcacaacccaccattaatcatattttaattaccaattaatta

SEQ ID NO: 24878 - DNA, 765 bp, Oryza sativa
  unsure (1)..(765): unsure at all n locations
nnnnnnnnnnnnnnnnnnnnnnnnnnnnnnnnnnnnnnnnaattctaaatgaaaaggggcacttttccattctcagatatacttatcaccatttctttttacaaaaaaagatacttaccagctaccaccagactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcacatccaagacacgtttacacggattagaggccccataagtcaataaaaaccatttagaattgggccaaaacatagtgcaggttattagaggcccattaagcaacctaccagccaaaggagaggccgggaggacactttttgggttcggccgaaccaaccagttcggccaaacccgttatgcgacctttcaccgtctgcttccacgtggacggcttggattcctcccctatggcagttgcagggtgttttggtcatttcccatacccctaaccgtcatttgg

SEQ ID NO: 24879 - DNA, 727 bp, Oryza sativa
  unsure (1)..(727): unsure at all n locations
cgacaaataagcccgcttgaccctagagacactcccttcatctatttatttttgaaagtgaagtgtataatcaagttatagctcttttcggcaaagatctgagtattttagcaattccttttttcttctagttatccttttgaattcagcatgtcttcaaatttaaatatctaacttctttttgtacaaatgggaagttaaataatactccctctatactaagatataagcatttcagctatttaaatattgtattaaaacattattacttctaggatagttattccaatacacaaaaattcaagcattttcaatcaatgaaaagcatcgaaagaaaatatatacaattaagtttattaaaaaagtattttgaaccaataggcatgagatctgccttgattatattaagaagaggcgaaatatgtcgcaatggtttgcttagaaactacaagatttaaaatttgacctaagaatgcaaattacaactttagtttataaaatgtgactaaaaagatatctctttctgttaacagtgaaatttggtaatcggcaaagacgtcatcggcttataatcattatcggctgcaacatctcggaatcagccgatgggagttatcaagtcgccaatagtaagattcctgctatattcggttaagaaaatcaatctactaaaggaagcttatccctaagtgannnnnnnnnnnnnnnnnnnnnnnnnnnnnnnnnn

SEQ ID NO: 24880 - DNA, 683 bp, Oryza sativa
atacaacaacaatagatatcataaataacatcacagagtttcacaaatggtacatgaatcatgatgcaatcgactgcatacatacgcagtccaaataaggttcatccaaaagatacaacgaactaatcatcaaactactcgtcaatctaggtaagggagggggtgtctcgcatattatccaaaaaccatctgatacgagatcgaagcttcaaggagtccgtcagtctagtcctccagccatccgcaggatcccggggcaggtagagggtggtcactggcacgcgcaaacctgagtccccacggctcagaggtagtggcccctggatctggcttgggcctcttgcccggaggtcgtgtgctcttgcgagcagtgctaagggtgcgagggcctccaaggaaggtgatgcggggaacaggggtctcatcctctaaaggatcagtgatgtctggctcgatctctggctcggtgtcggttccctctgtctcggagtcgacctggatcggagtctccaaactggaacccagctgtggagaaggtgtagggatcagtggagtgtgcaccaactccggaacaggtggctgtgccgctgtcgggtccactaggtagggcgttgactcggtagctagcatactagcctctcccagaagagcgtggaacgccggtgggtacggcggggtgagga

SEQ ID NO: 24881 - DNA, 755 bp, Oryza sativa
  unsure (1)..(755): unsure at all n locations
aacatgtagaaatgagaaccgaaaggtggttgtggtcctcaacaaggaaagtggtactaatcaaacaggactctggggatttcttaagcgagcatgaattaaggggaatttcaaaataaaaactttcatgctcatatgtggaatgttttctctcgtcctccagagtcgatgtctcaagcttgtccgtggcctgaaggttctccttcacaactgatgcatcgtgcaagaatcgggttgtttcttggtgataaacaagaaaaacgttctgagggccagagggacaaggcttaggcttgatcgagggtgatgagagtcgttcagtttcatgaagatgggaaataggtccagaagaaacgaacgaagatacaaacatcacctcctcgaacggctcattcttgggatgagccttcttttcgctggaataattcagggtattctcataattttcataaagatcacccctgaattggaatggaatttccggggaatgaatttctcttcctccggctccagcgactggaatgaggattcgacagttgagtcgggtttcgactccatgtgcagaggatcctcatggataatctcgatctccgggatggcttcgctttggccgaaagaatcgttctctaagatcaaatctaagagttctcttccttcggcagttgtcttgtgtgcgaacgatcctccgggggaaatatcgagatttgcggcagactnnnnnnnnnnnnnnnnnnnnnnnnnnnnnnnnnnnnnnn

SEQ ID NO: 24882 - DNA, 637 bp, Oryza sativa
  unsure (1)..(637): unsure at all n locations
ttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaaggannnnnnnnnnnnnnnnnnnnnnnnnnnnnnnnnnngatactca

SEQ ID NO: 24883 - DNA, 625 bp, Oryza sativa
acaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggatacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtagggggggtaccgagctcgaattcgccctatagt

SEQ ID NO: 24884 - DNA, 649 bp, Oryza sativa
  unsure (1)..(649): unsure at all n locations
nnnnnnnnnnnnnnnnnnnnnnnnnnnnnnnnnnnnagagggatcctgcacaccgggtgggtgcagcagcagcacatcctgcgccaccgcagcgtgggctgcttcgtcaaccactccgggctcagctccgtcgtggaggggctcgtcgccggctgccgcctcgtgctgctgccgatgaagggcgaccagtacctcaacgccgcgctgttcgcgcgcgagctccgcgtgggcaccgaggtcgcgcgccgcgcccgcgacgggtggttcgggcgtgaggacgtgcgcgacgcgctggcggcggcgttcgccggaggagaagacggcggcggcgaggagaagaaatggcgggagttcttgatggacgacgccgtgcagaggaggttcgtgcgggagttcgtggcggagctgagaaggctcaagggctgaaaacggaacgtcacgcgtcgttaatcagatcgacagctgtcacaactctgaagaaaatcggactctgttctgaagactgtgaagagaaggaatcaacggctgtgattgcttgatactgcatcgcgggtctcgctctagggagtactacatccgtcataaaataaaataagtgcagttttgcactggttatatccaacgtctgacttaacgtcttatttataaa

SEQ ID NO: 24885 - DNA, 699 bp, Oryza sativa
  unsure (1)..(699): unsure at all n locations
nnnnnnnnnnnnnnnnnnnnnnnnnnnnnnnnnnnnnnnaaatctcagcaggacccaccacataccatgtcttatacggatacaaccttcggatataggaggagttccgcataaggaaggatgaatagagttctacatgaaaacgacaaggactactcggattgtatccatattggtttccctagttctacttggacaaggggacacctatgggtataaatacaaggccctataggaggagaggggagacggacaatcaacatagacgccacaaagccagaagccaatacaagccaacatacgccaagacgagctgccggatatcgacatcaaagatatgcctggatcgaccctattcaatacctacagaggccggccgtaaggatctagcattgtctctgatctcgccggacacgaactcaaggaggaagactaccctgttgtcgactacgagtcagagcttcagaccgccatatcgacaacagttagataggctaccccaaatattgtacaggtgtgattatggtgaataagatcaataccggcttcggccaacaggatttagggctattacctgacaattcaggggtccgaacctgtataaaattcctcgtccccgtctcttttactacaatctcgcatatatcctggtaccaatgatccccatactatgcaaatactggaatcgcgacatcaaac

SEQ ID NO: 24886 - DNA, 824 bp, Oryza sativa
  unsure (1)..(824): unsure at all n locations
tattctagcgcccaggtgacctagcaaaaatggatattacacaggaaactgtattcttttccaaaacttacagacgcttccaagatttcatcggcttcactgatggaatactcaagaactaagatcaaagcaggagatacgatatatcatctatgtaaacaagacagtatagaagaactgataaggaggaaaacaagctggtatacttgcactcgcaagtccagtattcttcattacaaacatataagtgcgtccgcaaaatcgcttacatttatatctatgaaaacagagagacaaaaatgacagccggctgactcctcagaagtcagaatccacaaacataggataggaatactacatatgttgcaggctaggatcacaatctagatccttagactcaagttctttgatctttctcagacaacacacaaacgatatttacatagtgagtttgtgcggcgtcggggatgcatccagatgctggagatgtagggcagcgacaagtccctgccatgtttctccagggcgagctgatgtcttcaattccataagttttctctgtttcctgtagtagtcttccagtagcttggtctgcatattgagagtttcacatttagagtttatcatgttactgtactacaagaacaaagctagagaactccataagaactagtatcatgcctcacaattcctctcagagtttaaacttcttgtttctgaaaatgcaagtttttaggggtgtgcatatagatggcaaattggcaatnnnnnnnnnnnnnnnnnnnnnnnnnnnnnnnnnnnnnnnnnnnnnnnnnnnnnnnnnn

SEQ ID NO: 24887 - DNA, 449 bp, Oryza sativa
  unsure (1)..(449): unsure at all n locations
cgagctcggtacccacatatgttttaccacaaatcttatcttagccagagctggtgtatatcaattagagagcaccagatcgctggtcaaagctaaggaaaaacaagctttccctaaaagtcccacaattccacacactaaagcagcagaggacgcaaagcaggaagtggtgaacatacctgcccattctgaatgagcgaaactaggatgtatttcttgtaagcttcaacagcaatagcattcaatgatgacattgggacggtaacagcctgtaaaaatgcataacattgtaaacactgaaccattaaacatcaaacacaaaattaacatgtttaaagcctcacattgtgaagaaaatccagtgctatagtgaacttcttcagcccaatgtannnnnnnnnnnnnnnnnnnnnnnnnnnnnnnnnnnnnnnnnnnnnnnnnnnnnnnnn

SEQ ID NO: 24888 - DNA, 12455 bp, Oryza sativa
  unsure (1)..(12455): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaattgctatggaccgcaaaaacagggagaaagagatggcttcaattcttctatcctcattaagcatggaattgttctcaacagaagacattgtcaagggtttcataatgcttcttgaatctgcagaagataccgcacttgatatattggatgcctcagatgagctgggactgttcctagccagagcagtgattgatgatgtgcttgcgcctctgaacttagatgagataagcggcaagcttccaccaaactgcagcggggctgaaacattgaacatggcgcgctcccttgccactgcccgccatgcaggagagaggcttctgagatgctggggcggtgggacaggatgggttgtggaggacacaaaggacaagatagcaaagcttctggaggagtacgagagcggaggcgatgtaggagaagcttgcaactgcatccgcgagctgcacatgccgttcttcaatcatgaggtggtcaagaaggcgcttgtcatggcaatggaaaagaagaacgacaggatcctcggtctgctgcaggagtgctttggtgaagggatcatcaccatcaaccagatgaccaaggggttctcaagggtgagggatgggcttgatgatctggctctcgatattcctgatgccagggagaagttcctgtcctatgtggagcatgccaagaagagcggatggcttctaccctcattcggcgtcgctacttcagcttgaaccaatgttatgagtgagcaggaagcatcaagctggaccggaccgatgaacaacgaagcaagaaggcacatgccgtgatatttgctgcatccaagatattccaagttgatgattttcatttgcgttttctgatgcttgtcgttgtgcttgcgcgtgtaggtagcggagcgagcccctcttacttgtggttgttgtggtggcttatgtgtctagatctttcacctctgacacacccgttgctgttgttagttgcattccatttttaacttcccccatagacccttttttacttcacaagtaaaaacagagaaaagaacccccgtcatgtaaaagttgctccctgcctcagcatttgcatctgttgcttacctcatttactgtacgttctcgcctgcagcgataagtagcttgatgtgttcttttttaaaaaaaaaatactaggagtagatgttaattgtctttctgtgatgatcaaggcgacagagcacagttgcgctttgtttagctggttttacaatggggattggattggcaccaacattgtgtcagtgaatcatatctgttgggctgttgggtcagtggtatatcaatcatcagaaagacgcaatcaacatgccagctgtactgttttgcatcttggcgcaatcaacatgccaatggtatatcacatcttcatttccaaggattttccaagcatcctaggcttctgcgagcagctaggtgacgacaaaggcatcaaggttgtagcgatgaacgagcagaaagaccctatttcttcctcagcattggtactacctccgttcaaagggaaaattggaaccatgctattataattttgtaaaatttgagatataccatccttacccacatgtcattgacttatgtgggtcctatatgtcattgagatatcaatggcatatctcaaactttaaaaaattataatggcatggttccaatttaccaaaaagaatgtactagctatctactatccaattgaatctttatagagatatcgactgttcagatttatattattaggatgtgttcaattaaatactaggcaactagtttattttaaaacagaagaagtatgtgctagtttggtttagtaccctaccaatatattggtagtgccaaactctagacaagttttggcactaccaatattttagtaggatagatctgtaaatgagtgtgtttagtttatgccaattgagagccaaattttaaattgtggcgaagaatattttagaattgtgtcaaattaagtataggtattaccaaacatttggcttcaaaccaaatcttcacatttactatttaaactaccaaaaaaattggtatggcaatattttggtattaaaccaaaacgctcctatatgttgtttgtcctgaatgctgaagccatcatgtgctagcgtatgcgtcattctggtgtgaatcatcaatcaataactcccctaaccccactgtttttctcatttttatgaatttttttttggttatctggatggtttacacgtcgctcctcattccggctcctcgcgtacgcctgcgtgaccgctcgtaagcggtcaccggtccaacgatttttttgggcgcgggttggagccggtttgactaaaaggatattttgcaaaaaagtccttgtatttccacgaaatatcgtatacgtccttggactggttcacacccgttgtgtttgttgcgaaaaagccctcctatttcacaaatatacaatgtgaagaagagaaaattccgttttaggggtagagctgtaaatattaaaaactaaggggttttttcgaaaaacaaccacttataccccaaaccctaaccacgggctgttccctactacctcaccgcgcggccggcgccccacccacgccccgtgctcggcgctggcgccggcgcgggactcccctcgcctccgtccgccctccccgagtcacctccgtcgtcgtacggcctacacccgccgccggcggaatagtacgtcctacccccgctttacgttgcctctccttgcaagccgtgcgacggcgcggatcgtggcctcgtctccggagccgccgtagccagatccggccctcccacggatggatccatctccgccttcactgtatctggcggccggaggagacggcccgactgaagaggatggccgcgatagcttcggacgactaagcgtgggatggccttccccgtgaggggtttcgatgccgccaccgtcacccgtcgcctccgcatgcccacacacaccacgatctgccgccggtgcctcctccctccttacccctccccttgtggtgacgtcgacgggacggaaggcggacgcgtccatcaaggcttgaggtggcggcggagctgaccgcgcgaccgccgcccgtcggagccggtactccctagccccttcttcatgcgccaccgccgcctcctcgttcttccctagccgtcgtcaccgcccgtactcttcatctccccaatgccgccgcttcctctctctcgccctctcgccccgctcggtggggtgtcggatttgacgagcaaggtcagcggcgaggagcagggccagcggatgtggcaaggtggcgaaggcctcagcagccggcggtgggcgctcaaagcggacgaaagcgaggccgccggcggccccatcaaccgccctacccaccacccctaaccccccgcgccatgtcgtcctcccgctcaggtgcctatttccaccaccccccccccccccaacacccgtgcctcctgccgccgtcgctcccaccccaccaccggcggtcctcttcctcccggtcgacgttgctagccgatgccccttctacctatcaaccctatggctgcagtctgtaccgtcccatactcccgacgctgagccgtcctcggggaatgccggatctggcaccttgtcgccggattggccccggtctagggccggacgattgcaactcgctgtggctcaagttttgttgtcggctcttcctccttccgaaatacggacgcattggttggatgacagcagacatcagcccatgattaagcgttgcgggcggcgacgacgaccttgccgtatctgtgtaagtgatgagttttatggagtctttattcttcagactactggaagtttctttttgtccaaccaggttcttgcgatgtactggaagttcctaaacctttttttttcctgaacgtgttcctaagaacacttgaggctgttattttggtcgattgcaaagcaatttgaattaacaaatcccaaagcaaagcggtagtgacgagttttttatgtgcatgttttactgcctcggcggtgatgcaatcattcaggttttttgttcgactgcatcttacctattcaaactgcaggaaagtattgaattattgtgggttctggtggtttttatgctgacttgttcagttgttctcggtggtgttcttttttttattattggaccactgtatgtgcctcgtgttagtctgtttcttgttaaaaaaaattgcatggctcattatagtatcctactaggcttttcatgctctaggttcattgatatacaacttttctgaatgtgaatgagctccttgaacctggattttggttaggcagattatctgcattatcttttacactattgtatttggttaattgggttatctatgtgaggccagatgtagtgattggtcttacttgtgatgctaacaagcatgctttcaaaaggtagacatacttacagaattgttcttttggaaaaatggaacatgaactgtgatttaacgctcttatcagtcaatagccatccttttaattgtaattttcatatatagagcagaactacctagcatttccctgatgctatcataacacatgaaactgacagcgaaaattgaagggcctaatatttattttgtcctacaatgttgcactttgtaaaactataaataaaattataactcattgagccgcatcctttcagaacatgttaaagtctataaggctctcatgcctagcttgacagttaaagctcaattggaactgaagatctattaccatctaacgttcattgcatactgaaaattggattaggttcttttagagcttaatagggcctgtttttttataggttatggtgttttgccacacttgactttattattaaccagatctacagtccttgacaatactcctacttcaaagcattcattggatgatcgcagacccttgatcagtaagcaaccgatttatggcttgtggttgctgcttgatctcctcacctctcttgcaggggtaagaaaaagcaatgtacgaagcaccataaaaggtaattaattttctcatcataatatcgcagatagaagcttagaaaatacctacttttggttgctagggcgaattaccaaaagtggtgtacaatcaaatggtttgctgcaatccttttgcttacctacatgccctaatatattagatcgatcccaaattgctttatgtatcgtgtatcttattatatgtgcataggtcctaaaagagttgttgaaaaatacatctctgttgtcccacatagaatacatgatctctgttgttccatggcttgcatggattacctagctaatatattctactcctatcctcctttatttatttttaattatttatcttatttacttctgcaaattattcccataccaaactaattcagttgtgccttcttgcttgcaggtaaggatgtgctccatgtaaggactttggagttgctggcatagcagagaattgaatgactgcttttctaagtgcaagcaattgtgttctttgggttttatactaattctcaaacttgatgatattgggctggtcgcctctatattagctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaggttaccatgtggacttatttttgttaggcccatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagtatatctggtgcttcttcctcaacctctcttgtcctccctgctgctgctccgagaacatgaatggattcataaagttgattcgtgtaattaaatgccacattctgcaactatggacggtggcacggcgcgagtgtgtgcgacattggctggtgactgatagtatttgtggcgtgtgcgcggttgatcatttatttgtctcactcttccgcaactagcctgtacttgttcttgctgagaatgctaacaattcctttacgtaaatttggcttccttgctgtatttgcttgcagtatctcagtcgtcgttgatttcgactagcagatcttctatctcgagcttgatggaggtaaaaaagaaccaaggaaaagacgcaattttgctttacagtatataaatcgtcggtgcaatttgttcggaaataaatagtggactggcacgcgcaatcacaggaagagttttctttaattttgtggcttaatggagagtgactagatgataaattgaatcaaagaagaaagaagatttcagtttgttcttttttgcaggaaaaaaaaagaatgcagtttttgtaagatcggattcagacttaaatgcggctcatactaattggcccagaatgggatttcgattccgtgaggcctatatatatgttgggacgtgaggcccataaatattgggccagaacgggatttcgatttcaagaggcccaataacgggagtaggagttacgtgcggcccatattaggcctaacgggattctgacttgtgggccacaatgattgggccgcaactggatttcgattacgtgcggcccagtcaacgggcttggagcttcgcatggctttggacttacgtgaagcccattttcgctgggcccgttgatatatggggcccaggaaagttaatccgaccgccgcgaaaaaacagcagtccagatgagtaacatggaccatctctgcaactgcagttgatttacaccatgatttgatgattgatttaactcagataaagaaaggcatagtttatcaacgaggcaaaataggatgtgaatatgtgatccaactgatggtcaatcattgagctactaccagagatgttcaaaacatttcagtcagtgatgcgcatctattgtgtcagaactcacaagagagatgcagttaacagattcacatactttcatctaaactgaggtgatcttaacccagagcccatctaaaataacagtatacaagaatggacaacttgtagtcagcttcaaccaaatgaaattcatcatcttgatcatcaacccttgtttcagtttttactgtgcccttggaacccatcagtttcttccactttcgtcttgcagtctggtctgatcttgcagaaacagcatttgaacagtcccctgcgaggcaaagctccattttgataaggagcaccagcacggcgctgtagaagcttcgagaaacagcctcggcgagctctggcttcgtcaacctttggtgtgtgccctccagctttgaaggaaccatttcctggagtggatgcttcaggtatgactgaaatcttctgatagctcaagatcctcgactcggtatccaccgcgtcgccatctgtagcatggaggcaccccagaatgtgcgacggcttcttctttggttgcaccgcgagtggagaagggcactcttttcttgatgaagctactgttctgcaacctgcggcaactggatcttctgtctcctgatcttctctggattgcatgaccaggcttactgatgaattcttggatacaactctgttgctggtggagattggggaaagattgatcctgatatccacattgcactttagcaaattctgcagagaaaccacaaatggattccaaaagctctctgttgtaggtacatcctcggggtggcagaactgcagctcagcaactgctacacctgcaatccaaaattaaacagaatgagttcgacttgaaaattctgcagtgccggcatgcaatgatgctactaacatgcagtttggattcatggccagtgctgaacggcaattactacagaactatgggaagatatgtgttaaaagcatactgacaattatctgccaccttatcaagaacactagcttatccacagatatacctgtttactatacatgacacatcatacatcagttcagacaaacatgtgctttctggaaagcaacattgatcaactggctgaataagacgtatgatggatcagcaggaaacatagtaggaagtatggaaatgttcttgttatagataagatgacaaatgaatctgcctcccaaacaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcgttccataacgatattatacaggaaacagattaacccccatgggtacaaaataactgacactaatgtaataccatatgaagtagagaatgccatttacctgtctgactctctgtgaacatgcttgaaactgcagcatcatctaggcagtacggctctctcatattaaactgtaacagcgctgctgtaagccatgtagactggttctttgtggttttcagctgcttttcagtttcagaaagtatttccagtgcatttctaagtttgtgcacatcaatttcagccgctgtaaagttaagatacaggattagatgatatgtgtatgacacattaatgtgaactgtgagcataataattatcatatataataatgctaagctaatatgtcatgtttaaaggttggaattatcttcaagataaggactccatattgcagtgttatgttcggcattaacaataacagatctgcaggtaatccgtgtgtagattgtacaattttaaagtttgtttgggagggaaggagcatacatgtatgtttaccagtaacctttctaacttcttgggaatctgactggtgcctcccagctaaaatatccatgataagatttgcaagctgagctaataactgcagggggtcaacctttgagctcaaaagctccctagccctcctgacaatggtagcagcatccgatgaaaaagccagattaagaagatcaagcaactcctcatctgagacatcgcctatctgaaaaaaaaaaacagcatagcaagttgatgtatgttcactgaatatgaaacaaggcaatttattttatggtggtaaatatttcaaggctagaaaagctgattgattaacttactaggtcatatgttactgatttgctgatcctttttcctagcagagtaagctggtcaagcatttgaactgcatctcgaatggaaccgttggccttgcgagcaataagctccagtgcttcggcctcgaactccataccttcatttatgcaaatcctactcaatcggagggcgatctctgcttcgtctaccttgcaaaacctgtagctctggcaccatccaactgaattacttggcagtttatcaatgtcagatgtgatcatcacaaagattgagctgtcagggatgccttcaaggctactgtagacagagtaccatccctccttatccatgtgttggcaatcatccacaataagaaccttgaagtgcgaagaagcaggaacttcacaggcattcctcagcaaggcagcaactctagatttgcaatccagtttagaagcatcaatctctatcacactgctactgtttcctgagaatatggccatgcattcctcacagtgcccacaaggctggttcccacctgaagagtggcaattcagtgatgcggcaaatattctagctgcagatgtctttcctatgccatgtggaccatggaagagatagattggagcaagttttcctttcaaaacagcacttgaaagagactgagcaacaacattttgtccagccagctcagagaaagccttgggccggtacttttgaagcaaacttctcgcgctttcttgaaatgtagctccctccctccgacccaattgctctccttcaatcatcaaagaggatgccctgtcctttgttgcccttgacatccccgagatcaccgaggagcaggtctggttatgaagcgccgccttgaccctcgcattggccttgatgatgttgatcggcgagttcaccagccgaccagacctcgcgctgtccccaaactcctccctcctcctctggagatgatcatacatgttgtaactaaagctgtgcctaccataattgctcccctccaggtcatcttcctcgagagaacaaccctcccagatggtcttcttcgccgagaacttggccagcgagttggtctcagggtccctcagagatctggacctcatgacggccagtagagccctcgaaatcgggatgtcaacggagtgcctcctcccctcaatcatcttgcaaggccccaatgaactatgctgcaatgcagataaataacgaggaacaattcagtcttcagtagagaaaggatgtgcaattaggcattgcacagtcaacacaatcttcaaacatggtgcacactccacaaaaaaactaatcttttttcgatcttgtatgcaaggagcagagaaaccatcaacgcaaaatctgcagaaacaatcgctacctgcggttttacctaaccagcattgccatgcaaacaacttgccgagataggcggagccaagaaaaaaattgcagattgtagatggaagtcaatcgggcgcctggatgcaaacatccatagaaaaaccttgcaacttgcaaaggagagcataataaaactcaaatgcaaaatgcatccaagaacatgaaaaaaaaagaaacaaaagaaatggagaatttcaaggcctacatagtacataccgaacgatctcgcaggcggtacaaaaacctcgcaaaagggggcaaaagaagaagagaggaaacgacgcacaattccccatagaggaattaacctcaaagaacagatagaaccaaaaaaacaaaaagaaaattggaaacattttcgcagctccagacgacgtggcacgcaggccgaagaatccaggagaaaggacaaacaaacaaacaccaccgaccgagagcagcaagaacggaagagaaagatggggattcggaaccgaagcatttacctcccccccaaacacgaacgacaaccacaacgacgacgacgcaagacaacaacgccgcggcttttccgcacctccacctccaccgccacggccgcgcgccgctccctccctcctccgttcaccaccaccaccaccacattaatagcgcgagcacggcatggagactcgaggagagagagagcgagaggagcaagtgagcgaagcagcaggaggggggactaggcgagactagactagagtggcagagacgtaaatacgcgccaaggtgaggggtagttttgccccgggaggcgcggggaggaggcgggcttaggggtggatatcaagctggctcggctcggtctagctcgttaggataacgagctagattaccggctcggctcggctcgtgtgtcagctcgagccagctcgtttagctcgtgagccacaacaaggaaaaagagtagtggcgtgtgcagtgggaggaggaagagggcaaatgctcacaaaccaacagatttcaaaggaaaatggatatgatgatatatcactagcttgcactgatcgattactgcaaaacaaatgcaattcagtggccggattaaaccgctactgcaacagaaatcaaggggcattccagaactgaaaaatgcaaatgaggaatcaataaaaatacgcaaagagataatcatcttgaaagagatgcacaaatgatggcttgggtggtctcgttcaccctcctgactcctgctccctcggggtgtagttgcactgatgccgacaaagccacggaggcgagggctggcagcggggccgattgaggcgagggttggcgtcactatgg

SEQ ID NO: 24889 - DNA, 26935 bp, Oryza sativa
  unsure (1)..(26935): unsure at all n locations
nnnnnnnnnnnnnnnnnnnnnnnnnnnnnnnnnnnnnnnnnnnnnnnnnnnnnnnnnnnnncgagggctggcagcggggccgattgaggcgagggttggcgtcactatggcctacgagcaatctacacgcgacctcgtcggcgggcggcgcaaggcgccgtgagacgcggggagcgagcggcgctctcgtcgcgcggcggcgtgaggagcggagagcaagcggcgctagagtagaaaggggatctgggattcacagaatcacagtgcgtagacaagtcacgtgcgtgtgtttctccatctagggctagtgctattttttttcttgatgggccagctcgaccgcttcatattatctctttggactattgggcagctgggatctttggctgttgggcttggctcgttaggctcgtgagcagctcacgagccagctcgagctggctcgttataacaaacgagctaaaaccctagctcggctcgttgacaaatttaaacgagccgagccgagctaggcacgagtcgaacgagttatcgagccacgagttttctgtccaggccgagggaggagggagaagaagaggaggccacgatggcacccacccgtaaatacgcgggggattcgaggggcgtttccgtcatttcgtggctccgtccgtggcacaaccccgaaccgtaaaacggacgggacagcgtggagcggcggtggcgcgggtacaggttgatgacaggtgggccccgggcccccctgtcagtaaaagggcaacgtgggtgggggaacacgttgcgaagggcgtgccggtgtcgtcaaatttactgttgcggcatgcgaggccccgtgaccccaccgctgctgctttttttttttactgatttttttcatctcttgccacctgtgctgcaataatttgttttttttcttttttttattttgttgtgattctcttttatcctctgtcatagaattttggcaacaggatgactaaaaagataggactattgtcgtgtagcctgaggtgtgatttaacttttttgactcggaaaatgtttgtcattaacccatagtacaagtttgtatcagggtggtaggagtactagtacaagttattagttgatcaaattacacgtcatttgattatgtgtgagctttgaaaatctgtttcatgcttttatatgtatactaaactctaaaactggccttaatatgttcagtaatcagtcgtgtactaaaaatttgtcaggagtatggtttagaagatttgtggcttttattcaaaacatatagctagaggcaaattacttgtgtttgttgccgcatgccaacaatgctttcttgctatattagtttatcagtatgataacaacattgtcagatataattaattaatgtgttctgaattttcttatatcctttctcagttctcaccgatataaaagcagctggcaatcgatgtggttttgagcagggaaactactccaacaccataatctgtttctctcttcttttaacaaggattcggtagaaatgatccacaaggggggggggaccaagactagttggttccggcgacttgtttggtgattttctaatcattgtttagtgattgatcaatggtccaacatgcatatggcacagtcttcgaatccaatcaactcaagcatgcatttgtatttgtcgctttattaacttgtaggacagaacgatagcctcttgatctttgcatcattcaagagttgatcgatcgggttatcatcatcagaaacatggccggccctgctcatcatgcatttctccaacttaatcttttcatttgtaactgaggattaattatccactgtaaaaatgtttgtgtggctaataaacagtcaaacagcatttcgaagttattttaagtattcatactttataactttaactatgttatctgcacttggagtggatgatacgtctctaatcataatcaaatcagtagtagtagatagtatcataatgtgtagagaggtatagccgtatagggggtaagacaaacagtgtagcttgcggtgacagtaggtcgtctcgtctgaaaagattcgaccttaattagtttgactcttggtttagcagtttagcttacgctggagctaagacaacaggggcaaacagacacagctgacaaccgagcccaacgttgaaaaggctatcataaattcataattatgctagacacattagagatttgtttactcacctggttagcttattctaatcatcattcgacacccacatgggcacaatagtaaaaaaaattatactaagcaaactggtacagttgttctaattgcaaaacaatgtaaaaaaaagtacagtataaccaacactgttctctcttcttcttcctcttcatgtaaaaagagttgcacacgctgcaatcagccgtagaggagcctgtgctgtcgccagtcgcctgaattttctggaggaggcagacaagacgggctcatttccatgcttgtgttgcattgctgcacgatcttcctgtccatgagattgtgacttgtaatggcgaaatcttcagaaaaattctccattgaattgccaccgaatgtccatgaaccctaggtgaagtacgagcggcagtatcacagctctggctggctagctagatctcgtttaagctggcaatggaaggtactactgtactgtcagtgaagtgatattaacgcagatacagtgaccccatcgctgggacaggatcttcttcatggtgcaggagtaattaaacgcctcttcaacggggttcttgattttacctgtctggtgcaggacacggtactacatgtacaccaacttcttctgaaccgagagaggtttcaatgtaacggatggacccccaccacacgatctcttattgcacaaccagaatccttctttagaggacatgaactgataaaaggggaacttgaatagtagtaatatgtttttttcagtactaaaattatgtcttgaacataggcctcactcccgcgagggcggcacgggtggtgctaccgtcgccgcccatctccccctccctctgccttgccatcgctagagcgagcgggcgacaagacgtgtagcgtgctaggatagcaacggtggggctctcaactatagatataggggctttggataatagggggcggtgccgcggcgtgccatcccagctcacaaatcacgatggcggtgttaggtgcaagtgacaacttgacggtgagagcaatgcgtcgtcgaggttgtgcagtgattagcaacccattgaacgaggtgcaggtgcaaccagggaagcgaggcgacaaggtgtggccttgaaggtaaggtggccggtgcttcgtgggccctactggcaattgatggttgcagcctcctcccttcacgatggtggtgatggtgggcatccatcatccacaacgggtgcacaacaaggtacgaaggaggacaggagacaacaacgtgtcagatcccatgccagggaagggtgagtgcacccaacctttgtgatgatctagggtacaaaggtttggggcggcggcgatatgtcacgtccagaaatttagcccaaatttccagactatttttgtgtattaaatccctgtccaggaccagccagggtacacaaaacaacaagtaataaacagttccaaacgtaaataaagcgtaaaatatttacagaagaggcacttagtcctcacaccgaaagagaacgacagcagcggaaagaggcgatcctagcggggcttcaactccactcctcaggcaaaactcaactgggtctgagccttggtcttctaacttcgtcttcagctcagaagcactacacttctgaaaagggggaataatagcaaggctgagtacaaccaccgtactcagcaagccacaccaaagatgcagacgtgcaaggggatacaaggatggcttgtggctatttgcataaaggcgattgtaaagtattttattaagcaaaacggtaaaactgttgagtaattaaagtaatattaaatctccactgatcaacgctacaccacgttgaacaggcccaaccaacccacctgaactacagtgcattgggtcgatttattaagtgtgagactaatcacggtgattctggtcgatcgcccataaccgcgggcacggctattcgaatagttttactctggccagaggtgcacaactgtacccacaagacacaatccaccggcatgtcactgtgcccggccggacacgtcaccatgtcgagtgattatgacaagacccttcatataccccactctgaccaagcataccacacctcaggtttcacccccgcccctagcaggcagcgggcagtcccctctcgtgcctaggtgaatccggaagcgacagaggcagtcgcagggcccgccccgctccatcacgcccatccttgcctggatgcgtcagccagagaaaagctatacttcaagtcaggcagttaccctttcccgcttgtggcaagcgttgtatgtcttccagtgcatcccgcgaaccagtccttaattgccatgggtgcgaccagcaaaaccatgcacccacagcccaccattcagtcgcattttagttggataattacgaccatgaaacatagccaaatgtctcgagcacgcagcttgttctgatactaacaaggtctaatactgcaattatcccatcgactgagctagtggtaattaagcatggctaagcatatagttctagctagatcaacataagtgacacaagctagtcgaattatcacccacggttgacaaaggacaggtatcaagtaaacatggcacaagcgagcagataggtaattcccagatcccatgtaactagcaagacatgcattatttgcaaatggtaaaacacttgtaaattaggatcaaaatgctcaaggggaatgtgtgatttgccttgcttcttcaaacaatcttctgaactcttatcctcgcgaccgcgatcttccgaaacgacggaaactacacgctggcatgcaaaacgaggaaaaaccctaataaaaaccaagtaaacagtacaaaaaaagtaaacaaacatgtagagctacattttagatccattttgcaagttgaacggctcaattcggagttcatatgaattagatatgaattttagaagtttttagccgtttaaatgaatttctagaattaaactcgatttattgcgcaattattaattattttctcaagggaatggttgctgctgacgtcatcaaaagggggagggcggcgctggcaagcgggccccaccggtcagcggcacaagggcaccagtccaccgtggaccgggaccaccgagtcggtccaccgtcggtccatgggatccgacggcccggatcggccctagccgatcgggcggccacggggcggggcagccgagacacaggcactgctcaggccggcccgaccgaacgacggcgcgcggcaacgcggccaccggcgacggcgcggggggcgacggcgcatgcggccgtcgacggcgcacgctagggagcggcggcgcggcgcgatgcggcaaggtaaggcggcagccgtgtaagttcaagtgccttaatttggtttcggtgattaatgacaaatctaattatataagactaacgtttttatgagcctttctttgactagtctcatttagatatgaaagtaaaaataatgagaggtatgtattaaacttcacatattctaacttggtctctcttgtggatccaaaatataatgtgagcttcctatttgatctttattgattatgtgcatatgtgttccttcatatccatatgtatgcacatcttgagggggagcttattctatattttgtttattataatatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtcggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactcgaatgttatcttatttagtctcatttacattgagaacatacatatgccttctctatatgtataagataaacccccattggtcattctctaattatacatacacttgcatctcttgtatatttatttgtatgcatatatttagagggagcaaatcctatacatttattgtgcatgttctagatccatgttgttcacctattatttatactggatctttgcacttgagcttgcatacgagtatatgacacttgtgatgttaatgaatactcaacaaacatatacatatctttcatatgcaaccggttggtcatcaagtgaaggatgacaaccgatttgttgagactaatgttctcctttgaggtgtgaaaaggaataggtcccattacgatgaggctaatgaatgacaccatggtttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtattttcccggtcttggtgtttggtgtagaccggatttgctagataggcgccgtactatcaagagtggtctatgaagcgagcttgtggatgatcttgtgccatattagttcatatgcatgtaggtgcattttgtgggcttgtctaaccaagtgtagaagtgggcatgtccaataggagtgagtgacatcttgtgggtatgtccggtggatatcctttggagtgtgagccatttatccttgacttaagttgtgtttcttggatggatttttcatgggttggatggccctttgaataagctttccatagagtccaagaacgccaaattctgagacccgagtcaagagatatcgccgttttactaacggtcggttgagctgaaaagtgacctgcggtctgaccgtgggccttaggccggtctgaccggccggcgtggtaaggccagtatgaccggccccactggtctgttgcactggtctagtttttggtggcgatacagagccgccagagccgcaaccggtcagaccgagccgacggcggtctgaccgagccgtggacggtctgaccaaccactacactgcggtcagaccggccaggttgagtgggctcaatgattgccctgtaacggctagaagtagtccggtctgaccggcctcacaacggtggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtacacttagtttatctagtgaggtgttagagagtgagttaagccaatccaagtgcattgcttgattgttatagctagtgtggcacttgatcatcctcggcaagcatcctagacttgttactcttgtaggttgccgcctcctagacggcttgtggaggtgttgcccggtgacctctccgaggagattgtggaggaggcccggcaccgtttatgagtgatttggagttcaccaccttcggagtgaaggaagaactaccccgagtgatcgaggcttgggtagtcctctccgtgggccggctcccgccttgcccaccccttgacaaagggggcgtgcggtggcttcgtggttgagcggtggagttgggctcgcctgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccggctgtacagatctatctccaaaccaggaatataccattccaaaccaggagctaaacaaattattaccagttatagcatcttttattatgatgagaggtttgagactaatcacgaaagacattgttagacccgcccataaccgcggtcacggctattcgaatagttttactctgatcagaggtgtaccactgtacccacaagacacagctccacatcatgtcaccatgtgccttaataccaccacggtacctcggaaaggagctgtgacaataccccttacataacacaatccaccgcagtgcaccattcctggatcataatcacccccttataaacaaggcatggactccccagcgacccctgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaagggctataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttgcggtggaccgggtgcacggcggcggttcacgggaacggacggccgagatcgatccatccaaaacggacggccgagatcgagtggtccacgaccggctcacggcaaacggccacgatgacgtcagcggtgacgtcaccaccggcggcggctcgggcggcgcaggcgcacttgctcgccggcgaacgacggcgcggcggcgcgaacggaggacacccacgggtagcggacggcacggcgaactcaccggcgaccaaagcgacggcggaagatcaacggacggcgacggcgtcgaggttgaaacggcggagaagatcgggtcgacggcggcgacgggtcttcagcgacggcgaaggggcagacgaggacggcgacgcgacagcgaccacgaaggcgacctccccgagcgacgacgacgaccggaacggcggcggcgcatggctggagcggcggcgacgacggcggctcgaggttacacggcgctagggcgcttccgacggcgagaggcgaaaacaagggtggcggcgggtagaggagacaccggggatccttttaaagggtctaggaggcggtggcaaaggcccacggcggccggcgacgagaaagaaacttcggggtttgaaggaaagagaccgatccgattcgacctcgaatccacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagacgacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacatcgcctcaacggggattaggaaaccggcaagtttccgaaccttggtgaaaaattccttgtctcttgtctcatttatttgttgcatttacatttgtgctatttatattcatagagacatatttaagcccatatcacttaggtttgcaaaacttaacttagttgcttagttaaccttgcacctcaccttccctagcaacttaggttagttttgtttaagtgccattaagttttaaaaccgcctattcaccccccctctagtcggcctccttgatcctacaagccggctgcccggcacagccagcagcggcacggcgcggagcacggcggcggcgacccggtcgaacggccaccggcggcgacggcgcgtcacgggcaggcccgggaggcggccagcgaaggggaggaagagggagagggagaggagtgctcaccgagaggtcaaacagcggaaggaggcggccgacagcgagcaaggtgacggcggacgcctcgagatgacggtgggatggcgctccggcgattcccggcgaagaccacagcgtggccaagaaccggcaggagctggggaaggtatagaagggagctggagtgagggagatgacgcggaacgacggcaaaaaggcggccggaacccggcgggaaaggccgaactcaccttgagcagaggggaggtattttcggcggcgattcgcgaagacagaggggtggccgacgtgcggctcgacaccacggagacggagggggcgtcggcacggccggacgtggctccgaatgccagcggcgagcggctggtggctgaggagttgaagcggctcgggtgtggtggtgcaatggcggttccagtggtggagggggaaaatggagcggaggccagggtggagctcggcgggccgatgccgccggtggcggcggtggctagaccggcgaggaggggcgcccggagctcgtcggtgagtggtgaagagagggagcgcggtggggaggtggttccggcgatggaatggggaaacggagcgggggccgaggtgtggcaccgtgcggcggagcctacggcggtggctacgcggcgtggcgaccactagggcgagcggcggcgatggggtgcggcggtgtcgcggtggtttccgggcacgggagggctcgggagagaggggaaaagagagaaggaggtgcggggatcgttttatagagctcgggaggtggaaatcgtggccgggagagggggatcggctgacggaagcgggacgccgacgtggggtggtggcggctcggccggcgccggtttttgtgggacgagtggggggaaatggtggggaagaaggtgggcgacgaccacgtcgcacacgcgcgcgggagcggcatgggcgcgcgagaaaacgccgctatgtggggcggcaatggcggcatgggcggttgccggccagggaggccgaaggttggggatgacaggtggggcccatgggtcccacctgtcggggagggggagagagacagttggaagggggaggaaaagaagacttgagagagatgggcctacgacccgagagagggagagagggggcgcgggccgcgggaggggggaaagggacttgggccgaaaatggcccaagggggatggagggagattttatttgttttccttttattttatttgattatatgaactttgtattattataattatttcttgagctccgaaaattcacggaaaaatctggagagtatttgaaggcacaaagaatattacaaaatattcccggccaatgatttttaaaaggaaatttctaattccctcaataattcacttgattaaattgatttaacttttattaaatttctagaaaatacattatttaaacgatttttaatcccgaacgaaaatcggggcatcacacgatctgtgattggtgatggaccagatctaatgtgggtaggatgggtatgctcggccttgtaatgatctggcccatgacgagaacaacattgagggttcgtgaggtcggtggcagtaggaccaatccacgacagcgagggacatgtgtgctcgcccttttgtgacggttttggcttgtgcggcgatcctaccatgcaaaggtgagataaggctagccggtggaggggcgtttgtgcaagggttcttcacactagtggtagttggatgctggtggggtaatgcagttgcgattgcaggggtgtataggttgcaggtaaaagcgttgtccaataaattgtaggctagcaacggtaacactttcaagtgctgtgatccctctagaatacgtttgccgaggagcctcgctctccccttggtaggacactccaagtgaaaaccatgtccagatttcttaggcgggcgacaacgcattatggcgtcacatcctcgttgaaggtgtcatctagaaggttctgtttttggctttctaccttaaacagttggggcaatgcttatggatgacggtaggtttgtacgaggaatgagtactgagtagatctttcttgttgcttgccctatacctctgcaacccctctcggaccactaatttcagttgtttgaaggtgttgtcgggtggttaaaatgtggatgtggtggtggcatccgtcggtgtggcactagacatttggtttgtgtaggagctacagcatgtggtggtggttttgtttttctattttcgttattaactcccataattttagtcttatagtagtaattttgtactagtactatattaatatgaaacatcacagtggatggtgttgtttgtttcaaaaatatcaaaataaaatgtcttgaacgcaagggaccttttgttttgaattgttgaacaacaacaatttactcctaactaggaagaaagcccgcgcagatgcgcgggcagttttatgaagacaatttttaaaaaaggtaatatctcaccatttataagccgagaaatatattgcatactttaatatatttaagtaataaggttatctcctagattaaataaaatcactttgcctctggttacatacaaattttcttgttgtcacttcaacctattatcactgtttaaaagccaagtatctattcatagatgaactatgtaatgtatcaataaaataagcctaatacatcattaatacattgaaatatccactacacgtaagtgtttcgtgcctcaccaattttcaaaactatatataaatattgtaaaaataccacttgtacaaattaatagaataacatcaagttatacataaatgcttctctaatgcgtgaagccgattgtagtggcgagactttctctgtctattgccttgaaacatgggtcccatatcgatgtagttgtgcacctccagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttattgttgataatcacatgagacacctttactaattcgaagaatatatttatttttttcaaatttattaataataactaatatgtgggagtatatgggagttttttattttttttgtatgatactatatacgtatattttttttggttctatcttttttgacacgatggctttattcttttaccgtacgtatgtaggttttattgttccttttcattcttacgtacttacttttttttttggcgaacctattctctctcgtatgtataggtggaaagtattagtattagagatataaatatctaatctaatgatctaaataatggatccatcaatttaagtgaaaatcaacggtatagatatagatataatctaatggtctaaaataacgggtccaccaatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacaaaaagaaaaaaaattcaaataacctccccaaaaatcaaatccaaatcaactggctctctagaaagcaaccctgttccttaagcaacttccctttgtcttcttcccagcggcccataagtagtccacatctccactctcttgaccacgaaacggcccaacacccaaaacccccgggcccacatgtcatcctctcccccaaccctagcgccaccggcattccgatccctcctacccctggccccacatgtcagtgacccgaaaacgcctcagggtatatatacccagctgtgcctaagccgggcacacgccctctgaccccgatagaaagggaggaaaaaaaaaagagaaggcgaaaccccaaatccgccgcgatggccgccgccgccctcctccgccgctcgccggcggcgcgcgccctcctctccccggcgctctcctcccgcctcgtcgcctccaagccccactcgtcgtcccccgcgccgccgccgccgccgtcgaaggcgggggcgaacaccaagacgttctcgatctacaggtgggatcccgactcgccgtcgacgaagccccacctcaaggactacaaggtggacctctccgactgcgggccgatggtgctcgacgtgctgctcaagatcaagaacgagcaggacccgtcgctcaccttccgccgcagctgccgcgaggggatctgcgggagctgcgcgatgaacatcgacggcgacaatggcctcgcctgcctcaccaagatctcgtcggcgtcctcggcctccacgatctcgccgctcccccacatgttcgtcatcaaggacctcgtcgtcgacatgaccaacttctacaaccagtacaagagcgtggagccgtggctcaagcgcaaggacgcgccgccgcagcccgggaaggagatcccgcagaccaaggccgaccgcgccaagctcgacggcatgtacgagtgcatcctctgcgcctgctgctccacctcctgcccctcctactggtggaaccccgaggagtacctcggccccgccgcgctcctccacgccaacaggtataccaccaccttcccaaatgctcttggtgtcgtgatgttgttcttgtttgttgattcgttggatccgtttgctagttgacttgtttgtgattcatcgggtgatgaattgtgctctggtgattgtgaaatggtttgcttgttgattgatgcgtagattgatctgacctggatgcttgtttaggcgatgcttgtgtggaaatgattttcattaggacgatagtttatttttccgatactctgatgtggtcatgaattacgtgatcctcttatgtgacgatccaatatttgtttggtagctagtagaaacttggtaaagcggtttggatgatcataagtgaatacagtgtggtgatgaaatgtgttaaacacgtgtgtggttctatagtcataactgactaggcgcattcaaggcattcgctgccccacaagtattctgccttttgtgcctgacctactgatcagaaatttgatatccaaccaaggaatagtttgcaagcctcactgtggtaaaactcatacttggatagtggtagtgtttgattgctttccgtagtttccacctctgctagcatacagcggctgatgatttagctgatctacgacgttaaatacttttggtgtgcattcctttggcacttatttgccttaacttgaattatagttgtctaatatgattattgtttttttatgtaagctttaggatgttgctaagtccatgacacgttcaccctttttaggcttccgctgttggggacgctaatcaaaccaaaacccaacatgttcatgcacatccaagctcgaggatatcacggggtatcggagaagagaaacttgctggatcacaaacgtagattgcttgcagcaaaatatgaactgaaaggaaagctttataaggctgtttgtagggaccctgatcttccagcagatatgcaggaccagtttcgctataagctgtccaagttgccaagaaatagctccatgacacgccttagaaaccgctgtatcttcacgggccgctcgcgcgctgtttacaagaaattccgcatgtctcgtattgtgttccggtcattggctaataagggtgaattgttgggtgttaagaaagcgtcttggtagatgctaacaaccagtagatcaaagcactagctctgcagtagtccagcacaataagtttgcctccatgcagtttttcagtgtttgcaacctgaaactatatttcaatcttatgaccagcagccaatctggcactctttcaattatttagttgaaccaatgtactgtactgtttttctgcctattgagcatttatgaagttaaaagttttggaccattctttttcccctgcccctatatatatggtatttttgaattcggagatactttttttaccatcaaggtgcgctcagtcatgataaatacctttacttttgacagtttacttgtagaattagttatacttactgataactgtttcgcagtatgtagattaatttgcttagctttgggttacttgaattctgttctatatgttattgctgtgcctatgtattgttgaaagttaataatcacacattctagcgaactctggtgcatgctactggttgctcttgcaatcgcattaaacatggaattttgttaattaaggcatttgacctgttgtgccatcagttcaagatgtagtgcttcataatttcaccgttcatgggcttaatgagtggatcctcccttgttttccctagatttcagcaacaaattcctttcctgttcctgctgagttcctgtttgatgtaacttgtttgttgatgttcaagtattaaatcttctagatgaataactcagttttcactgcctgattatatttgtaaagagaactagttaacatatcaatcttttagtgtctgatttggttcaggtcccctaattttgttcatattgtgcaattttgcctgattctatgtgcagttgtgaactgggttttgtattagatcatcttacgaattgaccggtttgcagcttggataatcattatagctgctgtctatatataatgatattattgtatttgattctatagtgtaaataagctaaggcaggtttttgttttgtctgatctaattttgtcatgaagcaaaaatcttaaacatgatctgatatgactggtctgttggtttaggccgtttgtcctgccccaatttttgcaaatgcccatacccttgtgattgctctgtcctatgaacatccattccctgtttcaggtggatacaggacagccgtgaccagttcactaaggagcgcctggattccatcaacgacgagttcaagctgtaccgctgccacaccatcaagaactgcacacacgcctgccccaagggcctcaacccagcgaagcacatcgacacaatcaagaagctccagctcgaggcctgagtgagcagtatatctctcttcatgagatgaaactctgtcgaaaaattgtaatcagccagcctcttgtttctctgcctttttagtccatcgcctgacgaataattgctggaacgcaggattcccttctgggcctccgatctgatgacttccatttccatcagatggagggagcattgtagggagtgaataatttgctaccgtattttacgttttgttctgtatctaattcggtttgttgttcaccgtccattccattatgtcgtgcggtttatgcatgaagtaattcatggattttacctttgtttttgtgatgttgaacatgcccttcatatttttaacccggaaatcaacaagcattctccgtaatctctggttagtgatcgggtttagccatatagtgaatcttaaattgaagcaaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaaattaaagcgtgtaatgatgcatctaccaaatgctaaattgctaatggtgggatattccagataacactagaatgattcagacaggccaagcctcccaaggttttccatctcaccagcaggtgggacccacccccgttttgctcccagccaatggcgtcgcgaggcgcgagataaggctgcaaacctggagcacacactcgcctccttccatcgctgatgcagataagccgcgatcgcatccaccgttctagaaacgcagcgacattgcactcaccatctcagaaattgcatccaacagcagctgccatagttgcaagtgagctagagctcagagaagagaaggaagaagaaggcgtcaatggcgccccccatagctgcgatggccatgcttaagccgtccaagatcgtggcgcggtcatcgccggccccgtcggggagcggcagggtgcctagcatctcgctcaagagcctggccaagaagggcatgtcggtgttgtcgtcgtcgacggcggcggcgcccgtgtcggcggcggcgatggcgggcgcgttcttctcgggcgctgggcgtcgacggaacgcggcgctcgcggcgcagcagatcgcggacgtcgccgcggcggcggcgggtgccaacgacaaccgcgggctggcgttgctgctaccgatcgcgccggccatcgcgtgggtgctttacaacatcctccagccggcgctgaaccagctgaaccgcatgcggtcggagcaggtgctcgtcgccgggctcggcctgggcgcgacgacgggtcccgggctcgcgttcccgcccgaggcgtcgacggcgcagaaggtggcaaggctggcggcggagccgtcgccggcggagggcggcgacaaccgcggcctgctgctgctgttcgtggtggcgccggcgatcgcctgggttctctacaacatcctgcagccggcgttgaaccagctaaaccgcatgcggtcagactgagagcttgagcttgaagattgcatccgtacatgtgtgtacgtggtgtgttttgagggtggtggagtggagtggagtggtagtgacgtggaatgtggtgtacttatgccttaattaatcctgttcctaatcctctcttcccttgaacaaaaattcagtacagctcttcttcttatttgaattcatctagttaatttatttgtcttattgatcaatgtttgtttttgtttccccagtccggtagatgagcacacatgcacaccatagtacacttactagaaaaaaaatactagtggatcgacacatcgacctgtgaacccacttaaagtacaaataagtggataatcttaacatgttagtttcccatttatatgtttcctatttatatgtactataagtgaattcacgagccgactctcttacatccttcttacttaggtttgagtggattacttatttttcatccactcgaaccttttgaaaaaaaattcctatttctatgagagcacatatatagttttatcacagttatatagtttttacacttctatagttttgccgctgacaagtataatcgttatatcctgccctagtaaaagacgcgaatagtaaggaataacctaatatcaaataattaaaaggagtgatattttgaatccaggtcatctagcccaccattttgtggggatagccggaatacctctaggtatttctcatatcctgccctagtaatcttatctcatatatttatatagttcatcccactaagtgttgttaatgctatttcttttttctctcagtaagccacatcactctaattatttctagctattggatgatagatctatggttcaaattgtcacgtctttcttctctcataacaccaagtaatctcaattatttttaggccttaaaattcataagtatctatttgttttagttttaatattcatattgcatcttatttgtatatattattgtcagggttacagataaggcataccttttatcctacgacttatggaatataccgatatggtataccttcacgtatacggattgtttccatatacgttgttggaatctgttgcaaattacataaatatctctacaagataagtgatttccaaaatcctactcggaaggaatagatattctgttataccgtaccagatcaaatatctccaggccttacttgggggtcaagatgatccacggtataaaagggactccagggaggggtgcaaggcatcgaatttcatcgcctacacacccaccatagttcacgaggccggagttcacggcgccaagtcgtcggatcttgtccaattcatcaactacgatctcgccggtatcgtctgtttcgtttacttcctttgtaatctgtgattcctcatcatcaatctcatataaaccagactagggctattacctgacaaggggtctgaaccattataatccttgccttttgtggggtctgaaccattataatccttgccttttgtctgcttgatgtcgtactacatagatactcgtttcaacgtacccaaatactcaactcatccggtccatgagtaccactcgtcgataattatgcgacttaatttcccgcagcatcatgacggggtatttatctagttaaactaaatttcttgtgaattaaaaactgctacagagtagggggaaaagaaaaataaattacagtacctagacggtcaaggtcaaagcatcgcatgcccttgcggctttgactcttggcttggaggaagacgcctgaaagccagtgaggctgagcagcaaggctgcctggctgcgtcgtcacacgccacgatgcgtcctcgtattccccatctccctcgtcccgcgagactacggccactactcctacgagagtacgagtacggaggccgcccttgagttttcctctcactgagaggggttgaactgtaaaacatgtgttgtacagtgaaacattttgacttttacctccttgttttgtttgggtgtatttatgtcctgtttagttcagactaaacttccctcaaacctttaacttttcatcacatcacatcacatctaaaacttttctactcacataaactcctaactttttttccaaactaacaactttccctaaacttctccccaatttcagaaactaaacacagccttagttcacgccaaaattaaaagtttgattgaaattgaaacgatgtgatggaaaagttggaagtttgtgtctatagaaaagttttgatctgataaaaaagttgaaagtttaaagaaaaagtttggaagtaaactcggcctttgtttgacccttctggccatctatcggatcgccgtgcccttgccttgcctgtatggacgcattgtcgtagtactgccttcgtgcagtgcagatcacatatatgcgccgtgatgtgtcggccgggatggcccaccacgtcagcatctgcacgttttgcttcatcatactgatagtacaggattacaggcacagcttagcagctactcctactaatagagagagaaagagaaagagaaagaggaacaaattttggagctagtaaaattgaataaattttggagcaaggtgaaacaaacactggataaaaaatatagtaaatacatatatgtcagaaagaaaaaaatagctgaagtcaaattgtactatcagaacatataatagttgtgttccatgtcaagctcgaaaataatttaggatactcacaagaaaataaacgatcgtctacgagtaaacatcatttccatgtggattcacttaaaacggcgttcttctatatctatacaagttcaccaaactaaggatcgacattgaacacataacagtcaaagacacagacatgatcgactatgctaacttccattcgagatctataatttcttaaaagataatttcataacataaaacagagtaatattctagagtaaaataggagctgatgactgatagtacagatccaacggcgatgacgtgaacatccaccctaatccatcacaaaacccccgtgattcccataaaaatcctcctctccttttttcttcctccgaccaccccaccacatcgagtacggcgggggaaaaggcgacaccgcaatccggccgcccaatggcgcgccgccacgtcaccccgactcgccacgtcagcaagggatcacggaaaagcggagagatccccctcactttccctccaaatagcttggctcgctgcttctcttctcccgcgctttttttgcagcgaggtccctcaggttgcgtggtatttgcgttggttgggaggggggcaatggcgagcggcggcgcgcggcggaggaagggtcgccggggagggagggggaatgtgaagaggaggaccaagtatctgagtcttagtcggttcttgattaagaaggaggaggaggaggaggtggtggtggtggcggtgaggtcgccggagttggtgcccaaggatgaggcgccgtcgtcgccggaggacggtggggatggaggtgaggatgaggaggaaaagccgcagatggagccgttcgcgctgcatcctgagccgtccacgctgttcgcggcggcgccgtcgctcaccgacatcctcggcgcctccgctggcggcggcggcggtggcgggggcgagtcgtcgtccgcggcctcgccgggcgtttctggcgggaaggagctctccggcgaggaggatgacctggcgcggcgcgcgctacgggggcgggagcggtgggtgtactgtagcagctcgtccccgagcgcgacgaccaccaccaccaccacgacgtcgtcctcgtgctcctccgcggcgagcacgggcgcctcaagcggcggcgccgcggcgcggtcgctgctgctgaagctcgactacgaggagatcctcgccgcctgggcgggccgcggctcgctctacatcggcggcgccgccgccgccaccgccggtggcacggacaacgccgcggcggagctggagctcgactccgtaagcgccccactcgccccactcttcttggacacgccccgtggtgacactgacaccggcggcgcatgctcgtgcaggtgttcgtcgaggtgtcggcgtcgcctgagcccgcggcggcgccggcggcatggagcgtggcggagccggcggcgagggcggagaaggtgaggcggtacaaggagaagcggcaggggcggctgttcgcgaagcggatccggtacgaggttcgccggctcaatgccgtcaagcggccgcgcctgaaggtgaccaacttatctcaacctgaactagttgctgcatgcttcataagttcagaaaaattcttacctgaactgagctgaactggatttgctcatttattgattcttcagtaattgtctccagtcccataaactgtaaaagacttgtactttgtagtgtaaatgattcatcttgtcatcttggatttggcatggaccagcattatcattccgaatcagtttagtctaactggttggattcagtttattatcttcaggaattactgaatactgaataaggaatgtaagcatggaactttggtagggactaggaatcgaacgattaattaacttggaggcaacaggattagattctacttcttagtagatgtaagctgctgaagtgtgggtttcagaccttattgtataggctaatttatttctaatatctgaaaaaaataggttaggcatttccactatatccttttttagttagctctcatgatatatttctgtttttttgtctgaaattccttaataaagcttcagttgtctgctaattgcttatcagaagattagtacacttcaggcacactctgagcaaagccaatggatcatacatagtattgaacttctagtattaggtgataactgaactgaaaaacatgatgaattcacacatccgtggctggacatgttgatctttcactttctgaactagaaagcatcaaaatgcactttatggtttcactttctagctgatagaagaatctcttatgtaaaatttatgttcattgatataactgtgtgtccgcaaaccgacaaactaagaacttaacagtgttgattcatgaattgaaacctgctagactttgcatcctggaagtgcaagaaccatcttctacccatagtccatacatttcttttacttgatgaaactctgtcctgatgaaaccttttggcatttcttgcatcgctgcactgcagggccgtttcataaaggagaaggaaggcgccgcaatcacatagagaaagccagctccagctgcttacatagccttccctgctctctccaatgccatggtggatgcatcattatgcatctctccatcgcttcttcgcgtgtacatgatctgttagttattttgtttagttctccagtcctcatcatgtccaaatcagttcttctgccctggggctgcaagttgtgagccttcaggtgcagagatgcagtgtggattatgtctcataggatgaaaataacagcaattcagttcagttcagccatgatgtgcccaactgttcatcaacgatcagttcaacattttgtaatgtcttcaggtgctggttgtcgttgagagatttaatattggcttctccacaaaatagggcaaaatcatcttccattatttgtaaagaaccagtaatgccttatttggggaattcgagatttggacaggtaactgttgagtaccaaataatcggtgaaaatctagaaaactgggattgttatcccttgacttctagtttattttttaaaaaattttataactatatattcttaaaatttaaataggaatctatttagggagctagagattctttaaaaacctaacagaaactcttcaaacagaaccaataaactgacagaaactcttcaaacagaacgcaatcgaagggaattcatcaagggcaagagatgtcaggatcagaatcgtctaaccagtgcacagttcaactgatctgctccgtttaatcatcctggaaatggactgtattagcggagtaatagtattagttggtgtaatttttctgaagaaattactgatgatactgtagtatgnnnnnnnnnnnnnnnnnnnnnnnnnnnnnnnnnnnnnnnnnnnnnnnnnnnnnnn

SEQ ID NO: 24890 - DNA, 1181 bp, Oryza sativa
gcggtggagccgttgcatgcaccgttctgccgccgctgcaagtccagtgtcagctcacgtgagtgactcatggccccacctgtcagcgtgcatcggtactcagtgtgttgtccttttgcttgtggctgccaggtgggccccactggcaggcggtttggccgtgcgtggggagcagcattcgtggtcaaacttatgctgttcccagtaaaactgtaaaaaggtggtgtaaccaacagctttcgacctgttcactttgacgtaaaaaaaacattaccaatttttggtatagttgttaaaaattgtcaaaattttggcagtatttcttatatagttataaaaatttgacaataaactaaatagccattttttaaacaactttatcaaaatttggtaagattgaaaatggcaccaaagtgaacaggtacttcgtgtcgggactcggggtggtaaaagaaaaaagcgtgagatcagacggtgaatatcgaacggtggggagagagccgaggagaaatggacggttctcgttagcgttgttgtacagagcctcgcgagatgggctgggcctccgtggaatagtagaaggcccaaatggactaaacaaggccgctcatgtgaatacaagcacacggccttttttttaatttatgggcttttctgagagcccatcacttttaggacttggttagttcgcgaatagaaaatttttaggtgtcacatcgaacgtttgaccggatgttggaaggggttttagacacgaatgaaaatactaattccataactcgtctaaaaactgcgagacggatttttaagcctaattaattgtaacaccctgaaaattcgaccgacaaaatcaaaactctaaaaatacggattttcaaaaactttttaaattaattgcatcatgccgatcttattcgtctattttacctggatttgatctcgaagattattaatcgtgagtaaagaatagttaattaggagtaaaccgtaaaaacaaaattggtaaaatacatacaaattaaaataaagattaggtggggatagaaataaataaaatattatcgcgactatatttggatcaattaaatttaaatacgaccgctggaataagaattaaccctaattaaaactcaaataaattatataaaaataaaatatgagtaatattaatctagggtgaa

SEQ ID NO: 24891 - DNA, 11765 bp, Oryza sativa
aggcagaaaggcaaaagcaaagcgtgaatatagcataaggtactaactttctacgtacactgtccacaaccacaacatcaatagagccacttcggattaagatatcagcaagaccaagggcctgttcaccacagtctggttgagataataacaggtgttctgccttaacacctatagattctgctaatgttggatccagggcatgctcggcatcaataaaagcacaatatcctgaaacaacaaaatcaatttttttaaaaaaggatttattttactaacaggttgcatagatattgaaatctgaaggagcatgctttcacgggaaaactggtctacaccactgagtagtatgatattttgttctagcagcgagagattgtactcctaactttcttaccatttacttctgaaactaaagcctatttgtggacaacaaagtggaaataccaattgtatgttaattgttcaaagtaaagtacctatatttgcatgctgaaatagccagtccacactttctttcacttttcacagctcattgtcaaggccactggccaggacagacttgaaatggttgactgactcagataaatcaaatcaaagaatttctcagccactgtacaaatttacaggtaagttaatttattaagatattgcattactaatgcagtcttagactttttttcccttcacagctcaacctggacccatcaaaattagattattaatgctgtccatcgttttgcttatagttttcaagtacatggtgttaggcatagaggttagcactgaaaacttgatcattggcataaagtacttattttactagcttcatctaaataaagaacaaaatcatgctttaagaactcaaaactactatattggcatcttaattcactttttgcattgttagtcatggaaactagttcacagaggagatcagatgtataccccaaacaattatttacctccattcttctgtgcttcagctatgatatgaagtgctaaagtggtttttcctgatgcctctggaccataaatttcaacaacccttccctactgataaatgcaaaagtcaatgaagtgcaaaagaacaaatagcagaagataattatgaagaataatatcatataatttgctaaatggaaattcacttagaattttatcagttaaccaacgatgtagaatgatataaccaaaatgtacatatgcttttaactaatcttctgtttatgcattatttaacaaacatctcttaacataagtgagtttcagatttccaggaaattactaaatcataccaacaaaccctacagcagttttatttctcaaacatgcaggagagctgcgtatcattgattaagaaaaagaaagggtagaaaaccctgagtacacacacgttcgcctataccctacagaagcagttataatggagcaatagagctatcagaaaaaaaaagggcaactctatctgacatgctggctatggcgataaacaggtcagtaatgtttaaaagattaaattgcattggaacttcctaaatgttaattgacctagcagttttattttgcttgctagcctccctaaacttgcatccatttgctgttaggctcggattattctgttagcaaacggggaatagatgaccagtgatgcaaatgggtttaagttcaaagagcctagaaaacaaaagtcagctcagggagctaggtgagacaagtctacaaattcagggagctctgattcaatttactctttttaatagaaaataagtttcattaaactttcaatagtagaaagtcatttactcgtcctaaatagagcatgcatcagtgatcctggatactagaatataacaattattaaacaaaagaattaatacccttaactcaccttcgggagcccaccaattcctaaagccatgtccaatgcaaaggatccagtagatatgacaggaacttctttaggaccgtaagagtgatttagccacataattgactcctcaccaaatgcagacttaatttggtccaaagcttgttgtagcgcaaagtccttcttcttaatgtttgcctcactgtaaccatcttcacttgaatttgtctggtctttccctaaaaaataaaccatatatagagtcagtggtaaatctggatatatatacaatgaacaaattcaccaataaacttgacaaatgagatcggtattgttattttggaatagaattttcaagttatctggaatctggaaacaaactcaagatgcaatcatgtaaaattttccagaataggggaaccactaacaacgattcgtgttgtacataaaaaacaaaggttagcacatgaattcttattgaattggaaaaatattttcctataatgataattagctaaaactgtataacacttccattatgataactgataagtataaaacaaatatttctttcccatgcatgctgtacacatgccagctagattcccatgaagattttccaacgaaattaacaggatataaccatacgacaaatccagaaacaaaaaagtaaatctgtcgtaagaaagaagtaccatggaaaacataagtattacaagaggaaaaatttccagcaaggaggtatcatcaacctagcacaatgtcactgcattagagtgaaagaactaggcatttacgcaccttctgcagagaatctccacaactgaactcttggtgacacatttctattgcaggattccttcaaaaacaaaacagaaggcaataattatggcctgaatgttgatttttgtgttgagtcataaaaaattctttcaccgttctactaggagaaaacaagcagggctagattaagttgtccgctgttatagccaatccatgcagataaaaaaacaggtaattaatcgtgctgccttaatcaacatggtaaatggtacacaactccaagggcttgcagttctaggggataacgacaatcaaaaccttaaaagacctcaagtagtgggcactgcatgctcatcgtcaccagtatccatcacatcaggttcagaaacttgttatacccatatatttaccaatgcatcatcagctttcaactcaaagggatttcccccttttgtaaacccactaacccagcaacaatgaaaatccacaaaatctaagaaggatacaacgaaatcaacaaaaaaaaaagaaagaaaaagaaaaggaatcgattggcttcggatggctcgaggcacgcgagataacttccggaccacgcggccatggcccccaacgacgagcctataatggccgcgcatgcacgcccgacatgggggcgcccagctgtccgtcctgcagttgtgagagcgctatccccgcggctcgacgcctttgatcgggggctgcaaaaaaaggaaggggaagagggggagggggcgactcgagagggttggagacgacgaaccagtacaaaggaggtgggaggcgggggaggccgcaggaggcggcggaggaaggggtggccgcgccggaggaggagggccctggccatggccgccggaggaggctctccggttgcttcttcttgcgcttcctgagttgggccgatgatcgtggggcccgcgcgccggcgaaatttcgccttgggtgggtgcgcagcgggggtgtgtcgtgtgcgcgacgagattatgcgatgtggctggccgctgggtccggtctgtcggattgagggagaatctagaagtatttgccactcttccaaattgttactctcaaatgttatatgggcccacatatcagcctcacaaaatttgagacagtgacatttgagccctatcgaatgtgacattttctagtactacgaatctggactgtcccatccaatcttaggttcttatattttgggacagagggagtagtaaattatcccccattctctaatattggcttttgttaggtagccatacaagctatagctgatgcggctgctgcatagattagactctttttgggacggaggggttaaaaattagttgcaacaattcttaattattgtagttgcagctatagctaaaaaataccagtcaaacacaccgattataaaatagaaaaattaaatcattgtagaaaaaatggattttagtcattttaataagatctttcgtcctaaagaaaaaatatagtaacatgcttagaaaattctaaaactctagcctctagagtacacaaagacttgcacatatctttaatattctctcctcttcaagtacatagagacttgtacatagagacggcgagacggcggtgccggatctagcctccacggcgcaggagaccaccctcctaccccgagtcggtggcggctgggtacagtagagtggagacagcaatgaggacgtggaggcggcagggtgatggtggaggccacggatccggcacctacacaatggatctgtccggttgtggtgcgggaagaacgacgtcggaagggaggccggcggctgaacggggggcggccgcaatagcaccaatggtgtgggaggccggcgccgatggctaagcggcagtcgcgacaaggaggctaagggcgacggtcagcataaaggtgcggctgacgacgaaggccggcatggtgcacgaccgatggttactgaggccagctcaacgcataggtggagttgctggcagggaagggcagcatggtgtgatgggagtgcccgcaggacagcacgcaaaggctggacgggcagcgggcgttggttcagtggtgcccatgtgatgacggaggtttgatggtggtggagaaatggtgcatcacatgcgcataggcaagtggcgggtgaaaacctagcccggtcttgacctggcccgcaacaacggtgttttcgagtgtcactttccctcttgagggtgttgtcatgccgtcccatctcctctagtgggttgtcgggtgaaaacctatctcggttctcctttgagacctcgacagacggcggtggcggtgcttttatcgcttctctccttggagacgtcatccaggaaacccccttaccgaaacctcctaatcttcttatgcaagctcgctatagattccggttctattgtgtcggtgccctagtttacgcaagttggccacgtcggagggcctagggggagagtggttccattcttctctctcaccctctctccctcaattccaaagatgtggatagagtgtagttatgtgtcggttgttagggttgggtttcgggcatcctcatcagtagttcctttactggtctagcggtggctggtccggtgctagccttctcccgggcatcctctagtattagtgttgtcggggcgtggttgatggctattttatcttcattagttttaattttatagtaatttttttactatatcaatattctatcaatattaacttcacattgtatgagtcgttaaagaaaaatatcgaacggttcctccgttctatcaatatttttttacagctgcacgcctggacgcttcctccaccctcagagcaatacaaatatattttaaagagataaataagaagagagaagagcaacgggctacagatttgtagtcagctatagcacagactctaagacgcattgtgtgtatgatagttgaaaccggatattcagatattaatagtatagtatgtataatgagctattacattgactatagattaaattggagctagtagttagctatactattaaacttgctcttaccaccaactgccacctcacgtcccatcacacacattcacactccacgaccgcgagtccacgaccacggccctcgcgggctccgccgcctcgcgccacgagcccgcctccacccacaacccccgcgacctcatcccgtccctccacgtttcctctctctccatcctccaccgtccgatccacccacccacctcggaattcgtgccgctccacccaccgctaatcccctcatccatcgttgcctccgccaccccaccccacttcacacacacactctcgctctttctctcgccggagaagccgaggacaccgcacgcgaacgccggtgggtcggccccccgccatggggcgcggcccgtcgaagaagctggcaaagcggccgcgggctgcggcgcgtggggatcaggaggagggtgacgggaaggaggtgaaggaggaggaggaggatgaggcgctgctgttcccggtcggcgcggaggtggaggttggcagcgacgacccgggcttcgtcggctccttctacgagggcaccgtcgaggcccacctcccgggtggcgacggatacgtcgtcgcctacaccacgctggaggagggcggcgcggcgctgcgggaggaggcccgcgcccgcgacgtgcgcccgcagccgccgccggtggcgggggcgccgggcgcgccgggcgccggtgggttcgcgatgcacgacatggtggaggcgttccacaacgaggggtggtggtcgggcgtggtcaccggcctgccgctgccgctggacgtgctccccgtcgacccacgccggagggtgtacacggtggcgttcccgacgtcgcgggaggtgatggagttcgaggaggcggcgctgcggccgcaccgcgtgttccgccgcggcagctgggtcccggccgctgatgtggtaataagctgagctgtgcgaacttgtgtttcagggctagtcatttttttttcttttacagatttgggcagtactcattttttttaacatgatggtggtatagtgtaatttttagtctaaaatggagaggccatgcgcttttcctaaatgcccgtgctttgttacggataaaataaaatgtattaatgtgtccccatctataaaatgtattaatgtgtccccatctttttgctgtagggaatattcatcttaatctaatttttgtgtggttatcttggatttgatatttttttaaatgttaagaagttcacggggtaacttgcaaaatttacgatgatagtagatagggtggcagaatttaataagagtttgaatgtttatgtccgttttgtgttattacgccaaaagcttaacaatctacatgtcatgctgttcaagtagaagtggttggtacttgggagcaagaaggagataccacgctattttttgcacttacaatgttccaattttacaattgtacaatatggttagcttacccaactaatcaagtaacattttataatttaggaaataaaatcagatgagatatagtaaaagaaaccagttctagtaaacaatttttttgttcttggtaaaaaaaaataataaataaatatgtacgtcttcttttgtttgtagtattttataattgtttttctttttttaaaaaaaataaaatatttcgatgcgtttctgtgtgccaaattgacatgtcaatgagtctgtcttgacaatcaaacatggaagcataggaggaatcttgcataacatctaatgtcaacaaggtcgctatggttgctttgtaaaatggttgctaattcagctattattaggaatttgaatcataatgggtacaattgttagccattaggctcaatagacccaagtgagatgggtttggagaggactataagattgagagtttcatatgcaagtcaacgatgttttagatctgcaattgctcatgtatcagtgtataagtttgagcaccatttttccatgatcttaaaataacttttgtggataatttcacagaatttagcgcatctacatgttacataaagcctttctaaacaaacaagctttttttttgaggtaaacagacaacattgtaaaggcatagctttggcaccatcaatatgcggaataggttgtctatgcctcctgtggataattcattttcattattttaatgtaactctggtgatggttgtgtgaatgagttgaattatcacaaacaaaaaaaatacttttttatcatagaaaaaggtcaggtaaccttttgtgttacagtgtgctgcaatacttaatcctatgttcctatgcttttgttatgtgcaggacaatggaggtccagcattcagagagggaagcctagttgaagtgagtagatctgcggaaagctttggccagtcttggaatccagctactattttgaaagtgattggttctacaaatttcttagtacagtatagacacgtcggagatgatggggagctggtcacggagattgttgatactgaatatattcggccagcacgctcaatcattcgtatggactcaaaatacagattttctccatcttctcatgtagaggtctttcatgaaggtagctggtggcctggaattattttggagacttcaagtggtgtatttggcaagatgtatgttgttaaactgaagagttacacaacgggcatggataatgtggatggcgtggataagttgacagttgaaaatacaaaactgagaccacagtttgaatgggatggtcgaaaatggatgcgctgcatgacaaagaaaaaggatacaaaggcaaaggtacatattctctggctttttttttaaaaaaaaaagatacttctgctgtgtgttttacttcgatgatgatggaatgcttaaagttctagcttttatgtgcatcgtataacaattgtaggtagttatgtcatcaagatgtagttgtttgtgcactgtttgcaggactggttgcagtataatcctgttatcctctgtatgcattgttatttgtatgcctgtgcaaatattgatgcacatgaaacacaaaatacctagacatgcatttgaaatatgtatatttactttaattatagttagtctaccctctttctctgatttacataatggttttacataatattaactcaagattgtagaccaaataacatattaagaaaagactgtcagtttttatggtatttgctctgtttatttttctccatatttgatctccttttggattaaaatcatctctatataatgtgataccttttccatttcagaagcttgtcattagagggtctcaattaacctctcgaaaaaagccaattcctgctgacttggcatcatgtaatgacagtgatgaaatcagagataaaccaagctctgataaattgttggagactgcagatgtagtaccacgacctaaagaaactatgaagcaacaaaatgcagtgctggcattagcatctcagataaaacttcctttacagttatcaatgacaggatctggtcatttgaaatatacttcttcacttattctaggtagtcctattgaactaccatcttctcagatggatgtcatgccctctgtgccgcaaactgcagggctgcaagcttcactgtttggggtgtttgggaaactaagacctatcccacaggatccacttttagtaatgcaatcacctcatccagatctcagcagaaatgaaggatcaaaggcatcgactgatcaagaaaagcaatcaactgatgaaggctgttgtctgatttcaagtgctgcaaatagcttcaactttgtgtcatttgctggaattgatgtgtccagaaaaagaaaagaatgtgtttcttttcaagcacctgaggaactaggggtgaatcctgaaactctcagttcttttcacattcaggaggttctgtttaactcttctaaaccttctactgctgagcactgaattctctttttttcttgattaccttttacacttcaaatgcagatgaagaaaaacagagttgacgaaacaattgagggaacccacgacattgcagcaatctctgaagaacgtaagtttatactaaaccacgatacagaaaactcaaagcaagttgctaactaacaaaatgttgcagagaccaagctgatttttagagatgaacataatgaactgcctaccaatgttattgctggtccagcaattccttcagaaaaaaatcagccaactccacttgaagacaataaaggtacttgtgctcattagtcattactgaaaaacgagtcatctaatgcctatattttgatgccttatactgattcaggtccacgagacagtagcattgttgataaaatcagccaaagtggtataaacgatgttcgccaagatgagaaccttgtactgcatgcaacttcaacattagataattctggtgatgtgaatttgttatcttctgtttcttcaactgaaaaccagaagaaaatatccaaatctgaagggtgtgaaataagtatggatgaagactctggtgaagaattttgtcggagcattttggttatgcctgatgatactagaatggatcaatttccttcagcaaagagtggtcaagctaccaggcatgatgacctcatttgcaaggaaaacttgggagcaatagttgagtgtgtgacgaacactccaacagagaatttgtcttttttgtctccagctatgtttgatgatggggtgccgaaccagtcaccagtcagtgagaattgtcaggataacaaacaagatggcatggacaatgtggatcatggagcaaatgtggtggagttagccagtattattcctgaaactcagcatgccagtgttggtggtccactgtcaaccatatctttagctgcactcgagggtaaaacagtcctttcacatagtttaacgtgggagtctgcacttaatgaacaatctggagtttcacaacagtatcacagctcagccatggtagagtcaccagaatgtgttgctgaaagtagccagtccatcgatgattcgacaataactcagttatgttcttttgatatgagccaatgtattgatgctgaacttggtaacagcttgatcgtttcaaacaacactcaggatacaccaatatccaagtatgtagcaagaacacataactcttcctgccccttgatgcagaaatttcttcatgtgcatgagaatattatggttgatcagccatcagaatccttggctattattgaacttccgtttgtgaagacctccccgatgtgggcacaaattgaggcaatggaagtatttagtaaagtgccacaacgaccaaattttcatcagttacagcagcatcctccggagtttcgtgaagggatagcattgggtttgatgtactctttcaccaatttagcagaaagcataaacatgctgaatgtccatgacgataatgcagtatttgaacataagatgaggtgcatttctgtgttggaagcagacggcttcgatgtcaggcacctacgatctcgtttggaaactctgctcagtttaaaaaacagctggtccaaaatacaggatatgatgaaacgttcggagaagaagattgctcaagaagaaatcgatgatcaacaacgctgtgcagaaattagtgtgctaagtatggttgtccgccagcttgaacaacacgcccatctcttccgttgcataaagaaccgtgctatttcacagcagatgagccatgccatggagaattcaagactcaaagtagaagcaagccaacttaagcaatcatctatgtctaccgagcagcgcttcagtagtgtcgtcgctgcgccatggtaaggtttgtgcaaactaattggtatgcttgcgtattatttagttactgatggtatgtgaatattgctagatgttgtgagttactaatgctagtgctgctgaatctctttagtttgtgtgatggtttcttttggtatgaggagagcacccaacgtatgtaatgggtcgttgttgccctttatgcaagacatcttttgcttatatacaatgactactgatgtacatatagaatgcccagatgaaatttgtgtttttgt

SEQ ID NO: 24892 - DNA, 10546 bp, Oryza sativa
gaagatatcatcgtcatggcccttcaaccatcagcagatgccaaatcaaatgagctgttcacaactccatgacacaccggttcatattacctgtcagtcaggctgtgtcactactcacaacacacactttctgtttttattcatgtcatattcaccttccagtttttgttttctaatactacagggaaactatattctgttgttactcatgtctttattcatgtcatattcaccttccagtttttgttttctaatactacagggaaactatattcggttgttactcatgtcatcaaactctcgaggggacatctcctctcgttgtttgcatgtcatttaaacgattataaaaaatattgaaaaaaatcaacaagatagattaatatgtaatacttcactccacaaacatgcaaggttcttgcataagttaacttctacatgtgtaacaaaaaatatgactgcatatacgataattagctatagtttaatttgttttttctaacttgcagaaattgaattttaatttgtatgtttatggagtgatatatcacatagtatcttctcatttcttaaacttttttatgatatgcaaacaagatggagagtttaacctccattcccaatactacaggactcaaactgtagatacaagattgcccgatatttcagatctttcttcaagctattgcgtatctgtttttttagataatggtattgcgtatctgttgtctgctgagttttgactacctgtccacgatcaagggaaaaataaaaaaaagactatatacattacaagttattggtaaatatttctgcttgttactaacactagacgtaattaagcatagctcatttacattctaattaccatgttaatgataatctactatctctatctgcaccaaaaaaaggaaaatggttgctagatgtgatggtgggctaatgcttccggtatttggtcgttctctaacgaattttttttatttatacttttttttattaaaatatttacaaaaataatttgttgttttgaaaatttacaaatctaatcgcctgccgctctttgggagggcgatttttaaaaatcgcccttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttataaaatataaaacacattttaaaaaatctcagatctacatttcaaacgacattggatggagataaactttatataaaagttgtagatcttgatgatatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattcctaacgtctccgcgttatatcggcagtaaattaatacattacatattgacaattatctaggaatatatttatttaagagtatatatatatatatatatgacattcttttattatactaattggagacctttcaagaatctccttagaacatgtgaataattctaacaaactttgtacagttagaaattaattgacacattatactaaatgcacgtgctaccgctacggtaatatttaataattcaaaacaaacaataaaaaaatatatgtttcacaagaatgagatatatgctcaagattgattgaaaaaaggaacagtatagagttattatacattgtaaattatgtgtgaggcactcattaattttatccactttaatggggatcctaaattttggaaattaaattcaacgactaaaaatctcaatcttattttttttttcaaaagtttgcatcatgctgggtcttctcgaattttatttttttatgacagtgtcaactaaattcgaatatgaaacaaaatactcttttgaggaaatattctttccgaactctaattttctggtgggcctagcccaccttacctatactaaagcctaagcgcaacccctcttttttttttggatcactttgggtgtcgtcgagttcaaaatctgtccctgaaccgtaatactaggtataatccgttctcgaacttttaaaaccacaccaactttcaccctaagacaggatggctccctgttttgtttgatgtgacgctttgactatgctcagctatgctgagtcagtgtggaacccacgtgggccccatatgtcagtagccatctctttccccttccctctcttcccctcccgtggctagagggacgcccaaatcgaaccgccgtggcctacggcctcgatttcatgcctttggccatcctccacacaatcctctccatttctacctttcttgagctcaccaatagcactagagccgctccatttgcctccgccctctcccttctctctagtggcgccgttgcgctcggccagaacggcctccacacgtactccgccaccatggccaccctccgccggctgtccttgacacgtgcatcatcctccgagcaccccatcgcctctaccttcccaagacccaacgcctttgccaactttatgatgccaccgcagctctaccgcctccccatactgtcaaggcggtcgctacgcttggccactccaccgccgaatgagcgcctttcggacaccgcccgagattccgcgccatccactgcctcccaacctagctatggtgcgcaagcttggaggacgagaaaagaacaaaagagaacaagaaaagagaaggtggcagggtttgaaatttcggttcgaaatttccgaaattgacgctgttagtgatatgccctagaggcaatcatagagatgattgtatcacatactatgtttacatatttatccgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttggatagacccaacatgagacaatgcaagagccatatgtgttgtgtcatcagtgatctcatttagtgttggtgttgaatccttagacctgagattatcatggttcccaacatgcgtagtagcttacttagggactgctaaacgctactccgtaattggatagttataaaagtagttttcgggtatgctatgaaacatgtagtgggatatgaataatcaagatgggatttgcccctcctatggagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggtttatacaagtatacactagaggttcagccgatatgatctttatatatgcctggtgggtcaatacgttctgctaggggccgctgttgacgcgtggaccgaaaatgagttttcgggttacagccgagtatatatgaacctacagggtcgcacgcttaatgggctggaataaggggattggatagagatccaatatgagcttaatgcagataaggatccgaataggagtcctacgggctttggaggcccgagtgatggatcctatatattcgtgaggggtgtgaccggcggaggtattgcatcacgtgagaaaccctagccgtcacttccctccccgagcaaaaccctagccgcgcgcgggtgctagcacatctgtgcgtggcgttccgtccctgtacgtgtggataccggtagaggcgccactggtttgcggtgctgatcgtcgtaggagtacggcgaggagaacgcaggaggaggagaaggtcgagccggtgcgatcgactacttcctctacatcgacgcgcgctacttcgcgagagttctttcgacttctcagcgtcttcttccgctgcgcagcgcgtcgagcggtaacgatctatgatctaatacttgcatggttcttggtttacgcgatagaaatttttgatttatgctatcgtagcctacgcgtatcccaacagacgctgtccgcatcgacatgtctggcgagaggttacttgatgagcccattaatacatgggcaacaaagagaaagaatcctggagatgggcctaacagcaggaagaggaaggggaaagcaatggctgtggaagaggacgagtttgcaagtggtgatgacacggacagcgaaattgatggtagccctgtatatgcagagtcaggggacagtagttctagtgataatgaccatgaccatgatggagatgtgaatcctgaccaaagagatttacaagcaatgaaatctacaggtgcattttaaatatttgatgtttgtcatattggctgaaaggtgtgtgtatttctctatttgactaatgtatttctctatttgtaggtgttgagatgcagcatgctcggcgtacaacaaggaggctgaagaatgtcaatgcattggtttataacagtaagtattcagatcacttgtgaattttgtgaatgcccactctgaatttctaaagcatgcttgctgcttgctgcttgctgtgaattttgctgcttgctgctgaatttatgatgctgggctgctcgctacttgtaggaactaggaagtgaacaattggatgtgtacatgttaaaattgatgcttgctgccttgtaatcctgtatacatgttaaactgaattgctgcactgtctcatattcatgctcagcctatgattatcatctgtttaaagtatagctgcatattccccgcaaaaaaaaaaaaagtatagctgcatatatttgccattactccataaaactccatgtgagctattatgctgaaaaaatatatatataaaaggagctgctagtgaagcctgtaatatatcatatggaatgtgcactgactagtacatatatactttacttttttcagatcagacaaagaaaaagtaactccaacaagaattcactgagaatgaggacatggatgtccatgaatgactacttttggaagatgttgaaactctgttggattatgctattttgctacgttgagacaatttatgcttgtgatgtattattaagcctatttggaatgtttgaaatctatgttatggactatttgtcatatggactgttaaccctatgtaatggactgttatgtgatgaattgttaaaacttatgtaatggactgctaaagctatgttaccatctgttaaaacttatgtaatggactgttaaagctatgtgatgaacttgcgatggatttattggtgtatgcaactataatagactaattgcttccaagatgatttatttcttttgaaatcatgaattgtatgactgcaaaattgttctcagtgcatcccaaatttttttcccataaatttcgggtgaaattttcaaatttgaattcaaaaaatttcgtacgaaataattttcggaaatttcggttctatcgctcccctgcagcaaaaaacatgatttcgaaattgcaaaccctggaaggtggtgtatccccgccagtgctgcgacggcgggagccccgacaaggtccgggacttgagatgcggcatggtcgcggatgggggcagcgctaccacacccacgggcagctgccatgtggtgagcccccatgccaccaggaagctcgcagtggccctgctcgttggcgatgtgatggtgagacacgaagccaagcaccatacacctgcacctgcagctcctccttcacaggggcgccgtcgatgctcgggtatagccgcttcacctccggggatggtctgaatggcaccaccacggcgagcggcacgtccacagtagcctccacgaaacgcactggtggcataaaattgagcgagtgtcgcagtatcccatggccctagtcgtcgtcgtcctaggatgccggcgcgcgcgtccggtctaacaatctgagggagaagtcgacgtcctcgatgaccatgaccgacttggaccgcgtcgaggccagcagccttcggagatcaaagttggacatcactgtggtgagttagcaccaggtcgtatatgttcaactcgaggaggttggatggccaccacgaggctggtcttgccggtgccaaggtttgaaattttggttcgaaatttgtcccccaccgaaatgctcatatctcgcccgaaacttttggtttttttgcaaatttttgtgaatttggtcaaattttattcaaatccattcaaaatcagtcaaaattttaaaaaaattcgtacgaaaaaaatctgaaattttggttctatcgcccacctgcggcagaaatcctactttcgaaatttcaaaccctagccggtgctgggcaggtcatggagcaggtagccccgtgtccacacgcatccgactcatgcgtagtgctcgtgattgctcacgaactggtgcaggtccgctcaaatggtgtcgcgcagtgtcggatcgatggcgagtatttagtgattgtccatgccaccgccgctttcgtagaaactggaactgttggtgtggagcttactctcccacatcttggcccacgatgtcgccgcctcctcaagaatgaaggggatgtacacgtcatccatgacgttgcggtcacgtcaccataactcgagtcgcgggcacctttgctggctgccgatttggaccgggtgctacacgaacccacgggaggaggaagaggaggaggagaaacttcccctgaatgacgcgagctagcgttcccgttgcagagagaggatggagagaaatagagggaggaggactgtttgtgtgtgtggtgttgatgacatgtggggtccaccaatttttttttagaatgaaatgtcctaaaaagtgagtcccatgctgactctgtcgtcatgtcagccaaaaccggagcaatactgccttgggagctaatataacccgtttttataagtttggggacgggctatatatacctaatattatagctcgtggatgaattttaaactctacaacaaattaagggacctcaagtgaactttttcctttattttcttctcctatgctggcctagccaaacagatcagcccacaaaccaccaaacactagtccagcctaccaacatgtcccattttgctagactagcccagtctacaagccaatggccaagccgctgagctagccgtcggccacagcttgttccccattggcctcaaaggggactggccgctgtcaagctgcctattgacggtccttaagtaccaaatccaaccgtcaaatcctatataaacgcaaatgaaagaatataaaataaaataccaaacttagaggtagtggttattactaaccatttctacaagtctgggtgaatatttgtatgcaggtgaattatggagaaaacacacccgccatacgacaaaatacacatattgccaatcagacgtgagtacacggaatggagggcgcacaaatcatcttctggcgccgttgccggggaacggttgctgtatcatctacgaacttggttcatcctctatatttctttttctttctttcctcctttctcttctcttctaccacggagcagcctatctattcaaaacctttccgcttcaaaaggcgagttctctaagccactacctttcaaaacccatctggctttgaactccgtcctagctttgtagccatggttcgggagcactccttctcgcacagttaggaagacacatggtgaatggggagaactcaaaagcatgttttgtcttgctttcttcctgttaacccgtgatgtcttcctatggatggaaattctcggcttttagcagagtgagaagaagtctgcctcgtatgttgattttttcaccggaggctagtcgcactgcagaaggtagggattgtatcgtagagaacacctcccatcgtccgatgtgaaacccgctaggaagtcgagtatacccgttgaatccaagcctatacttccacatcccaaaattcaactgttaagccctcactcgagcctcgggtaccgaagaaagaagaaattctgcctctggaaatccttttctagttcgaggatgatcttttttaagattatggaagtacctcgacctattcccatcagaagagaccacctgtcccgtgtagtccctctgcgccgctcgaataacattttctcaaaaagacggtgagaggattgactaccatcatgagcgatgagtgcttaagggaggtcgagctttcttttgaagtaattcagattagcttcccatccttaattattcaatgtcttatgagagaggtcatggtgcatgatctttataatcccactatcggtgctagcttcatgtccgcaacctctgcattaacttacttaggggaagaaccattagcacccacagaaaaaaccttccatgaaaccacaagctattacatcttctccatcccgatcttcatcgtctcttcatcggactaatcccttggttgtacactcaataagcacattagtctcttaattgtttgtcatcaattaaccaaaacccactaggggcatagatgccttttcaatttctactttttgttgattgatgacaacacaattaaaacttacaaaagattgataataaatgattttgaatccaaatgttaatttgatctccccctaaatctgtgcatataaatatatgaagtgaacttatatgcacatatttttgagaatgtgagagcccccctaactctttgtatccatggggtgtattgtgtgtgataagagataccaaaagtaaaacaacagacaactcaaattcttggcaccgattcaaaaagtatcaaatgaaattttctatgccaattgattcaattttaagtatcaaatgaagcatgactaaccaaattttggaataaatttcaagtatcaatggataatctcaattgcatgtgacatggtgatcaaataataagcattgctccaactatataggatatagaaatgacttaaaaaacaacattttaagcttcatagtatttgatttggaattgcaattgtacataagacatgaatttattgagcatgagaagatccaatgctattgataggatatatagatatatatagaattagacactcttattttagaaagacaactcacaccccagggccctgccgggtcaccctcgggtaacctatcatcaccgccccctcttcctgttgttatttgtgatggctacaaataagtccgcaagtgcacggtgttgatgaaaaatatgcgcttggcctatggtgccagaactttgttggtgcgaactaagtcgacaacagcaatgacctaggagatctgcttagctccagtgcaggtccaaaaattgatgagatgcatgtgtgccaatcagtttgatcatgtaactagcaagatatgtaaacaatatatcaaatagcattgctttcagtattccccaaagatctatgaaactcttttatgtccatccactacttgccttcagcttcgttaggttcaaggtatctgacaatttggtgtgttttgccttgcatccggcgtatagaggcgtctccgagtcaccgaccaacctgctgaattttatggaatctctctcgttgtaagctgtgtcctcaacgtcatgtaatatgtcttgcatcagatcgtgatccacatcaaccatttcaccgcctaatggagaaggtacaaacatattatgctcatcttcattttcctaattttgtgctccacttctgtctgcagctgcaacatcgtcaagtgattcttgctctccatgcttcacccaacatgtgtagccctccatgaatcctcgttgtatcagatgagcatgtacgtccactctgctatcaaacatatctcatttttgcaatatgcacattgacaacatatgtaatcttgtttcttcttttcctatcctcctccgcggtgtttataaaatttaatactcaatttctatactatttgctatgacgtcgcacagttcttctatacatccaacttcgatccatcgctgcaaaagtgaacaaaatattagataaacattttgtaagataagtattactaaattaattggaattgattagtatttttcacttacttttatgaattttcttttttcttggaaaaaagagacaaaaatcgccccctcaatctcccaccaaaatagtgaacagtggaa

SEQ ID NO: 24893 - DNA, 37263 bp, Oryza sativa
  unsure (1)..(37263): unsure at all n locations
ttgaacaacttactataactgtgttaactatgcaactaatataatagctgtttcacacatcataggatggacaccacatgttttaactctacttgaaagctcttttaggccttaattttaactttaaaaagtatcacagattcaattatatttagaacttttttttgttttattacaaatacatgacaaatggctgtgttgtcctcagtctgtcttcatactatactagcaagagacacgcgctccgctgcgtgtggacatgcatagtataatccaaatgagctgagatgcatgttgaaggcatttatagttgtaaagtgtacatatacatggcataagaaaatcttacaatccaatattaaacacaacataaatcttttgatcatatatagacgaccaaacagcttgcagtgacacatgcattgacaattcggaaagaaaatagtgagatcttgatggaccacaaaactcgggttttcgtcaaatacacaaatgtattctcttgtagtcctaacaaaaaaacaacataatagtaaacttagtactgaatatatcaacttttaggacctgttcagattgtagccaaaataaaccttgcaaattttggtaagcaataccaaaattttggtaagttggcaatattgccaaaattttgacaggatttcttatgtatttactaaaatttggcaacaaactaaacatagccacatttttggcaactatgcccaaaaatggtatggttgaaaatgacatcaatctgaacaggcccttagataaagtgccacacattttcaaatagtaatgcaacctataaatctaaatagaactacttcaacgatttgtacaaatgtacaatcaatttatgactaaatatgacaatcagggaatgattgcactgaactaataaaacgttgacctgcaaacaatttaatcctctttaatctcttttcactggaccggcctgcaaacacaaaaataacaattaatccacaccatatattatttttctgtagttaactatattacacataaggttaacattttgttaactatattacacataaatatgatactagtagcagaaaaagaaaaaaaagcatggcaatatattggcttcaaacgtacgaacacggataaccatggaagatgtgggaggcctttaaatgtgaaaatatttcatgcggttaactgcactgaaatgagtgtgcttatacaggatatgtaagtaattgattttattgtgtgtacatgttgctgtggaaaaaaaatgatatacacaatccatacacaaccattagatgtcagagccaaattaatatagaccgatgacatgcactaatacatccttatgctaagggtacattaacaaatacaggcagaagaaaacgacaattccgaatccctttgtcatgttagaaaaaaaaatttaggaagaaaatgcccaaatttggctgttcatcctacatgtctagtatagcgttattgattcatggaaaaagctattcaagaataaaaattcgctgtggaggaaacttccaaattaacatcttaaagatgaatatgcgggactttgagccatagcctgcaactgcaagtttgaaattatttctagcttggtaaagtcttctcattctggttcttgttgataatgtagaaaatagagcaaatgttataaaacacttaatattaaattatgtagattggaagttgtaacctgaaaactggctccattacgtttattttgcaacagtgaatatgctagcggacatagctagaagcaaagcagaacttttatccaacctacctgatcacagcatcagtaagaaaattctaatgtgcatgccaccattaaaactcaacactgcgtaaatggcagcatgatgaaaacaggaacaaaataaattatttatgatgtccatgttagcaattaacattacctgaacagcattatctccataactttaatggacaccttgttcttgtccctcccaaccttatggtcatgctgtcatgaactgatccatggtgtttgcagatgaagcaccagtagatcaactaaacttctatttttgcatgcctgatactgcattactttcagtcataaacatcatgtgaaacctgaaataggaaagcgacgaccatttaccacccaataattagagcaagaatggtgcctcaaaatacaatttatgaaaaatgaaatagaaagatgctgcgggagaagcaaagcatccaccatagctcctttctaaattgaattgtttttaggcttaaatatgtgtcacatccttctttctatcaccatacaatgcatcatccactctttgttctgtagacaatttacagtgcacaacacacatttagagaacaaactatgggcagcaaaaacactgacacacacacagataaagagcagtaatacagttatacagcaagtggtaattcatgcagcaatcattcttatggtcttttacttggccaggttagttatttgctggcacctaaggaactataatagttaacataactatcatgagattaggtcggtcccaacagcaatcaaccaaggattttggaagaatgaagaaaataccaaaattttgtagcatgtgagtctcacggttgctttatgcagaccttggaagccttatcctaactgaatacagaagatgcatatccatctgtggcaagttaaaaaactgtcaattgtatgaggcatgaacaggacataagagaacacacagaaatcaaccaagattgtctatcatggatcgatcgaaggatcacctttgggatgtataaggaggtgggggctccggttgttgagcagatcaaggtgctgagtcagatctgtaaaaaaaacaggaaacgatgtgagtgtagagaatggagaagaaatgaggatttagcaccgtggaaacaggaagcccaacccagcttgcttgatccaatctttgcctcagaggtagaaggtggacaggcacacttgatatgtcggaggagttcccagtggagtccaatccagaggaaggaggctgcggccgtggtcggcgacactccacgttatagaaagcttgctggtggaagcaccaattgctacgaaggaaggaggggaactcgctgcgtgccttcctctccccatcccctctagctctcgccctctctctttccgtcttcatcgtcaatggaccgttggagaaggtgaaggcggcggcgcgtgacatgtcactgcacgagcgagagcgagggcgagaagcgcggcgcacggaggcgaggcatgagctggcggggagagaaaggccgcgagagcggcgagatcgacggcgcactagggttttggtggcgcttcaccactggagagatcaaggccgttcgttcgtccttccactgatccgagggctatggaagagccggcacagttgggctgggccaaacgaacgaccagcccaaagaaatggcacgctgaggaacgtggatggatggatttgctcctagccaagatcgaacggatcacagtagctgaaacccctgcacaattaaacagaagcacaggatgttttctgaaaaaatcgatgacgtggcaagctaatttttcaccgctcccacgacgtttagatagagtaatataacatttggatgtgatgacgtaataaattagttttttgttttgcactttgtgcatgcagatcgatatgtggaaattggtattgttgctggggttccagtctccataaatggaagaaatatctcagcagcattccttcttgtgtagctcaacaaaattggtgggaagcatgggattggacgcatcgatatggtggaaaaccgtcttgttggcatgaaatcgcacagtgtctatgagacccttggtgacaccataatggcagctgccattcgtgagctcgagtccctgacccttgatagggagatcatgcagtggaaagacattcttgccctcaaaatacgccaagttggtttatgttggccgctggttcgacccactccagcaatccatggatgccttcatggagaaggttaccgagacaacaactggttcggataccctcaagttgtacaagggttcactaaaattgcatcccggaagagcccctacagcctgtacggggaggacatttcctacagcatgggatcggacgcattgatatggtggaaaaccgtcttgttggcatgaaatcgcacggtgtctacaagacccccggtgacaccataatggcagctgccgttcgtgagctcgagtccctgacccttgatagggagatcatgcagtggaaagacattcttgccctcaagtacaccaagttggtttatgttggccgctggttcgacccgctccagcaatccatggatgccttcatggagaaggttaccgagacaacaactggttcggttaccctcaagttgtacaagggttcagtaaacattgcatcccggaagagcccctacatcctgtacggggaggacatttcctcgttcgagaatggaaagatatataaccaggcaaaaacgctgagggattcatcaggttgtatggtctccccacacgagtgcgggcagtgctggacaagggtctataagatttagacaaaatcaatcactactacaaaagtgatttttctgtacaagacctcttcatttttgcaaacggaccataactagtggcgtatgcaaaaatcgagcggcattttcgcagacggctgcttaatacgcctgtatgaaaaaatcgattttcccatacaagcctcttaagaggttgcatgcggctcacttaagcgcccgtatggaaaaatcgatttttccatacgggagtcttaaggagccgtatgcaaaaataaatttgaaaaatttaaaactagtgtatctcactcatatgaactccaaattggattattctttttcctaaatgtttctaaaatcatgctttatcatgttattatgttcttactgctattattttggccatttttttgtgactttattttatcaattaaaaatttgaatttcaaaactttaaaaaacattttcaaatactaaatgatttcagctgaaaaagtcatcaataacaaagttgtataactcatgaagatctataacttctattttggtcatttcttcatccgacgaagtgatggtaacatttgtacaaaatttacatatctctcttatagtttataaaacaatataagagatatgtatattttgtgaacaatcttataaatcactttatcggatgaagaaatgaccaaaataaaagttatagatcttaatgagttatacaactttgttattgatgactttttcagctgaaatcatttagtatttgaaaatgttgtttgaagttgtcataatttgaaattcaaattcaaactgtcgagacaaagtcatatagaaaaaatgaccaaaacaaaaaaagttgtagatcttgatgcgttttacaactttgttcttgacaatttttctcatttcaaatcatttattacccgacaaattatttgaagggcttccccgctcgaggacgacgacaatgacgaggagggagggctctcctcttcctactttcgcgaggcgacgaccaggcgggcgtggcgaggcggcggcagcgagcgggcgcggcggcgatggccaacggcaaccggcccccacgcgctcggatccagcagcggcggccgtcccccgcccagatccggcggcggcggccgtcccccgcggcggtgaggggcggcggctggttcgcttgccggcaggcgggcgggcggcgatttttctttttcttttttccttttggtttttttattccgtgcgggtggtatagtatgcccgcacgcgaaaataatgattttcacagacagcggtgtgcaggcgggccaaatgaccgcacggaaaaatagatatgcccgcccgggaaaataagttacgtagtagtgacggtgcttttatgcatggtacctctgctattgtagtactcctatgttagtaggatttgacatatgctcctagttccttctccgttttgttcccctgatatttttcccaaaaacatcacatcaaatctttggacacatgtatgaagcattaaatatagataaataaaaaaactaattgcacagttaggggggaatcacgaaacgaatcttttgagtctaattagtccatgattatccataagtgctacagtaacaaacatatgctaatgacagattaattaggctcaaaagattcgtctcgcggtttccatgtaagttatgaaattagttttttcattcgtgtccgaaaagcccttccgacatccggtcaaacatttaatgtgacaacaaaaaaattttcttttcccgaactaaatagggccacgtactccctccatacaaaatatgaagtgatcctaggaattttttagagattaagttcacagggaaaagactatgatgtgggtatgtggggagtaggaggatggttgggtaatattgagtgaaaattaaataagagatgtttagatgtgagaaatagtactctgaaatcctatattttaggaccaagggagtaatcctaagaaaatcagctcctattctccctttattatttggaaggcatgcctttcctttgactagttctatacatggatttaaaaactcactaggcaattgcagtttgaaaaagagggacgactaataatagtaacaatctatcaaccattggatccattgaatatttacctgtttcaaagtccacctattaaaggatcggaacaagtgattgcaaactattcaagtatggatatggatgcatcatgttgaaatgcaataattgatggaaggtactatgtagccagatagctattttggttgtgtatccaatctgttagcgtttaaatcttaaaatcatagatttgacagtgtccttttcgcccaacccaccggacctcaaatctttagacttgagctggtatccgtcaatcctagaagtacacataattgcatgtatagtgggtatgcatatgtctgtttattctgttattgactttgtgctaattgtgttgcaattaggggtgtaccgtagacacttaaaaaaacttcacgcaattttattggagttagttgagaaacgaacattaactgtactttactttgacatgtcttatttaaaaaaaaaataaaaaaaaatcattgttcaaagtccacttttgtaaaatcatgggtgacagtattttgtgatggtatgctgtcaccaaaattgtttatgacagccctctgacttttggtgatagcgaggggtagtcactaaatgcgtagagtaatactgacgcatttcagaatcgttctttttgtgtatatatattctaccccaagctcgcatagttcacacttttgtgtatgaggaaaatattttggaaacttttcactagtgtgaaatatatgaacgcctaggggaaattgatattaacctatgacgaaatgttttatttttttaaacttgttccatgatacaccacctatttccattttttgaaactgatacacctatttccattgatctgatctccaaaagaaagttttacagatctaggacgccaagcttgacacatctcatctcgctatttcagatcttacatgaaacttcatcacagaaaataatgaaggaccaaatttgtttattcatcgctttgatcacaccatgaacaaagaagggaaaccacagacgcatatatatcatatatgtatccaagggccacttctacggatagacctcaatgacacaccgaggtcccaatttcttcacaatcttgtagtccctgaagcctactttcatgaagagatctcgccaatcattctcgtcccgctgtcggcttttggtcaccaacatcacggccacatccataaggagttgggattccagcattggccctgaatcagaaccgactactatgtcgatgattatcactttccctctctcttcttggagcggaaccgctttcttgcattgggctaggatctttatgcagtcctcgtcgctccaatggtgcaacctaacctaaccatggataaaattgtgcaagtcaacaacacaaaaaaaaatagtgctcccttttataaatatatgatgatgttgatttttatttaacattcggttatttgtcttattaaaataatttgaataagctagcacagataaatttatgtaagtcttaatcttaatataaaatcaatcagaaaacatatatattacatattacataaatatgtgagaaaagtcaaaccttaatctaaagtcttcaaaccaaaccagccccgatctgctcttccctcagcgttttgcgctggcgtggacgctgccgcgtcgcgacacgtcagcgcgcgcgggaaaacggtggaatttcgcgagccctcgtgcctccgcgtcgtctttgaaaaatttgcagaaaagccctcgcgtttggtgatatttcgtgatagatgctaatcaaaagtttttttgtttaaaattattgcatttaagacctccaaaatattgaatattcaatacaaagaagagaaaatttggaaaataggactgcgctcggaaacatggaaactaatgggctatttagcaaaaacttttatccctaccaacccctcctccgaaaccctagccgccaccattcgctcctccctagccaacaccgacgccgttgcctcctcctcctcacgcccttctcacccccttacgccacgccgccgcatactctctcgcacctccctctcgccaccgcggggccggttccggtgtaggggagcccgtggccaccggatccggcatccacgacctccccgccggcggatctagccacccgaaggcgtgggctggtctagtataagaggctcatcggtagtgtcgatggtggtcctttctccatagcagcgagctccatggggaaagactttgctccttcattttcttcttccctcctaccccactccggcgcgtcacctactctcctcgcgccgctgccccctattctcctcacagtcacagcaccgccgatgcctcttctcgcacccaatcgcatcgccttacctccatgttgctaccgcggggccagatccgccggtgggaaggtcatgcccgccggatccgtcagccatgacctccctgccggcgtattcggtcgctcggaggcgagggctatcacgggaggcacatcggcaacatcgacgacggtcgtctctccatggcagcgcactccacagggaaaggctctgctctcccaccctcttctttattctcactctccctctcaccgtgatccagatccatagctgggtggggaagttgaatatgatctagagctggtggggaactcgtgcaacccccttcactgccggtccatcccatcccatgtgcggctgcgcgaggcgaagataagcgaagatgccgagatcgcggcattggccacggtccgtttgcagcttgatctatcttgattgattattttggttcatccggttgttgtctgcttgccaggatatggtggttgtctctttgtggatgggacatgatggatctagggattatggacaaggttgagtacaactacttcttggacatctctaaaatacaggcccgctcgtccctatgcaccacctactattgatctctgcaggtactttttcctccatccctctaccgcctactgcttactctgttgttgtttgtaacttatgtataccatgtactgactttaagttgcatcgattgaacctatccagcattaaaaatttttcatttttacactatgttgtcagattacaggatcccaatatctgaaaccacatattatatcatatctttcagtgtctgagtatctgagaccacctattatgctggatctttcagtgtatggaattctagccagtgtgcttttctctctttgttgcaattagcgatgacctgattgggagaagtaggtaaagctgtgctggctttgacatatagtagcgactcttgctgcatcaaacaagtgcatcatcataatatggatatccagggaggcctgctggacaatcaatgctgttgtggtggtgaaagtattatgcataacactccttattttgctatcaaaatgttaatcaggtacatcataatgtttttgctttatatttcccatgtgtgctctgatttgtggtggtttgccatgcaaatgctcttttcctcagtgtgatgctctgctcatccattacatggtatgctgattgctttgcttaacaactccatcgatgtggtagctaatttgtcatatgttcgcaatctcttgctttttatcttctttgatctaacaaagaaaatataaccttggtcattttagtaaaacaatctttttctactgagtacttacgagaactatacatctccacgctttagttaaatagaagaacataccttaattgacagtatatgcttatgagaactcgcattagtttttcccttaggatagctggcttcaaaatttatatgcttttttcccataacagcaagcttagatgcatttcatcctttcttgtgcagaattcaaagttcggtctccatcaaagtgatgtttaatatttatgacatatattacagatgcttgggcatgatgtgctgtaaatttagaggggtaagtccgtgctatcaaaacggaacatccaatagatttttggttccaaatactcagactgtatgtactttttcataatctgaacatattgagtgttttttttactttgtggccatctgtcctatcattttgttgtaggccgcaaaaatggagaacttctccttcacttgaatttctctattccaaacttgaatacttagtttaattgttcacttttgtttaataaatatcttgtcctttttggttagatcttagattacaccgtttaagatctaattcatttactagcagtgtacatactacattttattcattctgtgcttgtaatacagttcaaatataggactgaagttctggttttagtgctcctcttatccatttactagcagtgtacatgctacattttattcattctatgctggtaatacagttgaaatataggactgaagatatggttttagcgttttgtgtcaatcttttatgtttgactaatacggtgagtaactcattttttgaagcaattaagttggggctaaaatagttcttagatgcattagcacctaactgttgcctgtcagtttgatctaaagtgctcctcttatccatttactagcagtgtacatactacattttatttgttctatgctggtaatacagttgaaagataggactgaagttctggttttagtgttttgtgtaaatcttttatgttcgaataatacagtgagtgactaattttttgaagcaattaagttggggctaaaatagttcttagatgcattagcacctaactgttgtctgtcagtttgatctaaatgttttcactccacatcaacatggtggtatagctgcccactctggtcctgggaatggatggtgagttcatctaacagtacaattgcagaggtgcatgcagggccagccgacgagtggtccagctgcgtatgtttgatgcaaagtatttagcggtgttaaatctgattcttgaagttggcagaggcactaatcatgtttgccactcttccaaatgtgatactgcacttccatttaaaaatttaatcggacccttccatctagaaaaaaaaaatgatgctgcactcttgataaaaaaatctcttcaggtttgctttgtatatgtttagatccttcatgatttcagatcattgactgtttttggtgcaattaatacaattccttctaaatttgcatggaaatatagaaaagtaattggaacagaagttcacagctaaatttcttttggctaaacctggtgatgactgattattactattttgttagctcatcatgtagtgtgatatttgaaactgttcaataatttcctaggtagtctatctattttcatcctttgctgaacaatattttcattggtaccagctatgtgtttgtggaattgcttccttggcagcagctgtggaagagtaagaaaggagagggagttcagggcagagctgcctctatccaccgcagcggtacttccagcaaatcatggaccagcggttggtttcacgttgtgcctccacacttgcacgtccaccttcaaatccaagaaggcctccacaattgacaaggtgcatgtgctttcctcttgttgctttcttcatgcttgcttcattgtataaatttgaccaaaattttatttgtgaatgcataagaacaaaacactatagggttgtgttcattcaattgcaaatacgcccacctaaatgttcttggaagtggtttggctctaaatctgtcatggactaatgtgcttttggtcagcaaaggatgagaacccatatttgtagacatcaggaaatttaaaacaacaaatggattttccaatgttcttttttcttaaatatgcccgttaatatatggagtgtttattgatggggttgtagagtctatttgtaataaaatctgttgctagcctgacagttatgcactcttctcccttctcttggcagtaaatcatttccctatcacttaccctgcactccacatgtttgttgtattgcatcttaggacaaagagcagcctgaagaaaagggaacaatggcaatctgcaaaagatttatagcccttcatctggaacctatgttcccccccccccccccaaactattgagtactattttttacctcggcctcccttaattcaaggtaaaattgaaaatatcattcgaaggtttgtaaagtactttgtatttggcgtttgaatcctacatggttgcacaatttctgtacactatctcttaattttgaggaaaagttagtaattatttttaagacaagctagctatatgaagtttttaagatataacctctattattagctgttggttctctctggtaaaacaagtatgcagttaatcaatctgcccgttgtgaccttaaagcaaaagctttgcttacctatccttgcttttctacaagttaagttgaaataatagcatgatgtagtttatatgatgactaggacagtggcacggttccttgcgagacattttttcctcttttgaaacaaactacacatttattttagagtaaagtccatcaccggtccctaaacttgtaccgctgtgtcatcccggtccctaaactcgcaaatcaaccgctcaggtcctcaaactagtttgactgtcatcccggtacctaaacttgcagatcactcgtttaggtcctccaacttgttcagttgtgtcaccccggtccctaaataggacggtctaaaacctttatatcaaaaaataattcataactttttcatgtgaactctaatgaagacaacctttatatcaaaattgtagccctcgatgcgacctacaactttgtagttgaaaagtttttgaattaaaactgtttatggtcccaaaatattgttgcatgtttatagattttgaaattttaattttaaaattacattttgggacaaaaaatgacttaaaataaaaaaaattcaactacaaagttgtagatcgtgtcgaggactacaagtttgatataaagtttatcttcattagagttcacgtgaaaaggttatgaattatttttaaatataaagtctttagaccgtcctatttgacccagatgatattcaaatccaagtttagggaccggggtgacacaactgagcaagttggaggacctaaacaagtgatctgcaagtttagggactgggatgacacagtcgaacaagtttgaggacctgaacgatcgatttgcgagtttagggaccaggatgacatagcggtacaagtttagggaccggtgatggactttactctttattttatatagtacaagttatttgttcagcccatttccaaatgggctaattttgcactttgattaggcctttgcttatatataaacttttttacaatattctcttgctgctgttgctgagcctcttttctcattctaagctttcagcagggcagctttgcttttaagtaagtgacatattaacactgcagttgttaaactattggctgtgcaatactgtgctggtcgatttcgacacatactaaatgttgtgatcttttgatgagtaatttactttttttatagctgtaggaattggtggaagcacagttggtttgtttctgctcatcatcattttaggtgctcaacaataggcaaccaacttgcggtgttaccatgaagcttcagttgatgttgagtgttgtcctgcaggttgtaaccaaattatgactagcttgtaccttgtagtttcatcatattcctttaaacatactgatagtatctgctcacaaaaatattgtgcttgcaatgaattaagtgttaaaatcacatacctataatctatgtaaaagatgcacaacaccaatagtttaacgatagattgacatttacaatcctgtccatttcaactttatttgctgcataaatatgttgttggataaattatttggttcactttcatgattatgagaaaaatactaagagaacaatttagattgtttacatgtttgttgtgtttttagtatggataaatcattacttcggttttggcaatcctttttgtgtttccctgtcattgagatgtttgattgatttcctcacattggtctaagattggtacagtacctgctggtgctccttcggttaattcattcacagattacaccactactgcattcatccttacaatttaaacatacgccacaaaaataactccattaacttattttattcacattcagaaaaagaaaattaggaggggacgactaatattgttgagtagttcaacgccacaacattattggctctcaatattgacactaaaattgtatttttgcagcacttctcgagcaactatgcataagtggaagcaattcatcgtaccaaaaaatgtgccttctatttacacatcaacaagaaggcccttgcagtaaaccagcaatgcaatcctctgaattcatggggaaaaaggtcaattactgcaaaggcatccaaaccacattagaatttagccatctgtaatatagtcgtatgtgctcatctagcagaactgttgcaatgctactgctataaagctactatgtactgtatatcctgtcatcgtacacatggcaagttttgttatgtatttactgtcctcaatctgtatacatcatttagttatacttatacatgtccttcattgaacttacaaagaacattgtttcaactgcctacctcaacttatgtaatcactgattctcctaaatggcaccactggtgcagcgtgcgaagcacgcgttcgcctcaagttatattaaaaactttcatgtgttcagattaaattaaaggtttcaccgattcagaactagtgcaggtttcttttcgtgtaagatatatatacaaaatggattacgaattactcactcatgttgttaattaattaattaattaccttgcttgactcggtgggatgaagtcgaacatgtcacctgccacgtactcaacaacaccgtcggccgggacgtcgccgaccacacgggcgaggtccagcacttgacgtgcgggaaggcctcggcgatggccctcgccgccgtgccgtcgccgccgccgcagtcggtcagcgactcgacgccgtcgaacacgtcgcggcactcccggagaaccacggcgaacccggaggcgtcgtacaccctcaggccttcctggaacagcgccgcatcctccgggccaagcctcgctgtgctctcgagaggtgtcacgccgtggacgtgctcgaacggcgacggcggcgacggagccgggaagtcctccctgaaccagccggcgagccccgccacggtgtcgaggcagtgcctcgacgtcgaggcgagcacgtggggcacctggctgaggtggccgtcgacgacgggcacggcggcggcggcgccgtccacgaggaagaaggagaccggggtgagacggtacgtcgtccctgcatcgtcggaggcgaagatgccggagtggaccagcagccgcatgaggcggcggaggaaggggagcttggccgtggggagggacagcgcggtgacgaggtcgggcagcgaggcggcgccgccgtggcggtggatggcggtggggatgccgaggtggacggcgcaccggagagtcatggaggtgaggtaggagagggtgtggcgccacagctcggcctgcgtttgcagcatctcgtcgtcggtcgggaccaacatgcttggagcctgatcggatgctgccatttctgtctgctcgacttcttctctgagcttgaacgatggaaatgattgcattacttcctatcgatcgtctgtctgactctggcgcgattacgagggttataaatagtaatcctttcggtttttaataggggacgctattggctttaggatatacttatcatttatcatattataatttttatgcaaatataaaaataaaagtggttctaaattatctttattaatgacaaaaccaaataaaaataattataattataattttctttgaaaataagatgaatagtcaaatacaagcataagaatcaatgacaacgaccatctacttaacaattagaagtagggaacatatcctatacacacaaggtttccatacatactctatgcataccaatcagcaaatatcacgaaaaattctaaaaaagattggacttttcaataggcaaattcattatctatgaaatctcatcttcaaatttattatattttacttgtagaaaagacaaaattctgacagatttttactctgaaaactgtcagatctctcacttttttaaggctaaaatataatgaatttgcatataagactttgtaatactattaaaaatacatgtcagattctctttcgagaatttttcgtgatatttgttaattggtttgtacggagtgcatataaaaaacttgtatgcataggatatgttctatgagggaaagtattgtttctggtcatggaactaacgtctcttgcctggaaataaaataattggccatgacaccatcactgctgtaaagaattgagaattgactctacttaattaattttctacttgcattactatatgtagactctccaatgagggttgggatgcaagctaggggagtgggtagacataaaagtgttttgattattactgatgaaacttcaccctgttggcggtgtaccaatttctcattgtatggatcctctagtactgcgggaggatcaaaacttcttcgtgcaagcacaatactactacatcattgcgtgcgataatcttatttatacgggattacctattaattgttcgataaatttaaagcttcaaatctacagaattttcaactaatggatacaactagttttgaatgaaataagaaaaaaaggaacaggtcaaaaattgtaaatctagagacaaaaacagttataaaatttaatttcgtgctctgcaactgagtggaaattcattgtaactaagtgctccataaccaaatataagtgttctataattgggtgtaactaaaagttggatatggaaacatgaatcttaatgcagcttcatatggatgaaaaatcgaaagatagaagtgcaaaaatctatcatacgtgaaattgcaaatcttaaactgaaatacataaatgacaacatagtacgtcacagtgggtggtaggatctcatgatatttttaccgatgtcatccattttgcagataaatatcacaggtaagaattctctatcataatgtccctatgattatagcaactagtgtatgggttccacccttatattatctcacatgttagtatacttataatgatagtaccgttatgatacacagaggtcacatcatgtctgattctgctactcgctgtgttgctgtctctgacagcagggccccagatgcaaggcctcactacgtggccaatgcagcctgggctttgtcattgtaggattgttatttgttgccatacttgaaattgataacattcaaacgatagatttagtattttactcactgccaatatgttgattataaagttgcacgacttagttctgtttaggtgctcctgtcgatctataatggttggtagggccaatatctttgtaaattttggatacagagacgtataaggcttgtttgttagcagtactgtactatcgtaccgtggcttgtttgcagctcatagctggaccctgctttagggccctttgaatcgtaggaataaaaaaacagagaaatatgaaaaacacaggatactgacaagaatataattgtaaaacagaggattgcaaaacacagaaatggccgtttgattggaccacaggaaaaacgcaggaattagatgagagagatagacacagaagaaatgttccaagaggttagacctcttgctaattttcctccaaaatgtgcataggattacccattccataggaattttaaaggattggagccttcataggatttttttcctatagattgaaatcctctaaaatttctacatttttcctacaaatcaaaggggcccttaatcctggttttaatcctgcagacccaacggcctttactagagtaaaaaaagaaaaaaaaatactagtaagtaatacacgctacaacacaaatattaagagcaattagcaaagcaagctagagctgcgccaccctgcattgcatatttgcatatttctggaataaagccgcagtgtcatgcacatccattccccataaggccaaaaatccataatgatccaagagttccagaagtgagtgaaccctctattcaagacgcatatcatcaatcaataactctcctaaccccaccgtttttctcatttttttaattatttttgggctatctcattgttttacacgtggctgctacttctcctgctccttgcgcgcgcaggggcaaccgcccataagaggtgcgccggttaattaaaatttgggcgctgtggtggtgtgcatacgggttggggtggagggctgctccaggtgagagggctgggcatttttgtaaaaaactccttgtgtttgcacggaatatcgtatacgtcctcggaccgcctgacatcccgttgtatttcttgcgtataacccctcgtcttctaggaaaatacaatgcgaagaagagaaaattccgcttctaggggtagcgctgtaaacataaaaaccatagggggttttctacaaaacgtcctacactaaccccccaatcccgaaacccttcccccattctctccctctcctcccctcccacctctcctctctcggcgcgggttccggccagagctgccgccggagggcggtggcggcggcagcggcggctactgacggtggcagaggcggctcaaggcggtggctgcgcggagggtggagccagcggcggcttccctccctcctcccagatccggtgtaggcggaggtggatggtggaggcggcgcgtgccgtgtagggtggacgcggcggcggctccgccgggaggggggagggcggtggcggtggcggccctcccctctggatctggcgaggcggctacgccctcggctgtatccgccgccgccgctgtcggatctggcgaccggagaagacggcgcggcggaggaagatgaccgcgataggcgctggcgacggagcggcggaggccgacaggtgcggcaccatcttcgccttcatcgcctgccgcccttgcacgggacgtcacgtgtgcgtcggcgtcggtgcgcccctcccccttctccttctcctcgcggatccagtgttctctgtcctcgggaacggcctggcgggagcggaagcgccggcagcgcgcggatctggccgcctccgccctcgggagcggcggcggcgggcttaggcgggcgggagcgagcggccacggctgcggcagctacgacaacgacgacggcgacggtggctgcgacgacggcaatgatgctgacggcagctgcgacgaaaatgacgattgtctcctccaaccccggcaccgggccagccgtcggcgacgatttcacctgtctcgaccattccgccgcccccaaaagtatcctcccccacttgcgagaggacgagggactggctcagcatcgagccctccacgagtgtgcagcgcatcagatttaggctgccttctttcaaaggagattggggagattgtcactcgttttccgcacgcacgcttcccaaactattaaacggtgtattttttgtaaaaaatttctatatgaaagttgctttaaaaattcatattagtccatttttgaaatttaaaatagttaatactcaattaatcatgcgctaatggcttacctcgttttgtgtatcttcccaatcatctcgatcccctcaccctttgccttagaccatgtgtgtgtgtgcccgcgcgcatttcttggtagcgtttgtgatgctgtttcttggctatgctggattacatccccaccgtgttcgacaatttcagtgctaatgtttcagtggatgggaacatcatcaacttgggattatggggcactgctggtaaaactgattcttccattgttctactctcttctactgagattttatttttcctttttactcatgcaactgtccaatctctgaacatcgtgtgttcttttgtttgattcatccaggacaagaggattacagcaggctgaggattctgagctacagaggagcggatatatttgtgctagcattctcactgatcagcagagcgagccatgagaatgttctcaaggaggtaggtaccagtactccatttagttccgtttggactcaaaatgtctgaatatctgacagcatgaggatactgaccacagatactgtaccaaaaactttacctttcccttctctggtggcgacgttgggtcaggtggcggcgtcggagccggcgccggtgtcccccccccttctccctccgctcgcggcggtgtcgggcgggtggcgcgtggaactgatgccaccgggggaatccttagctcccacttgatgtttctcatgaggtatgcttcaattctgttgcaggaactcgaattcgatctatggccgcgttggggcgatggcggggctgattttattgggattttcctggtggatgggtgcaggatggagtaagaccgcgggttaaccattttctcactggacgggcgtctgttccaggtcgagtatgccattgaggtcatcaaggcgagttttctgcccttgtgtttttatttattgtatctgagtgagctggtgcttttaatcaaatctagaccggggtgaagctgagatattagattgtgtgataattgggggttcctctcttgggagaggttgagatgtttgattctgtgagaactaggggtttccaagggagaggttctagatttggcggatgagttggctttaaatttcaaatagggtgttgaattttttttaggatggactgaattgttaggtgcatgtactctgattttttggtgccaaaatctcaactgtagttctataaattttggatggtgttcgtcaggagttcttttttcatggttatcgagtgggctacgtctttagtgctattctgtttcatgtttcatttgtgacttgttacatgtaagtggtgctaatgttgctgatcctactgtagtttagttggggtcaactgcgatcatgttcaccacatataattgatgaccccttagatcataatgttggaggtatatgttaggttctacatccttctctttctagataagtattattgcaggtgtctaggtggaaaataaagtttgggaaaaaataatgatcaagagtcctccataacatatatagatatagatccatgaaacattatgatttgtgcaaaattatcaaactactgtgtatcatgatttcattaactctggtagttcagttcattgatgcacattgatacttgatagcttggatatgctgtataatgaacactggatggtgaattgaccaggaaagtgcaaaatcttgtgcttaattttcttcatttttgtaggctatctcaaaaggaaggcaaagcatagaagcacagaacattgttcgagtgagtgcatatctattccttcgttagtatgtacagcaggaaaattatgaaatcttggttcttcaaactgagttcttggattacctcttgcaactttacttggccaatatacgcctcaagaatgcagcaactgatgtagttattactgtatatgagccactgttgataaagtaagcccagtagatcactaattacgataaaggtgatggattaatatttaccttcattattcacatctgttatttcttttcagatggtcttatggaagcaacactatctcatgctcgttcacctaaacagcttaaggttattacattgattttggcattggctgcaccagttgtgtcatatgctggtttggttatttgcatggttgatgttgtaattgggagtattgtacgcattgatagatacatatattgagcttgcgacctccaagagggttctctgttttaagatatgctgtttttgtgataggactaaaaatactttgtaacttaactgctaatagattttataaggcaccatatcaattaatttaaatcaaccaaactgatgtgtaccttaaatttgcaggaaccctggtggcctaccaaattggcttggcaatgtagtagtctctgttgccattgctattgtcatatgttttacctgtgtgtatcttctttcttacgttcatatatcaggtaaaccatgacacactatatatatcatcatgctttgcttccctttgcagttacatcaatttctgtgatcatgtttattcgaaatctcaaaagtaggttctgcatcagattgttacacctgtcctgtccacgagattgcatccatccagaagggaatgaaaagagcatcaaggcatttttggcaaattattgattttgttcttgagcgtggcatttaccaatccattatatatatattggttttattacagtacaaagaaatcaagttcatgttactcggtgcattgttcatacagatgtataaaaatgttggtgtgatgtggcaatttgagcaatattggaccttgcttcttatggcattccagttggctgatgattgcagttacatgttgatggcatccttatatgtgtagttatgtggcaaagcttgtttaactgactattgtctttgtaacaaacaaccaattatccttactattgttactaaaaatgtatactctctccctttgtgatgctaactgaatcacatacttgattatatactggtatttctcatttagttactttcaactaactctatgtacacattgacgggcgtggcttgaagccgcgcttattcatctagtaccttcatcagtagcccacctattcctgttccgcgagggcacaacaaatagcttccagacgcatatcagtatcgctactcacattgacaaattaagctcaactttttaggtatagatcagcttacaacatgttcttacagagccagcctattttattggtcactgatctgacctgcggacagcttaacaatcacatgtttacatgacaaatgcacaaccttttgttcctatgaatgcttaatcctgtaacaatctaccacctaacagacatttttctgactaactcagctccttcacctgcgaaaacaagaatgctactcacttaatatttgaacaatacagcaaaaggtgaccgcattgttatgtcaatggaaggcagtgatacaggaagaaatacatcgaatttacctcaccgagtatcaacaggttcaacaggtgggtaaacactctctagtcactcttcgatgcaccctgccgaggatcatttcctgaggcagcggctgggaagtcggagaggcgaaagctaacaagagctggtccaagagcaccgattttccctgcgcctgcaaatgctgcctcagcatccatgcgcctcttgaagatcacctgagcgcagttagcattgtttgcagtctctgccttggcttcattgacgggtccatattggctaaagattttgataaggtcactgcgtgacggaacagcacctggcctgctgaagtgcagcactagtccagcaaatgaggaactttccgtttcttcagaacttactttagttccatttgcaacactcagttgtgtttctgcattcggttgcttgttctctgaaccttcaacagttggtccctctatatttcccagtgatgatgatttcatggcaggttttttaacatgttccttctttcttgttctgttcacacccttatctttcttttttctgagactagacagtggttcctccacattaatcagaatgtcagcccaataatcatcctgcatatgatcagccaagggctgttccaaaggagtgggctcagtgccggcagctttctcaggaatatcctcatcaacatcagaaaatgaagcacaggatccagtgttagttgccttcccatatatctccttctcaacatcagacctagaagcatacgagtacttcctgaaatcagtaaagaagttcatgcctgcactggaaaatctctcctttttcttaagattaaatactgctagggagagctgtgacagcatttcagaacaagacagggaattttctgtcaaggtatcagtcttgccctttttcaccttcagagaatgtgcagacttgtctggagcatttacttgtctttctttagtgctacgagaattcttctgagatactgcgccattagctttgcgaacgggtcgtgtctgtgacatttgtccagcagctttgtgcatcaattctccaacctttgtagtgctcttgcgggagacaggctgtggctgggaagacaaatcccccaatgtgtcaagtttctttcttttcctagtcttcattgtatcctccaaatcacgatcaggatcctcaagtttctcagttgatgcatccatagaacgcttgcctcgagccttgcttttaccaccagaagaaggattaggcacatctgtcactgccataagttcagaaagtttcttcttcttcctaccctgctctgagattcgcgcttctgaagctaccgaggtttcaccacgcgttgacctcttgccagaagaaacagaaacattggcattgccatcttcaagtccgtccccatcccctgtggttttatacttcttgcgtgcagagccagctctacgccccaccttattctccttgagcaaagcagtattcttctcttccacctttaaggattcagcaccactatcctttcccctgcctttcaaggctaccggggtgcctcccttcatgcgtgttgatcttgttctgcgtgctgatttgctgtcactcaaggtttcatccacagccttcttggacagttttttgcttgcaccaactgtttcaagcccatctgcatcttttgaggtgtttttgttcttctttgctgatctgttcttgttctttgacttctttgttttaatcgatgtatcatcagttgcccctttccttggcacagaacctttgtcatccatatcaagcccatctgcatcttttgaggtgtttttgttcttctttgctgaattgttctggttctttgacttctttgttttactcgatgcatcatctgttgcccctttacttggcacagaaccttcgccatccatatcaagcccatctgcatcttttgaggtgtttttattcttatttactgcactgttctggttctttgacttctttatttgtctcgatgtatcaactgttgcccctttacttggcacagaacctttgtcatccatatcaagcccatctgcatcttttgaggtgtttctgttcttctttgctgcacaggtctggttcttcgacttctttgttttacttaatgtatcttctgttgcccctatacttggcacagaaccttccccatccataatctccttctttccagcctccggcaaaacctttttcttgcgtgatgaactctcaccacgccttggcttcttctccatgtccatcacatcatccccaccacttttatccatccttttcctcttggtgtgtgggatcgccacagaaacatcctcaatcccctcaaaggtcacaaactcagggaggtgcctactaccccttgagcaattgaatgccctaagctgtgctttggcagttgtaagttcgagacggtcggcaccagccagtggattcattcccagagctaagatgtagtcaagaaatggtctaccatgatatgcgcccctcatgtacgcaccatctacaacagcaccataagccccttcacggatgccagaattctcaatctcttgcctcttgccaatgctactaccaaagcaggtgcatgagaggcctacctctacacggcgaccaacctcttgcagtgcagcatccacagcggatacaaaaccagacatggtgctctggctggccaggcgcgtgaagttgctgcagaatggcagaagtgaggaggcatcgctccaagcgaaggtcttgtcccagaaataggcgacaaggggagcgcctgccctggtatgcttcagcgcaagcttggaagcatctgcagcatcaaacacctggcccggccaccatgggtgactccgcaccttgccccagacaagctctggcggtgcaaaatcatggcctccctcatcctgaaaagtgcagtcatagcgcgcgcttccatggtttccctcttcctcctcctgcggtggcggtgatggttggttcttggggcggccagagcgagggcttttgagaagctgaaacaacccacaattaattagattctaattaaaaattgtatatcttaattcgatccatgcgattggttaaacaaaagaatggcaacttggttaaaaatttagaagctagaacttttttaacccaaattatatacaaaaaattaattagacatgatactattgtctaaattatacaaattgtggtaatacactaaatcttcaccatccataattagtacaaacatgagtataacaatattttgaggtataatacttaaaattacatcagtgcatacactttgtttagcatacaacaaactaagcagaatacaccgaagtataaatctagctttgccatgagttattatcatgtacagacaacaaaattacctacataaaagctctgttaggtgtcttaatctagcttaatatttcctctagcaatacccaaaacacttacaagtcaccagccatattatgtcatatagcagccacacatcaccaccatgggaaggagccacacttgaccttgtccaaacatcaacagccaacagtacaagcatgtatgcgcaaccatttctatacaacgataagattgcaggacgagcagaaacaagtagtagaggaggaagaacctgcgccactacatatccattcctaccctcttcatctctgcccccctacaagtatgattcctagaatccaaatcaacagcaaatcactatcactaactcaaatgtagcctaatcactctcctcgtagcagaaaaaaaaagagaaagagatgaaacactagatatattgaaattagggttccaaaaccccccacatcgaagcacacacaaggcctttgctcaaatttcacagctcaatacctgagaaagctcacaaagggtagcactagcacagaattcgaaccggagagaagagcataggcacctacctcaccgccggcagcgggtcggcgccgaccaccgcgctcgccagttacggcggcttgcttggagcgcctacggccggagctctccgttggtgtttccccacccgacgatgcgctgcgggttcgggctgcgcggcgcgcagagggggtgcgaacggcgtcagtacccatggcctatgcagcggcagcagcagagtttttagggtagggatttgggggaagaagcagccattagcaggagcaggatgtgggagatttgggggaaccgcctgctcccgagagccgagcagcagcaggacggttttgtctgtctcccgggcgaaagccgagctccggtgagaaggcggcggcggcggcgggtggggatgacgtcgacggcggatgctcgaggtcggggagagaggggcgtgctgtggatggggattgaccgcggagggacagctatacgttcccatcagtgggcttattgggctgttcttcaatggcttttcggcccatcataattttcttttttcacgcttaggtcctgtttggcacagttccacgtcacagttacataatagattatttgaaggttgtatgttaaattataaatgtttaagaattttagatttcatttaaaataaaaaaaatagtttattcatatgttaaattataaatgtttaagattttcaggttctatgtgatgtgatgtgtcatgtgtaaaatacccactttaaaagatcttggatctgaagctataccaaagaaatcattttagttgtttattgtctcagtgaaaaactatggtaatttcaatatgtttagaaaatcttttgtgccaataggttagggcaaggccaatgcttatggttccatcagccatatatgtgggacccgctatagtaagcattagttatgtccatatccacaatggctgtgcctatgggagaaaataagctgggtcccaatgggtcccaccgaaggataaaaaaaatcacttcttatcctcctgtgaaactctttgcacaatgaaaattccccaaaagtactagcgtgaacaacacatcacaaaagtattatattctatgttagagtttggatatattgcatgtacatttgataatactcccgtatggctgaggatagagtttgttgtgttagttagataagatatgatcaatctctgtagtttagctgtacacaacaaactctcaccgaagctatttatctcttgtaatcctgtcgcccgattgtggcattattatcaacacgtaacctcctcaccgtaggagttcctcgcttccacattctatagtcttgttgccacaccataaggctaatgcttatttttgatgtcagattcttatggtccactttcacaatacttaaggttactttcacaatgcttaaggtgatatactttatagtagtatgtatttgtaggaatcttcctgaattatttcacagccttcgtttcaaatttaaattggaacaaactctgtctagtttctccccattacctccttttagcccatgtccagagcatgaatatttcccggttttcgactcatcataatgttaatcaacaaatacaatatattacttaaactagttgataccttgcacggttgcttcagacattggtagaatgaaataagaatcaatttcttgcaaattaatttagaaaatgataagtttgagtgtggtagagcacaacgtttttttgttaaaagggatatgccaaaaggaaaaggatgctccgatggtagtaatctgtagaggaaattgtatttgttaccttaaatgatcaatgtcgaaacaagatttcggcaataataaaagggggtggctatcaagctagaaaagtggatgggtttggagacaaggaattttatacaggttcaggccttcttatttaagaagtaataccctactcctgtccggggatgattccgccgagtgtgttattgattgtatgattgggagaaaaaagaatcgtctcgagaggaacccggacccctccttatataagggaagggatctgtattacaaagtacagtccatatcctaacggaatatgggattacagataaaatacaatcgtaaccgactaggatcccgagtattttcttgacatacaagtttagaatctaacccgagtcctcataaagatattctatctatatttggtactgtatatccgactaaaatataactgtcatgcagatatggggtatccattatctccacagtagcccccgagaccttcgtagttgacgaaataaccttctcgaaacaaaaaccagtagtccgagtgcttcaattcaacttgctccagcttgccgagtagtaaaaatcagaaactgtgaagggcgaaaataaaacatggtgcatcgagtagatgcacctaattaggtgtagcccccgactatgtgaaaaactaaacatatagtcaagaaccgagtggttttatagcgaagcacgcatggtacttagtaagatacccagccgactgctcctcaactagaacatatcaaggacaaaaaatataaaaagggccgaatgataaacactcaaaaggtccaaaaatagatatatttggtaagaatccaagtaagaaactcttaaaatgatccaccaaatatgataaagatcatggtaattaataagttcattagcctaggctataacccttaccacaatcaaaataagcatataacatgctaggagaatgactactaataaaccagtcatctcaaattaacccaatagcttttgtagcctaaaaaggtttacaaaaatggtataacacctttctgtcgggcaccttttaatgtgcatcataataattccaaagaattattgaatcgcgttaaaaaggattttaacagcatcgggccgcatcatcgtgagcacatattgccaaagcaaaaagcgcctaagttcctagggatcacaacaggccacgctaattatagtattgggctgaagtactgtataggtccaggcccattagtactcccgataccctaataatgccgaagtgaaaaacggctcttcgtcttccccgccgagactctcgccattttcaacattccctgctacagtgcaaaactgcgccgggcaaactagggttcatcgatccgctccaatccaccctcaaaaacttcgcgaaatttctcctcgcatccaccgctccgattccccatccctttccagccgtatctcgaactaaatcagaccgtccagttcacattcatggcagaggaaagagaaagcttcgaaagtcagtgggcgccctccgatgtaacggaagacaatctgaaggagatggtggcgcacgtcgttcttccagcaaaagagatcatcgggtggcgaccggcatttggtgaggcattcccgaccccagatacacatgagatcgtggtattcgctcatttcttctatggcagattttctcttccaacctcaagatttttccggggaattctaaacttctacgggattagcttgcatcatctgaattcaaactccatagtgcatattgccaattttattcatgcctgcgaagcttttctgggcattaggcctcatttcgccttgttccaccgcatcttcttcctcaagccccagccaaataagagcaaaccatgcgtcgttgggggtgctggtttccaactcaggggaactctaagccaaaaatacttctccatgcccttcaagacctcaaataaaggctggcacgcaaactagttttatgttcaaaaccccgagcctgtccttcccgagtactcctgtcttcctccagtttatcaggatacttggaactcgctgccaatgggagatgaagccgcacaagcagtagaactgatggagaggatgataaagctgaaagaacagggccttcaaggagaacagatcaccaggcactttatcaagtgtcggttagctccaatcaaagaaagatctcgtacagccttcgaattcgacggcaagcatgacccaaaccgtgaagacccagattctcttgacttcaaggtcatgaaggaaaggatgtataagatcttttcaaacgccatcgttgtcagctactcacacttgctgccagtcgtaccgttcaatgcattcaatcctcctccaccggtacgcattcatacacttcaacctttttcaaaatatgatcgtcttcttgttgaatcagttaacaatgaaagatattatacccaggaatttgctttgatgaagtcggatcccccaattgctcaacgccaatctccccgccgccaaactgggcaagggagcggaggaccaagaattcgatccgaaactcaaccaagtgcttctgatccagtcggccagtcagattctcgaaagaggaagctggttctaagtgacgacgaagccgatgataccaccaggaagcctggagaccgagagacaaccaagaaactaccaaaacaggctactccaaggaagaaaacattcagtcgccctgcaccaaagatcaggaagtcttctaggtacaactcacataacgatctctcttgcattgatgcgcatccattgcggcaataacaccgataatcaaatttgcaggaaaccatctgatatagatccgtccgggaaagactctaacccgactaacgtagacacaagttcttccaaagaaaccggaccaactgctgaggatcatccgagtgacaatcagccggcaacggacaatgtagaacccagcaacgagcccccgattgggaaccagtcggccgaagctgaagtcggtgctaaccaggagcccccgaccggaaaccagtcggatgcaggggcaaacgaagagattccagaagtcgaaacccaagcagacaaccctcagggacaagacgccagcaatgaccggagatctggatctcctttaaaagcatctgagtccactcatcctcgtccagaaatcattacaggtaaacactttgtctgaaaccatgttgacccaaataactctgatcaattgtctaacctttgttagtgaatacattaggaccaataattggtgatgaagaagaaatcccccgtatacaagcagctgaggattcatgccctccgattctggtcaagtggtgggatgacaacatgcagcctcaagggatcgtgataagtaagaaaaaagaggacgaagagttatgcctactgaagaaggcactcggtcaggcaacacgcattgtaaatgtaagccctctggtacttgatctcaaccatctcgtttgccatttaattcatgcgctaattaaactgtcttgcagaggattcatcttaggaacgaagccaaaacggcaaccttagagaggttagtccctcatctcggaaccctcgaagccaccaggaatcaactgcacgaagtgaaagaacttgccaggaagaatgaacatgatctacgggatcggatcgctgagctccaggaatcaaattttgaactgagtggctcatcaaaaggtatgcacaaactctgctcaattgactcatactgttatctttgcaatcttgattaaccgtaatcaatgtagtgcaagctgccaagatatctcagttggagaagcaaattcaaatcctggaaaatgacaaggcagaactggcaagacaaagaaacctggctttaaaagaagttgaaggtatcaacaatcaatacctcaaaaaccattatcctccatatgctgacttattaatgtgaatctgttgatgcagaccgcaagatcaaatctcaagctcaattcgacgtcctggttggcaagataaaaaaacttgaaggatcccgggatgaggttgctaacgctgctgccccaattgttcaagcgatgttcttcaataacaacggccaagcgcacttgatgcttctgaaattttcgacaagctaagagttgctccggatacatatttcaagaacatcaaagaagctagaagtatgggagcaagtctggcgttggcgatgaccaaatctctttatccgagggttgacgttgatgccattgatggctttgcagacgggacgagcgaagaagttgctcttgacctcatcagtgatgcgcagaaagccgctgacaagattgctgctgatgtagttgagagattttaggacaccgatcttcgaccgactggtcctgataattctgatgatgaaaagactgatactgattaatgtaccaatgattttgatgattaatgatgatggaggcacaatttatacaatactgatgaatttatgctatgcttgatatcttaactagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaaggaaaaaacttgaagttaacagtcaaagaggaaagatacaaacgaaatgcctaagcgtaaaatcgatgaaggtgttcaatattccaagaattgttgatgagagtaccgtcttcgcgcttgagtcgataagaacccggccgagtgacttcagcaattatgaacggtccttcccataagggagataatttatgccgatcttgtgttgtttgaattttcctcagaaccaggtcaccgactaaaaaggctcgcaatcgaacatttcgacaatgataacggcgcaacgcttgcaaatatcgagtcgattgaattaaagctgcttctcgggcttcttctagtcggttgatgtcgtctactcggccctcttcatagccctcctcgttgaagttccgaaatcgtagtgattcaagttccacttcactcggcaacattgcttctgcgctgtaaaccaaaaagaacggcgactggccggtagcccgactaggagtagtgcgtaaagaccaaagtacggacggcagctgatctacccacttaccagcattgggacgtagtcggtcaaaaactcgtgctttgatcccttgaagtatcatgccgttagcgcgctcgacttgtccgttactcatagggtgtgccacagaggcgtaacaaattttaatgccgaagtcttcacaaaaatctttgaatgctccgccagtgaattgagtgccattatcagtgatgatccgattaggtactccaaaccgatgcacaatgttgatgaaaaaatctctagctttatctgctgtgatcgtgatgaccggtttagcctcaatccacttggagaatttgtcgatagccacaaagagatgcgtgtaaccgtcgactacccttttaaacgggtcgaccatgtcaagcccccagaccgcaaacggccaggacaacggaatggtttgcaactcttgggctggcaaatgagtttgtctggcaaaaaattgacaaccttcgcatgtccgcacaatcttgtctgcatcggacacagctgtaggccagaaaaaaccttgccggtaagctttgccgacaatggtccgcacaatcttatccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagctcagtctcatgaataatgtaaagtctgctgcgtctgaaaatccgctcggcttcatttttgtcttgagggagttcttgtttggtcaaaaattttacaagaggttctctccagtaggcttcaatcatgcttacgccttgagtatccatggcttcgactatctcttttctaggcacggtcggttcataaagatgttcgacgaacacatctgaaggagctgcttcccgttttgaaccaaaattggccagtctgtcggccgccttattgttatgttggaggacatgggtgagctcgagtccatcgaatttgttttccaacttgcgtacctcttgtcgataagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaaatgtatccacaatacgtagctcaatctttctccagtcggggaaatcaagacgaccccagctccagtgcctgtaagcctcttcgacccatcaaaatgcataatccaatattccatcttttcctctggcatgtcttcttggcactcggtccactcggcaaggaaatcagctaaagcttgtgacttgatcgaagttcgtggcttgaatgatatgtccaaagatatcaactctaaggcccacttcgcaatccgtccatttgcttcacgattgtgaagtatatctccgagtggaaacgatgtgactaccgtaaccaagtgactttgaaaatagtgagataatttcctaacggtaattaagacaccatataataacttttgaacctgaggatatcttgtcttggagtcggctaaaacctcgctgacaaaataaattggtcgttggactttttgaatatggcgctcaacaaccaggaccgtgctcacaacctgggaggtcgccgacacatataacagcagcggctcttgtggatgcggcgaggccaaaactggtggagtagtgagaagtctcttgaagtctttaaaggctttttgtgcttcgggtccccactgaaaattgtcagtcttcttcagcagcttgaagaagggcatcccccgctagctgagtcgtgagacgaaccggctgagtgccgccatgcaaccagtcagcttttggacgtctttttgggagcttggcggtttcatgttgaggatggcgttgactttctccgggttggcctgtatgcctctttgagataccataaatccgagcaacttccctgacggcactccgaagatgtacttttccgggtttagtttcatcttgaaagcacgaatgcttgtaaaagtttcttctaaatccgcgatcaggtcatccttctgcttggtcttgacgactacatcatcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24894 - DNA, 183 bp, Oryza sativa
aatagtagcatcgtcgtcccgcccctgcagcagcaactgcgcctgcgcgccgctctggctccgaatgtggcgcctcgccaagcgccactgcgtcgccgcgcggatccgggagctctggctccgactgtggaggagctccgccgtgcgccgtcctcgccgtcgccggcgtatgcactcaccgag

SEQ ID NO: 24895 - DNA, 13218 bp, Oryza sativa
  unsure (1)..(13218): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatgcccagttagccgacttggcttttcagggtatgatccctccaattagggagaaattctcatctgaggattttgaaaacttgtcccatcttagacagaaggtgaccttgcatgaacaaaggtttgtggaggctaggaagaattccaggaaggttaatcatgtatgtccttatatatatggatcggatgatgaagatgatgattctgagatagatgcagccgaatgggtaagaagtaaaatagttacaccatgccaatgggtaaagagttctgaaaagaggaaaggtatgactttgatatcactaaggccgacaagatttttgacttgctactccgagagaagcagattcaacttcctgctggtcacacaattccctgctgaataattgggcaagaaaaggtattgcaagtggcacaattctgggtctcataccactaatgattgcaagatcttcaggcagcagatccaagcggctattaaagggggcaaaatcaaatttgatgactctaagaggtcgatgaaggttgatggaaatccttttcctgttaatatggtgcatacagctggccgaacagccgatgggggccgtgcaagaggttttcaggtaaattcggctaagactatcaacaaatatcagaggaggtatgacaagcagcaggagaagcattatgaagaagatgacgatggctttgatcctcattggggttgcgagttctttagattttgttggaatgaaggtatgaggctgtcgtctattggggactgtcctaggtgcagtgatgttgcggagagctcaagccgatcatatagtaggggcaatcggctaaggtagacaagacttcctgttcatcaaaggccgggtccagtgaaccaagtacatggccaggaggacgatgaaaacagaaaaaatgcatggtgtccttctggtatctttacgaagaatcaaaaaagaagggttcaaagattgaggagcagggagcgctctcaggaagtcgagcaggaaatcaaccatcggctgaagaagacaaagccgaagcaggagtggcgtgttaagaatcaagttcctgtagttgaggaagccacagccgatgaagcaaaaaggttggccaaaggaaaaagtgttgtaactgctccgatcaacatggttttcacgttgcctgccgagtttgggaataagcaagccgatattgacgaagttgaagaagaatcggctaagttgattttgtcaccagagcaggcagtttttgagaagctagaggggacggagaatcggcatcttaagccattgtatataaattgttatgtcaatgggaagccaatgtccaagatgatggtcgacggtggggctgcggtaaatttgatgccttacactacgtttaggaagttgggcagaaatgctgaagatctcatcaagacaaacatggtgctcaaagactttggcggcaatccatcagaaaccaaaggagttctgaatgtggggttgacagtcggcaacaaaaccatccctacaacattctttgtcctcgatgggaagggttcttatagcttgttggttggaagagattggattcatgctaattgttgcattccttcaaccatgcatcaatgcttgattcagtggcaaggcgacaagattgaaattgtgctagccgacaggtcagtcaatgttgccagtgccgatttagctctttgggagatggatggtcttgattgtttacctggaaaagtttgggatggagattttctaaaagtgtccgattctgatatacagccaattgaagatggagaacccaagctattattttgagggcgtcgtggagagttcagaggtctgcaacaaggacacaatagatgatctcgatgacaaacaaagacagggttttatgtcggccgatgatttggaagaaattgatataggtccaggtgatcgaccaaggctgacatttattagtaagaatttaccggcagagtttagaaccaagttgatagagctgttgagagaattcagagattgcttcgcttgggagtattatgaaatgcttggactcagccgatcaattgttgaacatcggctacctatcaaaccaggggttaggaaacaggaacaacctacgaggagatgcaaagccgatatgcttgaacctgtcaaggctgagattaaacgattatatgatgctggttttattcgtccctgccgatatgctgagtgggtttctagttgaagatgcacttaaaccccctagtgggttttggtgattaatgacaaggtggttaaaggtgactaacgtgtttatcaaagttattcacggactttagtcccaaagcgagttgtgatggctaagaatgcaagtagaccccccaattcgaatgttcctaaagtgcaaagtcatcngaggtgattagactaggtttttcactttcgaaattgagtttaggaaaaaccgtactattaagaggggtttcaagtgtggttctagggtatacaaagtgctcttagtcatatccatgagtcaaaagatttttggaatcatttttgatcaatgattttctcccttggacagagagggctacccggaggttctggccggaacttccgggcaccgtttatttgcaaaaaatttcctaagtgctgcccgaaaattcctggcacttttgcccggaacctcctggcaggtttccagttcaaacttgtgagtaacggctagatgacgtcaccttgccgttatatatatggatttcgtccccaggtcaccttttcaccattccacttctgttcattcagtttctagggttttctagccactcccaagcttcctttgcttcctccactcaaatctagagcctatcttgtgagattgagagattagatgagagtgtaggagtgttttggagatggcttgaagattaggtttgattgagcactttggataccttgtgggctgtcacttgggcttattactcttggagatattctcctagacggttaggtgtcgcccctgagcttccaaagatcttgtggctgtcccgggaaagtttgtgaaggttttccacacctccgcaaggaaacgaggtaagtgagtaaagattcttgtgctgagttttcagaggttgtcctaggtagagcaacttgcacttgtggtcttttctagaagaaattttgagttggatcttggtggtcactcaattctagaaaatgacctaaagtgtcgagttgagggatgtggacctcttctgggatctttgcataagtgaggcaaggggttaatcgagacccggctctttggagcacctcaacggagagtaggattcgtgagatccgaactttgggaaaaaatcatctttgtctctcttgtgcatgatctttgtgtgaatctgctgatattctgcgatcttcatcttgttcctctgtgtgcctaaacttctcttgctaggacctggctttcatctcagttttaatttatctctgctgcctagaagttcctggctcaagaactccggaagttccaggctactcatcttgcctggaagttctggtcatcatcactaggaggttccgggccctgtcaatttaaccgatgcgattgttgagaaaaatcaggatagcctattcaccccccaactctaggctacatctctgctcgttcaattggtattagagcgaggtgctcatggttcaagcttcaccgctttaagtgatccatgatgtcgtacttagggggaaagaacggggaaaatggaaatgaagatgaagcaagcagcaagggaactccaccacccaagggagctactataccttttgattacagcaaacttaccattccttctcacaacttcgtctccgtgccttccgggcgtgctcctcaatttgatgggacatattatgccgcttggaagcacatgatgaaggtgcatctaatctctttgcatccaagtatttggaatgttgtctgtacaggtattgatataccccatgatgacatggagctcacttcagagcaagaacaactcatccaccgcaatgctcaagcttccaatgcaattctctccgccttgagtccggaggagttcaacaaggttgatggactagaggaggccaaggagatatgggatactttgcaattgacacatgagggatcacccgccgttcgtgaggccaagattgaattattggaaggaaggcttggaagatttgtgatggatgacaaggagacaccacaagagatgtatgataggatgatgattcttgtcaacaagattaaaggacttgggagtgaggacatgacaaatcactttgtggtcaagagactttttggtccaagaaatcccactcttgtatcaatgatacgggaaaggaaagacttcaagagactcaccccaagtgacattcttggaagaattgtgtctcatgagatgcaagaagaggaaggtcgttgtcatgcccagaaattcccgaatagaattccaagcagaatgtgcattaaaatccccgtctaagaccggccggggtacacaaacgacaatgttgacattcagatccacgtcttacaaacatcataaacgtcttacataaatgcagaggaaaaatgaaagacaacaggagctaagccttgactagaactgtagcgggaacaccactccacaggcatcctcgacggcacggacgaagcatactcctcggagaaacctccatctgacacatactcgtactttggggttgggaaaaatagagcaagactgagtactacccactgtgctcagcaagtcataccggaataggggtatgatgcagggaattatcaaaggagagctagagtggttcatttgcataaagcgagcatttataaacagaagtttaaagaagaaaacagtcataataattaatcaatattaatcgtccactgtccaacgctataccacgttgcgacaggcccaaccatccacctatactatccaatttcaatagactaaactagggtgagactaatcacggtgaatctgattgaccgcccatatccgcgggcatggctattcgaatagttttactctgatcagaggtgtacaactgtacccacaagacacagccccacgacacgttttcgtgtgccgacatgccaccacgacataccggaaagaggccgagacaggacccttcgcataaccccctctaaccaagcacaccacacctcaggtttcacccccactcctcgcaatgcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgtgaaccggtccttaactgtcatgggtgcgaccagcaaaaccatgcacccacagctcaccatgtgatttattttaattaaccaacaccaaagcggtggcactaatccaacaataccattagaaccaacagtctaaacattaataggattttccccactgtgtactagttgaattaagcatggctaagcaactcctagtccaacgtctattcatgttataacccaagataacaaaggagcaaggtaccaaaatagcatggctgtaacaataggtaaacatcccatcataacattataaaacgatgcagtatttgaagaaaaacaatagagcatttgcaatataggatcaacatgttcaggtgacaagcatgacttgccttgctctgctgctggaggaacctcggcgactatttcgaagtacaccggagcgtcggaagaaccggaatctaagcgacatacaaagcaaacaatgcaaacaggctataagactactgaaatagagaacaaaaccatttttaatggattctacacatttttcttgatttactgagatttgaatgggcttaaacggagctcagatgaattagttatgaattttagaagattcattgtgtttattgctataacaaaaagtccttaaataatttattgcgcaacaactcccagggctgacgtcatcaagggggggtggcgccgacgggcgggtcccactggtcagtggctcgggagagaggggaaggggcggcggcacgtgggccccactcggcagcggctcaaggggagggcacggctggcaagcgggccccacggccccggctccacgggccggtgtaccggccaggcccggcatcaagccggccggccggccatggcaaagcggcggcgcgcgcatgcgaccgccggcgacggcaaacggcggcaccgacggcgggcggcggcgcgagcggcgacggccgaacatgacggcaagtgcgcgaagagggcggcggcgcacggggaaaaaagggaaggaaaggaaggggagggagacctcaccggaggggcagcaacggccggcagcggaaaacgagggaggcggcaaagaccggcgatgccgaggtgcggacgagcgacggcgacacctagggaaaaagagaggaggaattaggacggagggaaaccctcacggcgaccatccacgccggccggagtcggaggggagagagaactcaccggcgacatgagggagatggggtttcggtgggattccggcaacgctaagcggcggccgggaaaggtcttgcggcggtgaagctaggagtggcggtggcttagcgtggcgacggctctagcggcggcggcacacggccgtagtgcggcggtgggcggcggcgcaagcggcggcggcgcgagcttggtagggagcacgggatggagcggtgagagcggaaaacgagataggagggcatggggagcattttataggcggagggggaggcggacatggccgggaggtgccccgatttcgccggcgacgtgggggaggagagagagaaggtgggggcgattcaaaatcgaatcccgcccctctcgtgcgcgggcgcggcaggaagacgcggggagagggggcggtgacgtggcgtgggcacgggcgacgctgcgtgggcacagggaaagcggaggagtgggtgcagcggcggcggtttcggcggggtggtgaccggcgcgggcggcgggaggttgggggaggacccgacaggtgggccccacctgtcggcgaccccgggagaggagggaggcgggcgggcctggctgggcctcggcctatggtcggcccagcgggagaaaggggagaaaaaggaggaatgggcgagcggcccattcaaaggaaaagaaaaaaaaagaaaagaaagaaaaaggaaaaagaaggaaaaatgatttttcctgggattaaaattgcatgtgctcaattttaattggttaaaataatttcgagagctctgaaaattccactaaaaatcttgttagcgtatttcgacatgtagaactcaagaaaaattccacttccaattccgattattatttgtattaatttattaaggttttctcttgatttgcaccggcattttcttagggtgatttataaattcaattttaggcttaggaggagaacttcagggtgtgacagtcgtgaagtgagacaaatggtgaagaagtttctttgaaggcaaaacaagaagaagagtcaagttgtgaagaaagtgaagatgaagaaatgacttttattgtcaagagattcaagcactttcttcgcaagagtggctatggcaaagggaggaaggatgatgacaagggaaagaggcaatcaaagagagcatgcttcaattgtggcgaatatggccacttcattgccgattgtcccaagtcaaataaagctaaggcgaagggaggcaagaagaagccggagcgtgctcatgtggcggaggcgcacatggcggaagtgtggtactccagagatgaagaagatcccgaggtcaagcccaagcccaagtcaaaagacaaggttgaaggagaaggtggtgttgctaccgtcgccttcaagtcatcctcttcaagcaaggagcgtctcttcaacaacttgagtgatgacgacgacgactcctatcactactcttgcttcatggcacaaggccgcaaggtgatgactcaaaagccctctgaaacttctcttgatgttgattctagtgatgaggaaagtgataatgaattagatgatgtgcttaagagctttagcaaacccgctatgcaacatttggctaagttaatgagagctttggatagtaaagaacagtcactcgaaaggcaagaagaattgcttattcttgagaagaaaagaaaccttgccttagaggagagcttagctaaagaatgtgctaaaaatgaacaacttgctaatgagcttaatttggctaatggttctttagctagccttagggatgtcaatgaaactcttcaagaaaaatttgctaatttagacaaaagtcataaagatcttgaagttcaatttgccactctttggaatagcacctctcaaccaaatgtggtttctaattcttctaacccttctactagcaatggttgtgctaggtggtacaatattgatttgaactcttatgctactaatattgatgatatgcaagctcttaaaaagagaatgaaaggttgggcacattggtgaaatatggatgcatgaaggcataccattcattagatgccctttacaagaccatcaccgctcatcctaacaaggatggatacaggctcgggttttcgggtggaagtcctgtgtctaagtgtgtaatggtaaatgggaaagaatgcttgatgtttgtgagagaaggtaaagcaccacaagcaagtgaggtgactagtcttgtgagctgccagggacccggaacatccggacaaaccgggagaaacatccgggtgggagtctctgtctctcaaaaattcccaccaggaagttccggccagtttgccaggaagttccgggccaatgaccatgcacaagacatgaccggaagttccgggcacaatgcctggaggttccggaaagagggtctttactatgattcatatgtaatttccaaaaattcatagggcaaagtggttgcctattttaatgggaattacaatgatgagtaccgcacttgtgtgtgggtgccaaaggctttggtaactaacatcaagggacccaaacttagacaagtttgggttcctaaatcccaagcttgattttcttgtgtaggcatactcctccgatggttcaagttgggttgtggacagtggttgcaccaatcatatgactggagagaggagtatgtttacaagtcttgatgagtagaacggaactcgtgagaatattgtgtttggagatgatggtaaaggaaaggtaattggtctagataaaattgccatctccaataatcaatctctctctaatgttcttcttgtcaattcattaagctacaatttattatccgtttctcaattgtgtaagttgggttacaattgcttgtttaccgatgaggatgtgaccgtctttagaagggatgtctcctccgttgcattcaaaggcaatttgaagggtgatctctatcttgtcgatttcgatgtggatagagtgaatccggaaacttgtttgattgctaaatcctccatgggttggctatggcatcgtagactagcccatgttggaatgtggaatttggcaactcttctaaagggggaacacatcctcgggctcactagtgtcacatttgagaaagatcgtgtgtgtagtgcttgccaagccgagaaacaagttgggaatccgcatcctatcaagaacatcatgactacaacacgccctcttgagcttctacatatggatttattcgggcccgtagcctacataagtattggaggtaacaagtatggttttgtcattgttgatgatttttcccgcttcacttgggtgtattttctccatgacaagagtgaggctcaagatgtcttcaagcgtttcgccaagcaagcccaaaacctctatgatctcactatcaagagggtacgaagtgacaatggaggagaattcaagaacacgcaagtggaggaattccttgatgaagagggaatcaagcatgagttctccaccccctatgatcctcctcaaaatagcattgttgagaggaagaaccgaactcttattgaagccgcaagagcaatgcttgatgagtacaagacttcggatatcttttgggtggaggccgtgagcactgcatgccatgccatcaatcggctctacctccataagattctaaagtttcatattttcgtgtctttgggagcaaatgctttattttgagtaagaggccttgctcatctaagttttcacctaaggtggatgagggattcttacttggctataagtcaaatgcacatgcctaccgtgtcttcaacaaaacctccggtattgttgaagttacaagagatgtgacatttgacgaatctaatggctcccaagaagagcaagttgttgtacatgttgtagatgatgcggatcctagacaagcaattggttctaaggctattggagacatacgaccagtcgagacgcaggatgaccaagaagatagggatcaaccttcgtcatcgacatccaatagccctacaacaagtcaagagtcagttgacccggaagttccgggaccagatgatcggaacctccggacctccctaggctaggaagttccgggtccatctcccaggaagttcggggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtttcttctttggaaccaaccagggttgaagatgcacttggtgatccggattgggtgatggctatgcaagaggagttgaataacttcacttgcaacctagtatggacatcggtggagagacccgaccaaaatgtcatcggcaccaagtgaattttctgcaacaagcaagatgaacatggagtggttgtaaggaacaaagcccggttagttgcgcaagggttcacgcaagtcgagggtctcgattttggtgaaacattcgcacccgttgctcgtcttgagtcaatccaaatgcttttagactatgccgcttaccatgatttcaggttatatcaaatggatgtcaagagcgcctttctcaatggacccatcttggagttggtctatgtggagcaaccaccggggttcgaggatccaaagttgccaaaccatgtgtacaagcttcacaaagcgcaaaacgggctcaaacaagccctagagcttggtatgaatgtctccgagattttcttttgaaaaatagttttgaaaatgggaaggcggacactactctcttcactaaaaaggttgaaaatgattattcatttgccaaacttatgtcgatgacataatatttggttctactaatgcctctttttgtgaagaatttagtagtatcatgactaaaaggttcgagatgtctatgatgggtgagctaaccttcttcctcgcgctacaagtcaagcaagcacaagaaggtactttcatctctcaaaccaagtacatgaaggacattctcaagaagtttgggatggaagatgccaaaaccatcaagactcccatgcctaccaatggtcaccgtgatcttgatgaaaatggtaaatgtgtggaccaaaaggtttatcgctccatgataggatccttgctttacttatgtgcatctcgtcccgatatcatgcttagtgtttgcatatgtgctcgctttcaagcggagcctaaagagtgccatttgattgccgtcaagagaattctaagatatttagttattactcctaatcttggcttgtggtaacataagggttgtgactttgagcttttgggctattccgattcggattacgccgggtgtaaggttgatagaaaaagcacaaccgggacttgccaatttcttaggcagtcccttgtttcttggtcctccaagaagcaaaattccattgcattatccaccgccgaagccgaatatgtcgccgccgattcttgttgtgcccaactcctttggatgaaacaaactctaaaagactttggctacaacttcaccaagatcccactcctatgtgacaatgagagtgccaccaaaatagccaataatcccgttcaacactctcgaaccaaacacatagatattcgtcaccactttttgagagatcatgaaaccaaaggagacatatgccttacccatgtgagaaccgagagccaattagccgacattttcaccaagcctttagatgagaaaagattttgtgagcttaggagtgagctcaatatcttagattctcgcaacattaagtgatgggtaattggctaatttatagccaaacatgtatcactaaaatgtaaattaaaaaaaaatgagcttttgtgtcttgagatcacttcttggttgaagatggtcttgataccaggaatttagctcaaacattcccccctttatccaaaaacccttttgtgaatttttttgcaaaatcctttgtgtgccttttattgcgaaaatttggtttttatccccttcttgtggtgtatattgaccattgttatgtaatgttgattgttggctggtcatatgcatcataagtctctgcttgtccatagttccctatttcccctcgttgaattctcgtcttttccttgtttttgggcctgactgccctttatctgtcaggccggaagttctaggcctccctgtccggaacctccgggtgtcggggagtatatatactcaaggggagttagaagccctattctctctcctcatttcttctctctccccgacgccagccctagccgccggcacagtgcttctagtggtgattttcactttcatccaatcaaattcggttcttctccgtggattcatccacattggtggctgggaggttctttctgtgatcgattcgtagtttct

SEQ ID NO: 24896 - DNA, 5709 bp, Oryza sativa
acatgcactggctatttttgagacctctgttcttcatttttgccggccggaagttccggtgttcttgcacccggaacctccgggcgctttctagccagcctgtcattcttgcttctctcaatttttgcctaactactgcactccaaattgttgattcctgttacagtaagcactatgactcatgagaaaagacagaaagcctctcaggatgtgtccggtgatgagagtcctcctattcggttccctcgtggtcgtttgggtaaagagaaagttgttgagggcggcagtggcagtggcactcgtacttctcccaggtttacaaggcaatcaagcaaccgtcctgttcagattagggatgttgacagtggtcaaggaagtgatgcacctaatacaagaggacgggggagaggtggttgtcgcagttctagggctggaagggcatctcatgatttccctgtaggatctcgtgagaatcccgttcggctctacaaaactcttggttttgacaccactcctttgcaccacattggaagacccaagtccaactaccttcatcaacttgccaagtgtagaagagatcgtttgattgatccagagacacagcctgaggagtcacaagatcctcgcttaaggactttcactcaattggattggtataactcggtgattatggctagagaaaatccagtggttgagatgaagtggattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctgagatgttggggttagatgatgaggatctcaataggcccaacattcatagtgaagcacccctccccatgatcaagaccaagttcatgtatgcaaaggatgctcctaagacttgcatgggatctactcatggattgcatcccaactacaaggtgttgtactccatctttcgttggtctttgcttccaaaggttggaaatactactgctttgctatccaagcatgctcatctttcagtcgcatgcgctacaatcagcctcccttcagtgtgatgaaattgatttggtatgagatcgccaacaccattcttgagcctaagcggggttgcatctatgctcctttcattatgaagatgattgagacagtcaccggggtattctacatcaaagatgggcaccataatccttttcgccctcatgctccaccttcctcttctccagtggtccctcgatctgttccttctacttcagctggttcttctactagtgccccaccaagttcctcgagttcttctcccatcaagaaggcacttcaggcaattttctgtatgtgtgctaagactgccaagaaagtgaagaagatcgaaaggcgtcagaaggaagatagaagattggctgggaaagaagtgtcagatgattctgaggatgaggtctatgttgatccatttgaggcttatgaggcagcccacaacgttgccggtgaaggtctatccaccttcttcaatgaagaatcttcccattctgatgatgatgatgatgatgatgatggtgatgagggtgacaccgaggcagctgctgaggatgctcccactgatgttgatgagggtgtcactgctgctcagtccgatgagtctcatcactccggcgataccgagattgttccctctgatggagatgagtgatcctcttcttctcttcatagtttctcgcctttttggtgcctttatgccaaagggggagaaattgtgaattgaagggggtcatttaaatcctttttgctaccttgactgttgtctggtcatttggccggaagttccgggtcctgtgatctggaggttccggctaggcagatttcctctctattatctctctctatatggacatgtaatcgtattctattatggttggatgtaatgactgttagatgctttattatcctttatgtcagtaagttagaccatatggatgttgcattttgatgtgatgatgtgttcttttcatctatttgagtgattgccaagtcatctagtctttctttttacatcactcatcattcaagcactttcatctgcatctcttctttgataagggtagtgtgaggtttcttttgagctttccttcatcttatgcataatgttttcatttctagttcttgatatgcatatctttagggggagcttcacacttctctcatcattcaaaatttaaattctattatctttttatttactttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcgagttgtgatggctaagaatgtaaggagaccccccaattcgaatgttcctaagtgcaaaaatcatcgaaggtgattagactaggtttttcactttcgaaattgagtttaggaaaaaccgtactattaagaggggtttcaagtgtggttctagggtatacaaagtgctcttagtcatatccatgagtcaaaagatttttggaatcatttttgatcaatgattttctcccttggacagagagggctacccggaggttctggccggaacttccgggcaccgtttatttgcaaaaaatttcctaagtgctgcccgaaaattcctggcacttttgcccggaacctcctggcaggtttccagttcaaacttgtaacggctagatgacgtcaccttgctgttatatatatggatttcgtccccaggtcaccttttggccattccactcctgttcattcatgttctagggttttctagccactcccaagcttcctttgcttcctccactcaaatctagagcctatcttgtgagattgagagattagatgagagtgtaggagtgttttggagatggcttgaagattaggtttgactgagcactttggataccttatgggctgtcacttgggcttatttctcttggagatcttttcctagttgttaggtgtcgcccgtgagcttccaaagatcttgtggatgtcccgggaaagtttgtgaaggttttcctcacctccgcaaggaaacgaggtaagtgagtaaagattcttgtgctgagttttcaaatctttgtgtgaatcttctgatattctgcgatcttcatcttgttcctctatgtgcttaaacttctcttgctaggacctgtttttcatctcagctttaatttatctctgctgcccggaagttcctagctcaagaactccggaagttctggggtactcatcctacctagaagttccggtgttcatcaccaagaggttccgggccctgtcaatttaaccgctacgattgttgagaaaatttcaggatagcctattcaccccccccccttctaggctgcatctctactcgttcactagtatagttcttgttatcaagaaaaacggtaaggtcagggtgtgcattgatttccaaaacttgaataaagctaccccgaaggacaaatatgcaatgccggtagccgatcagctggttgatgctgcgtcagggcacaagattttgagttttatggatgaaaacacaggatataatcagatttttatggcccaagaagacattcataagacagcttttagatgtcctggtgcaattggcttatttgaatgggttgtgatgactttcggcttgaagagtgctggagctacatatcaaagagtcatgaattatatataccatgatctaatcggctggttggttgaggtctacattgatatgtggttgttaaatctaaggaaatagaggaccacatagctgatttaaggaaagtttttgagagaaccagaaaatatggcctgaagatgaacccgacaaaatgtgcttgtggtgtatcagctggccagtttttggggtttcttgttcatgagagggggatcgaagtgactcaaaggagtgttaatgcgatcaagaagattcagcctccagagaacaagacggaactacaagagatgatcggcaaaataaattttgttagaatgtttatttctaatttgtctgggaggttggaaccttttacaccattgttgagatcgaaagccgatcagcagtttacttggggggcagcgcagcaaaaggctttggataatattaaagaatatcttagctctcctcctgttttgattcctccacagaaagggatacgttttagattgtatctatcagctggtgagaagtcaatcggctcagtcttgattcaggagttggatgaaaaagaacgagttgtattttatctcagtcgtcggctcttggatgctgaaactagatattcccctgtggagaagttatgcttgtgcttatatttttcatgtacaaggttgaggcattatctactatccaacgagtgcactgtcatatgcaaggccgatgttgtcaaatacatgttatcggctccaattttcaaaggaagggttggaaagtggatattctctttaactgagtttgatctgtggaatgagtcaccgaaagagattaaaggacaagctatagccgattttattgtggaacatcatgatgattcaattagctcggttgagattgtgccatggactttattctttgatggatcagtgtgtactcatggttgtggtatcggcttagttataatttcccctaggggggcatgtttcgagtttgcttatactattaaaccttatgcaactaataatcaagctgagtataaggcagtgctcaagggttgcaattactcaacgaaattgaagccgatgctattgaaatcatgggggattctttgctggtaatcagtcaattggcaggagattacaagtgcaagaatgatacattaatggtttataatgacaagtgctaagaattgatgaagtaatttcggctagttactttgaagcatgtatctcgagaatagaatatcgaagctaatgatttggcccaaggggcatcggggtataagccgatgatcaaagatgttaaggttgaagtcgcagcaataacagccgatgattggaggtatgatgtgcatcaatatttacagaatccatctcaatcggcttcttggaaattaagatataaggcgttgaagtatactttattggatgatgagctttcttatcggacgattgatggggtgttgcttaaatgtttgagtgctgatcaggctaaagttgcaataggtgaagttcatgaaggaatttgtggtactcatcaatcggctcataagatgaagtggttacttcggcgtgcagggtacttttagctgacaatgctggaggattgttttagatattacaaaggatgtcaagattgtcagaaatttggagcaattcagcgagcaccagcgtcgctatgaatcctatcattaagccatggccattcagaggttggggaattgatatgatcggcatgattaatccaccatcgagtaaaggacataagtttatattggtggcgaccgattatttcaccaaatgggtagaggcgattcctttgaagaaggttgatt

SEQ ID NO: 24897 - DNA, 7071 bp, Oryza sativa
tcttatcggatggcttgtcatggatcgatccaggtccctccttataaacttgtttatgggcatgagactgttttgccatgggaagttcgaatcggctccaggagaacggaattacaaaatgatttaacagccgatgagtattataaccttatggccgatgagagggaagatctagttcagtcacgttttgtgagcccttgcaaaggttactaaagataaagaacgagttgctcggcattacaacaagaagctaatacccaaagattttttggaaggcgaacttgtgtggaaattgattttgccgattggaactcgagatagcaaattcggcaagtggtcgccgaattgggaaggaccgttccaaatttataaagttgtatccaaaggagcttacatgttgcaaggacttgatggagaagtttatggcagagcactaaatggcaaatatttgaagaaatattacccatgtgttcgggttaacgcatgatcggctaatgttgccgatacatgatagcccatgtgtttacatcgccttgagatggtcgatatggttatatcgcccttagatatttttatattgtaatcaattgtgatttgccgatgtacaatagccgatatggttatatcgcccttagatgttttcatattgtaatcggttgtgatttgccgatgtacaatggccgatatggttatatcgtccttagatgttttcatattgtagtcggttgtggtttgtcgacatacaaatggtcgatattgttatatcgcccttagtcgttttgtataattttatcaatgttttttgacattgtaaaattaggggggcacatacatggaaaattgcaaaatttttagcgaatttagaagttatattaattggtcagatcagcaacattcttgatagccgatttgagtctcgctttctgctcttcgatagactttgggagatcggccagctttctatgttccatatccagctcggcattgcattcttcaagttgtgccaagagctcaatcttgcgagtttcgggccgatcaatattggacttaatcggaccctcagatagctgatcaagtttggccttctcttcatgaaaaagctgccgattggcttagattgtggcttcaatatccttgcgctcccgacgttcggctagtcttagcttggccttctccagcttgaattgatgttattcaagatagactgttggagttagaatatcggctagctcatctgggattagagcttggatctcatgtagccgagtcctaattggcccacagtttaccaccaagttgttcagtgacgatgcttccagccgatgagatatgtcttcaagtgttttctttacgtcatcggacaagggaacctattaacgaccaaatttggtaatatcagtatcggagatgaagattagattgaagcgggatcgaagatgaagattgtcgcggaaacagagtaagaatcggctgaagtccggatcggctacgattggatcggccgagttggagttagacttggttaggtgatgcagccgattccaataatacgacttggtgtacgacatcgggttggattgaggtgcttcaagatgattgccacgcatggatagagtcctgggaaggcaattgtatctattaattaggacattttatgtaatatccttagagatatgcttgagcaaaagtctgccgtaaagacttgtggtatcttagagtttgttagagaaaatagtcgtgtccggtatggacatatcttgtaattctcgggtataaatagaccccaagccctatgtaattaaaaaacaacacacacgttcaatacaattttggcgcatcgccacctttttgctttagttttatttcgacgagttctcgctatcgggttgagctgcatcggtttcgatcttcaacaagaggtaaaacttgttatgatggcttgtgttctcgggattagtgcttccatctttatgatactctaatcttgtttacgtaattcgtcgagttatcatatatcgtacataatctctggcaatatcactatctaacctacaatcggctaacatctgttagtagagggcagctgattaggttagattttgatgttgatttagattatataagatatccaccactatatgaaacttccaacggcttgattgtctagatattgttcttcttttcatacttaatgctgcatcagttgagtttgatatattaagtcgtgcttagaatatcaatctctagcatgccttctgattaccgattagggtagtatcggagtttcagccgatcttatctgatttaaccatattcgctctatatgctttagtgacagggtaatatctacagccgatcgagtagtttagttctttattatctatttatagtcaccgatcgattcacatatgacatcggctcaaagataaatgatatatcatcggcacttagccgatcgactatcatttatagatttaaccgcgatctctttgtttctatttcttgttgattgcaggatcaaatcaactggcacgctaacatacccgaaggcgagttttggacctgcattggagttaagcagatctcccaggcctcgtgttttacatcaacacgcttttggcacgcctggtgggactgataagaagtcagcaagcaattcttcctcatggccgagaaaccaccgctgtcgccatcctcggttagtctaggcattgttaaggaaaagatccagaagttgggattgactgacgtcaatgaaggaaatgtcgtgcccattgatccagaaaaattcacacctgatcagaagaaagatttcgacgcgatgatgcagcaggcacgggatcagttcttgaactcattcatgcagactcgcaagggaacattggttcagaagtataaagtaaaggtagttgccgatgatactgggaccagttcttctaaaggtgaagacgggaaacaagctctggacggctcggcgctacagacggttctctaggaggtcaaggtgacaattctcagggagtccatggggttcaaggtgatggggcgcatggagttcaaagtgatggtgctcaggggttgcagggaggaaattttaatcaggatagcaatgcatcacaggaattttttaataacttccaggatcggatcgactatgttgtgcaccatgctttgatcaatcagtctagggtgttagtcaataccttatcaaacatgatgaagtcaatagccgatggttcaatagctgagcatcaggctgcaggcccagtttatttgcaagcaggtgtcttcccaaattatcggcctttgatcaccgatgctcagccatctattcaggcagttccccccattgttccatcagctcagccgacagcgcctgcatcgactcccctatctactccgtcagcgttggcaccaggccagctggtgaaccctcggttattaataagagaacagccacaacatagtgggcaggttgcgaatcggctaatgcaagatgaggttgctgccacgtttctgccacctcaacctactattgatccaatacagcagcagccgattcaatagacacccccgattcaacagattgtacaaccaattcagcagcaggttgtgcaaccagttcagcaaacgccaccaaggcagcagcctccgcggccgattcagcagacaccgttaagacagcaaatcgttcagccgattcagcaccaaggctcaatgagcgcatcggccgggtttgcgacgcctggtggacagcctgtacaacaatatttaaatcaagttgtcccagaacacttggttcaccacgtatagccggatggcacagtaatgcctcaagttgttcccgaacacttggcatgtaatattcagccaaaccttcataattaccagggggacaacttgaattatcaatatcagcctccttccccgcaagcccagtatcagccagggggactggctcaaccccagtttgcgtctcaatacagtctgttcgaacccatgcaacaacattcacaggcagcagttcagcaacgaccgtgggccgatgtcattgccgacgtaatgagggaacaatttgggcttaaaccaaaagagactataagcttgtatcggcagccttaccctgagtgctttgagagagttcctcttcccaatcggttcaaagttccagatttctccaaattttcaggacaagatggtgtgtcaacttatgagcacattagccgacttttagctcagtgttgtaaagcatcggttgtggacgctctgagggttaggttgttccggttatctttgtctggatcggctttgtcttggttttcctctttgccgtatgggtcgatcaatagttgggccgatttggagaagcaattccacagctatttctatagtggggttcatgagatgaaattatctgacttgacggtgattaagcagcggcatgatgaacctatgcacgagtatattcagagattcagggagatgaggaacaaatgcttcagcttgagtttaactgacgcccagttagccaatctggcctttcagggtatgattgctccgattagggagaaattctcgtctaaagactttgatagcttgtcatatctgatacagaaggtaaccttgcacgagcataggtctgtggaagctaggaaatgctctaagaaggttaatcatgtttgtccttacatatatgggtcggatgatgatgaggatgactctgaaatagctacagccgaatgggtgaggagtaagaatgtcatatcgtgccaatgggtaaagagatctggaaaagaagagaggtatgactttgatataaacaaggctgataagatttttgacttgctacttcgagagaagcagattcaacttcctgccggtcacataattccatcggctgaagaattgggcaagaaaaggtattgcaagtggcacaactctgggtctcatatgactaatgattgcaaggtcttcaggcggcagatccaagcggctattgaagggggcaaaattaagtttgacgactctaagaggccgatgaaggttgatggcaatccttttcctgttaatatggtgcatacagctggccgaacagccgatgggggccgtgtaaggggttttcggatgaattcggctaagattatcaacaaatatcagaggaagtataacaagcagtaggagaagcattatgaagcagatgatgatggttttgatcctcattggagttgcgagttctttagattttgttggaatgaaggtatgaggctgccctctcttaaagactgtcctgggtgcagtgatgttgccgagaattcaagccgatcatatggtatgggtagtcggctaaggcagacaagagttcctattcatcaaagatcgggtccagtgaatcaagatcatgaccaagaggacaatgaaatcaggaaaaatcagtggtgtccttctggtattttcacgaagaattagaaaagaagggttcaaagattgaggaacagtgagcgctttcaggaggttgaacaggaaattaaccatcggctgaagaaagcaaagccgaggcaggagtggcgtgttaagaatcaggttcctgtagccgatgaggctgcagccgatgaggcaagaaagttagctaaggggaaaagtgtcgtaactacttcaatcaacatggttttcacatgtcgatgtcgatgaagttgaagaagaatcgggtaaattgattttgtcgccagagcaagcggtttttgagaaactagaggggacagagaatcggcatcttaagccattgtatataaatggttatgtcaatgggaagccgatgtccaagatgatggtcgatagtggggctgcagtgaacttgatgccttacgctacattcagaaagttgggtagaaacgctgaagatctcatcaagacaaacatggtgctcaaagactttggtggcaatccgtcagaaaccaaaggagttttgaatgtggaactgacagtcggcagcaaaactatccctacaacattctttgtcatcgatgggaagggttcctacagcttgttgcttggaagggattgtattcatgccaattgttgtcttccttcgaccatgcatcaatgcttgattcaatggcaaggcgacaggattgagatcgtgccagccgataggtcagtcaacgttgccagtgccgatttagctctttgggagatggatggtcttgattgcttatctggaaaagtttgggatagagattttctaaaagtgtccgattgtgatatacagccaattgaagatggagagcccaaattgttattttgagggcatcgtggagggctcaggagtctacgtcaaggacacggtggatgatctcgatgacaaggaaggacaaggttttatgtcggccggtgatttggaacaagttgatataggtccaggtgatcgaccaaggccgacgtttattagtaagaatttatctgcataatttagaaccaagttgatagagctgttgaaaaattcaaagattgcttcgcttggaaatattatgagatgcctggactcaaccgatcgattgtagaacatcggctacctatcaaaccggggttaggccacaccagcaacctctgaggagatgtaaggccgatatgcttgaacctgtcaaagctgaaattgaacgattgtatgatgctggttttattcgtccttgccgatacgctgaatgggtttctagtatagttcctgttattaagaagactggcaaggtcaaggtgtgcattgatttccgagatttgaataaaactacaccaaaggatgaatacccaatgccagtggccgatcagctagttgacgccgcgtcaggaaacaaaattttgagttttatggatggaaataatcaaatctttatggctgaagaagatatccataagacagcttttagatgtcctggtggaatcggcttatttgaatgggttgttatgactttcggtttgaagagtgctggagctacatatcaaagagccattaattacatatatcatgatctaatcggctggttggttgaagtctacattgatgatgtggttgtgaaatct

SEQ ID NO: 24898 - DNA, 13102 bp, Oryza sativa
cggttgaaatggtgccatggactttattctttgatggatcggtatgtactcatggttgtggtatcggcctagttataatttcccctaggggggcatgtttcgagtttgcttatactattaagccttacgcgactaataatcaagctgagtatgaagcagtgctcaaagggttgcagttactcaaggaagttgaagccgatgctattgaaatcatgggggattctttgctagtaatcagtcagttggcaggagaatacgaatgcaagaatgatacgttaatggtttataatgagaagtgccaagaattgatgaaggaatttcagctggttactttgaagcatgtatctcgagaacaaaatattaaagctaatgatttggcccaaggggcatcggggtataagccgatgatcaaagatgttaaggttgaaattgcagctatgacagccgatgattggaggtatgatgtgcaccagtatttacggaatccatctcaatcggcttctaggaaattgcgatataaggcgttgaagtacactctattggatgatgagctttactatcggacgattgatggggtgttgctcaagtgtttgagtgccgattaggctaaagttgcaatcggcgaagtccatgagggaatttgtggcactcatcaatcggctcttaagatgaagtggttgcttcggcgtgcggggtatttttggccgacaatgctggaggattgtttcagatattacaaaggatgtcaggattgccaaaaatttcgagcaatacaaagggcaccagcatcggctatgaatcctatcattaaaccatggccgttagaggttgggagattgatatgatcagtatgataaatccgccatcgagtaaaggacataagtttatattggtggcgactgattatttcaccaaatgggtagaggcgattcctttgaagaaagttgattctggggacgctatacaatttgttcaagaacatataatttatcgatttggtattcctcaaaccattacaaccgatcaaggttcgattttcgtgtccgatgaatttgttcagtttgtcgatagcgtgggtatcaaatttttgaattcttcaccatattatgcacaagctaatgggtatgctgaggcatctaacaagagcttgataaaattgattaagaggaaaatttctgattatcctcggcagtggcatactcgtttagctgaagcgttgtggtcttatcggatggcttgtcatggttcaattcaagttcctccttataagcttgtttatggacatgaagccgttttgccatgggaagttagaatcggctccagaaggatagaattgcaagacgatttgacggccgatgagtattataaccttatggctgatgaaagggaggacttggttcaatcgcgtttacgagcccttgctaaggttaccaaagataaggaatgtgttgctaggcattataacaagaaagtggtgtccaaaactttttcggaaggtgaatttgtatggaagttgattttgccgattggaacttgggataacaagttcggcaagtggtcaccaaattgggaagaaccgtttcaaatctataaggttgtgtctaaaggggcatatatattgcaagggcttgatggtgaagtctatggacgagcgctcaatggcaaatacttgaagaaatatttcccaagtgtttgggttaacgcatgatcggctagtgttggcgatgcatgatagccgatgtgtttgcatcgccttgagatggccgatattgctatatcgcctttagttgtttttgtaatcggttgtgagttaccgatgtacaatggccgatattgctatatcgcccttagttgtttttgtattgtaatcggttgtgagttaccgatgtacagtggccgatattgttatatcgcccttagttcacaatataattttatcaatgcctatgacactgtaaaattaggggggcatatatatccacaacaagttgcaaaatttttgagcaaatttggaagttttattaattggcgcaaaggattgtcaagataaacattagaagtatctttaccgatcacaaaattcctaaggtctattacatagaaagttattgagatagatagctctggatagccaatatagcttttcgcctaatttgttctacttcttcaatggcttgagcatcttgagcgtcggttccagggataactttcagagacttggtcagatcagcgacattcttgatagccgattttagtcttgccttctgtccttcgacaacttgtgagagatcggctagcttcttgtgctccagatccagctcggcgttgcattcttgaagttgtgccaagagctcaatcttgcgagattcgagccgatcaatattggctttgatcgggccgtcagataacagatcaagcttggccttctcttcatgaacaagctgccgatttgcctggattgtggctaatctctgcttggccttctccagcttgaatcggtgttgttcaaggtagacagctggagtgagggcatcggctagctcatctgagagtagagcttggatatctgcaaaccttgcgctgatagaaccacagttagtcaccaagttgtctaatgatgcctctagccgatgggagatatcctcaagagtttttttcacatcatcggacaagggagctagagctttgctagtggtatcagtttctgtttcttcatcaagatagtctttgatatcaaatgagaacagatcggctaatacctgtagaagagaaaactgaagacaattatagatcagattgcatggtacagccgattgaaaaccttttgaaggtgatacttactgggatgttaggaacagcaggttgttcttcttcctcaacattgtgactatctgcagccgatggagtacaatcacttgatattcgttgcacaggagatgaagagggaggaggtggctgcaaaagaataaagtattatggaaggttgtccataagaaaaggatttatatgataatcttactggaggctggtttaaaggttgttgcagccaatttcttcctcacagcggtcttctttttttgcaaatgcaagatcaatgagtgatcggctaggaaggaacatgactgctagaggggatcaatgtaagtggtttaccctagaaaagtgagctggatcagaaggagtcggaggagttcgcttgggagaagccgatagagttcttgctatgtcactcacctcggctgcagcttgatcaacatcttcttcgatctgtttttcatccagagcttgatcaatggatggatctagggcaggcagatcatcagctagcttggttttcttcggcttggtttttcttctttggtgcctgagccgatggatttatagccgatgacctagtttttctcttcttgccgacgtcggctggttttctgatgagcccttgaaggagagttgaagtcctgggggcattatagccaataacaggaggagatggtccacccccgtttggaatcagccccagggcatactcaatatttctgccactattgctctggcgaggaggagagaactctgttgtctacaaattaaaaggaaaattagtcaagattagtcggctaaacaattattcagatgaaattaagtaaatcaagacatgcctgagggacaacatctggaaagaggtccgtcatgtacatagaagccaattgatggaataggtgcaatttccattcaccccaccatctgtcaaatgctttgctcctaaaggttgccagctctatgttgtcaatgttgcctagagggggtccttggagatttagcagccgatccatcattaaggttgatgaaatttcccctcggcactggatcttatcggcaaagaataagccgattgggagttggcccattcctagttgtctgcctgagctcattgggtgataaaactcataagaaacctggatgtttcttccttgattaatgccaacagggaggatacatggactgattgcagctgagaagatttctctgggtttctgatatttttcgtgattgatatcttcgaacctaaagtccaatggattctccagaagtgttgaatcttcgtagtggaaccaaactcgagtgtctttttggaaaccctcataaaaactacagaactagtccttgagcagctcagccgatagctttgctcctacatcggctggtgtggaggcatattctccgtatgatgcgcacctacgatgagtgtgttcttctccatcatcatctacagttggttccagtcttgggaatttggcttctgttatagatggccgattgataaacttcataactactagattcagccaagactgcaatagccaccatggtccacctgctccgactactgagccgacggccagcttagctgatatattgtgtagcatttggtacaaatagccgaggaggattttgcctaaaggaaattgtctctttgtctccaaggcttcggctacgaactgctagttggttgtagggccacagcttgatccacaaaagaggaatttttctagccacattagcagaaaagctacatgttctcgaggagtgacagaaccttggcccatatatgctgctacatagcctgaccagccacctatgctcttggtcctgaagtcatattgcttcttcgtgttcaagctcatagggttagccgatgaggtgacgtccagacccgtaatcattatgatatctatgagagttggagtcatcggcgcttgattgaacaagaaggcattgatggtgttggaccaaaaataggaggcagctgccattaggggctcgtctttagctgagttggctatggtgagatcaactgcttggccgattctgatttcatcccaatgaactcttttgctagccgacatgcgtttgaaccatgtgatccaacttttctcgggtgaggttttcttgagagatggccaggatttgaaagtgtttctccagtgacctaaatctgggttggtcagtctgaaaggaatcctattggttttgccaataacgaactcggtgggatcagggttgccaactgggcagagaaagtagtaatttgcgtgcgacaggttgggaattgcaactaggtatgagagatgctgcgaatccaaaagaaccaagaaggggaaaacaagataaggtgttggaagatcggtctgatgctgagaaaggggatctagccgatgggaacttacctcagcgtactcagctgacggcacggcaggcgggctagtggaagaagacatcgtcgcgggtggagatatggccggagatgaagtcgcctggggatcgccttgtgcgtcagagaaatcgccggagaagaagactacaaggttggcttcagcggtgaaaatggaagtaacgggataaatatttttcaggacagcagttagtatttaaagcactgaggataacggtcggaaaacggcggagtgcgaaacttgctcggagtcgatatgcggcaaatccgaaacattaccgaatattccggacttggggggcatgtgttaacgaccaaatttggtaatatcagtatcggagatgaagattagattgaagcgggatcgaagatgaagattgtcacggaaacagagtaagaatcggctgaagtccggatcggctacgattggatcggctgagttggagtcagacttggttaggtgatgcagccgattccaacaatacaacttggtgtacgacatcgggttgggttgaggtgcttcaagatgattgccacgcatggatagagtcctgggaaggcaattgtatctattaattaggacattttatgtaatttccttagagatatgctcgggcaaaagtctgccgtaaagacttgtggtatcttagagtttgttagagataatagtcgtgtccggtatggacacatcttgtaattcttgggtataaatagaccccaagccctatgtaaaaaaaacacacacgttcaatacaatttcggcgcatcaccacctttttgctttagttttattttgacgagttcttgctttcgggttgagctgcatcggtttcaatcttcaacaagaggtaaaacttgttatgatggcttgtgttctcgggattagtgcttccatctttatgatattctaatcttgtttacgtaattcgtcgagttatcatatatcgtacgtaatctctggcaatatcactatctaacctacaatcggctaacatctgttagtagagggcagccgattaggttagattttgatgttgatttagattatataagatatctaccactctatgaaacttccagcggcttgattgtctagatattgttcttcttttcatacttaatgctgcatcagttgagtttgatctattaagtcgttcttagaatatcaatctctagcctgccttctggttgccgattagggtagtatcggagtttcagccgatattatctgatttaaccatattcgctctatatgcttcagtgacatgttaaatccgccctttatgtcaggatcttattgcatttaagcatattaagcttttgtttgatatattatacttgttttagtatcctgatatagagtagtatcggagtattagccgatacatgctagatctatatgatcggctatgctataaacatatatagtcctgttattaatatatatttcgatccaagtgatttatactgtctcggcatggtaaccgatctatcccaattacttgatttaaatatatatatcgatatgagaactatatattggtaatatctacagccgatcgagtaggtttagttctttattatctatttatagtcgtcgatcgattcacatatgacatcagctcaaagataaatgatatatcatcggcacttagtcaatcggccatcatttatagatttaaccacgatctctttgtttctatttattgttgattgcaggatcaaatcaactggcacgctaacatacccaaagacgagttttggacctgcactggagttaagctgatctcccaggcctcgtgttttacatcaacagaaccaaagatttgttggtagtgtcttcttctgtttcttcatcaagataatctctaatgtcaaaagagaagagatcagctaaaacctgcagaaacaatttatggaagattgagagctaagtagatatagtcgatctaatcttttgcatcaggaggaaacttactgggatagcaggagcagttggttgtacttcttcctcaatatgatgactccccacagccgatggagttcggtcactcgacgattgttgtacaggggaagaaggaggaagttgtaaaagagacaagtgttatacaaaatcggctgaaatcaactagtaaatttaagaataacttactggtggagctggattgaaaattggtgctgccgatttcttctttacagcaattttcttcttctgcagctacaaagtatatgagtaatcggccgaaaagtgaaataattacaaaagagattgaagggagctgcttactcttaagagatgagtgggggcagaaggagttgaaggtgtttgcttgggtgaagccgatggtgttctttctgtgtcactcacttcggctcaacctgatcaacatcatcctcaatgtcttcttcatccagagcttgctcaatagatggatccaggacaagcagatcatcggttggtttaggtttcttgagtttggccttcttctttgaggctagagttaatgtatctgcagccgatgacctagttcttctcttcttacctgtatcggctggttctctgatgagcccttgaagaagagttgaggtcttgggggcattatagccaatgacaggaggggatggtccacctccattaggaattaaacctggggcatattggatatttataccactattgctttgatgtggaggggaagattctgttgtctgcaaaacaggaacaaaagattagtcaagtaatgaatcggctgacagttatgcagtttagtaatgacaaagtttacctggggtatgacattagggaatagatctgtcatgtacattgaggccgattgatgaaatagatgcagcttccattcaccccaccatctgtcaaagtttctgctcttgaatcctgccaattcgatattttcaatacaacccagaggaggtccttggaggttaagcagccaatccatcatcagagttgatgagatttctcctcggcactggatcttgtcggcaaagaataagccgattgggagttggcctaatccaagttgtttggttgaactcattgggtgatagaattcgtaggagacttggatatttctcccttggtggatgccgacgggtaagatgcatgggctgattgcagttgagagaacttccctggccttttggtatctttcatgattaatatcctcaaacctaaagtctgatggaagctcaagatctgctgagtcttcataagggaaccaaacccaggcatctttttgaaaaccttcataaaagctgcaaaaccagtccttgagcagctcagccgacagctttgctccagcatcggttggtgtggatgcatattctccatatgacatgcatctgcgatgagtgcgttcttctccatcatcttccacaatcggctctggcatcggaaattcagcttctgtcaccgatggcccgattgacaactttcatgaccatcagacttaaccaggtctgcagcagccaccatggtccacctgccctaactactgagccgacggctatcttggctgatgcattattcaacatttggtatagatagccgaggagattttgcccaagggaaattgtatctttgattctaaggcttcggctacaaattgccagttggtcataaggccgcaactggatccacagaaaagaaatgtttccagccacatgagtaaaaaggccacatgttctcgaggagtaacagatccttggcccatatatgctgccacatagccagaccaaccacctatgctttttgtccagaagtcgaattgattcttagtgttcatactcataggattagccgatgaagttacatctaaatcggtgatcatggtaatgtcgatcaaagttggagtcatcggcccttggctgaacaacaaggcattgatggtgttggaccagaaataggtggcggcagccatcagaggttcgtcattagcagaattggctatggtgagggcaagcgcttggccgatcccaatctcatcccagtgaactttcttactagccgatacgcgctggtaccatatggtccaactcttctcaggggtgattttctcaagagatggccaagacttgaaagtattctccagtgacccagattagagttggctaatctaaaggggattctgttggtttcacccatgataaaattagtgggggtcaagattgccgattggaccaagaaagtagtggttttcatgtgacgggctgggaatagcaactaagttggaaaggtgctgcaaatccaaaggaatcgggaagatgagaaaaggggaaatcgatttcatgcgaggaaaagggatctagccggtgagaacttacctcagcgtactcggccgatggcgcggtagacgggctagcggaagacaacatcgccacgggcggaggtctaactggagatgaaatcgcttggggatcgcctcgagcgtcggagaaatcgccggggagagaaaggagaaggttggcttcgacggtgaaaacagaagtaacggggtgaagatttttcagggccgcggttagtatttaaagcgctggggataacggtcggaaaacggcaaagtgcgaaactcgctcggagacgatttacagcaaatccgaaacattaccaaatattccgaacatggggggcatgtgttaacgaccaaatttggtaatatcagcatcggaaaagaggattagatcaaagtggagtcgaaggcggagattgattcgagaatagaacaagaatcggctggagtccagatcggctacgatcaggatcggctgggtcgagttagattgggtaagccgatacagccgattccgacaatacgacttggtgtacgacatcgggttgagttgatatgcttcaagatgattgccgcacatggatagagtcctgagaagacaattgtatctattaattaggatgttttatgtaatttccttagagatatgtttagggcaaaagtctgccgtaaagacttatggtatcttaaagtttgttagagataagagttcgacatggacatagtttgtaattttcgggtataaatagaccccgaaccccatgtaatcaattaacacacacattcaatacaatttcggcgcatcgccacccttttgctttagttttatttcaacgagttcttgctttcaggttgagctgcatcggtttcgatcttcaacaagaggtaaaacttgttatgatggcttgcattctcgggattagtgcttacatctttatgatactctaatcttgtttatgtaattcgtcgagttatcatatatcttacataatctctggcaatatcgttatctaacctgcaatcggccaacatctatcggtagagggcagccgattaggttagacatggacgttgatttagattatataagatatctaccactctatgaaacttccagtggcttgattgtctagatattgttcttcttttcatacttaatgctgcatcagttgagtttgatctattaagtcgtgcttagaatatcaagctctagcctgcctcctggttgccgattacggtagtatcggagtttcagccgtgaaagatctatgtagtagagttgccttgtaaggggagattggaatatctatgatcctaagagtgcggtgattgttttggtgattaatgacaacccagtgttggaactaactatttccatgagttggtgagattaggttaagttccggcatcaagttaaaagattgaagctagaagatggacattataccttgatgacgagcaagtgaagacattgatgatgcggggtatgaagtggctatctatggcaaaacggtgaagggcaagcaaggctcggctacagtggaccatggggggtgaagagcaagaaagaggcttggcgccgatggaccaaatccggtggtgaagggcgagtaaaggctttgtcgtgatggaccgtccgaggccatttgaagctatgagtaatccgtatcaattattagaagaccacaagatggaatgccgaagatcaagaggatgtggttctccaatgaacatcaagtcaaaagccaaagtgggtattgatcaaggcaaaggtataattgatttgggactaatatgcttaatgagtgtaggttgcttaggagtgggctaggatgcttggagaccccccaaaacatcaaaatcaaagcggcgagaagactcggagccgagttagactagtttactttttcgctttgagtttaggaaaaaaccatactattaagaggggttccaagtgtggttctgagataacacaagtgctcttggtggtgtccaagtgttgaaatatttttaggagctgcttttgaaaatggctctactcgggacagagagtcccacccggaggttttgtccggaacttcctggcaccgaggtgaggttgaaaaatttcctaagtgctgcccggaagttcctggcacttttacccggaacctcctggcaggtttccagttcaaacttgtgagtaacggctagatgacgtcacctagccgttatatatatggatctcgtccccagatccccctttggccattccactttagttcttgtgttccctagcttcttctagcctctcccaatgtgattttgcttccaccacccaaatcttgtgtatttcttgagtgagagagtgattttgagggtggtggtcaggattggagaaggttttgaaggctaggatgacttgagcacttggggtatctcgttgggctgtcatttggagcttgttactcttggagggtgacctcctagacggttaggtgtcgcccgcgagtttccaacaaggttgtggattgactcgggcaagtttgtgagggcgttattccacctccgaaaggaaacggaatacacggtgagtgaattccgagctgaggtttaggaggtcgtcttggtagagcaagcctcacttgtgctgttctcttggtgttcaagttggggatcttagtggtcacttgaaaccaaagagaagtacctaagggtgttggcttgaataccggagacctcttcctaggcctttgcttggtgaggcaaagggttaatcaagacctggctctttggagctcctcaacagagacgtaggattctcggtggagaatacgaacttcgggaaacaaatcttttgactcctctcactctctttacctttgtgattgtgatgcttattgtcacgtcccaaaatgaccctaaaatatatcctttaaaattatgcctagaataattaaaatccttgtgaaagcctccaaaaattaaaatgtgcactgttaaaagtcaaataaggcttggaggatttttgtataattcctaaaagcctaacatgtgtaaataaattttagtggaattttcagagcacaaataataattattaagaaataaacaaagttgaaaaggttttataaaaagaaaaaccctaaaaacccctctcccctctaatgggccggctcggcccatctcccttcccctctctctcctctaccccgcggcccactcggcctctccccgcgcgcgcgccgctgatgggcgggcccgcccgccaccctcgctgacgggtggggcccacccgtcatccccgtcctcccgctgctcccgacgccccgcccgcgccaagcgccgccgccgccgccgaatccgccgcatcccgccgcccccgcgtgcaattaagtggggggaattattccccgtgatcccctccccctttccccccatttttccctctctctctcgctttcaaacggccggatttgctcccgcaaatctcgccggcgccattgatggcggccggacctcccgcgccggtttcctttcccgccggccgccctttttcccttccaaccctatttaaaccctt

SEQ ID NO: 24899 - DNA, 5221 bp, Oryza sativa
ttttcccccttccgttcccctctctcaaccgccgctccgccgtgcctatggccgccgccggcgaccataggggcgcgggcgccgcctcccgccggctgcgccatcgtggccgcctccgggcgcgccgtgtggccgccgcgtggggcccggccgttagccgcccgtgccctcgggtgcggctgacgcgtggggcccacagcgccggccggtgtgagcccgggtgcgcccggtccaccgaggaccatgaggctgccgcgtgggccccactcccgtggacccggtccacgcgccccctcccctcggctgacgcaataaacctttttaaattaaaatttaaatgaagaaattcgcaaatattcacttaaagaacatataaacttcaaatggccataacttggccatttgaacttggaattggaccgttcaaatctttaatttttccttaagaagtcaagaacccatttttgtactttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgagcatattaaatccccgtttgtaaaattattttgatttaaattaatgcattatcgctttatttaaattcccgcgttatcactattttatttagtcatgtctatttacctttgttatgaccttattattattgttattgttattattaccttgttcaccctagaataaacaaaaccccgactagtgggtactctaatcatggtaccactagtatgaatttaggtagatgcttcgctgtttaattaggcaacattaggtggttttataactctagactttgggaatattcatatcacttggacattttggaatggttggattattgtggaattggatacacaccttcccctctattcaaaaccctcaaaatggttttaggccgggctcggggtgcatggttttgatagtagcacctcggccacataaggaccggtcttcgggcctctattgcaaagcactaccgtacttccacatgtctagtgggtaaggcttagtttgtggctcagcctggttataaacaaaagtatacggatggagatggatgaagtcgggggtcgatggacatctctaggacaaatgaaggctacacgagctgcggcccggcagtcgagatgtcatggcacagggctagtgtcctgctactaggggctcagtcctgcctacctgtcccggaggttccggccgtaggtggggctgggtcggtactcttgtctatggctaggatgggttgggaactatgtcacgtctttcgtccgtataccgtggtggtatgtggcacgtggttacacgtgagaaaggtgtgtcttgtgggtaaagatgtacacctctgatcaaagtataatctattcgaatagccgcgccctcggttatgggcaagcctagcaatgtacccaagttagtgttttaaattcttaaaacctgcttaacaactaaaatgtggaatggttggcctgggttgacttgggacgagctgggacccagggtcgggttgccagttcggtctgaatcatcgtaggccttgggttaaggcaggttcgtgtgggttcacggccttgattaataatattgtatagctctaggatcgtgtttacaaggtagctttgagcaactaagtgtcttttaatgctgtttactacaaaccctaaccccctatattataactcccttgtactcccttgcatttattctgcacttgtgggtgtgtcttgttgagtacggtggttgtacttagtcttgctcaatttttcccaaacccagaagaggagttcctggaagatgaaggctttggtgtctagctcgtgcctgccatcaagcgcctgtggtcatcgccctagtcttctgttgtttttcgtttgtcttcatgtgtgctgggccttcgccgcccatgtaataaattaactatttacgcttccgcttgttaaactctgtattgtatcaacttttggtgtaccttgcctcctgggacaaggaataatacacgcacgtaaggaacgcccgttgggttatttccggtcgtgacacttatctccttatttgcctagttgtgctatcatgtctcccattgtatgatcacttgtgatatcttgtgtattttcatgtgtattactcttgtttgagacatgttgtacctctctatggtttaggcttccttgtgatttaatttacttgttgtgaggtgcttgaaatagcaattcacaactgcccggaagttcctaggaagaactccggaagttccgggcagctttctctgcttgtgagaaaaagctgccaggaagttccggaccttttgccaggaagttccgggccctgattttaagcgctgcgatttgaagtaaattttaggaacgcctattcatccccccctctaggcgacatcacggcccattcaagccgatcttatctggtttaactatatttgctctatatgcctcgttgacatgttaaatctgccctttatattaagatcttattgcatctaagtatattaaatctgccctttatcttattctgcatccaggattatgtattgttaatatctgtagccgatcaagtagatttagttctttgttatctatttataactgccgatcgatttacatatgacaccgatcggctatcatttatggatttaaccacggtttctttgtctttatttcttgttgattgcaggatcaaatcaactggcacgcttgcacacccgaaggcgagttttggacctgcactggagttaagcagatctcccaggcctcgtgttttatgtcaacagcatactatcttcttagcctcgtacgttgtctcgggcaatttgtttccctccggaagaatgttcttgacaagtttcaataaatcaccaaatgccttgtcactaacaccattttttgccttccattgcaagaactccaaagtggtatccaactttttgtgcccctgctcgcaacctgggtacaacgacgctctgtggtcctataacatccgctccaatttatgggcctccttttcactttcacagtcctcctttgcgtcctgcaacatctgaccaagatcatccgcagcgtcgttatcgccagcatccctgtccacctcacccgtttgatttccttcaaatccagcgtattgagcccagtcaggaatgttctcgtcctccgcttcatcttcttccatttcaaccccttgctcaccgtgggatgtccaataattatagcttggcatgaaccccgactcaaacaagcggaaatgaatagtcctggatgcagaatactccttctggttcttacacttattgcatggacaacaaataaaaccgttccacttgttagcttcggcctctcaaaaaataatgcacgccgtcgataaactctttggaccgccggtcagcgtacatccattgtcgatccatctatatgaaatgaaaaaaaatcgtacataaataaattttcaaacaataatgacagtcaaacaataatgataaagtaattaaaaactctttcgacaagcatacaataatgacatatcattactcatacaattaataattataaaataatccaacaaacaattcttattaacaatttttgaagttctaaactaatattaatgttgtacttctcttaattttcaatttagtttgttttctattttttaagattaattttcatcatattttaatataagaataaaacttttttaagtaaacaaacaaaatttctatatattcttcttccccacacaaattttctctctcgtcaacttacaacaaagttttggagacaaaaaaaatgtgtgaaacatagctccaaaagtaatataacaacaaaaaacattggaggatgaagttactaacattttagacacctccgatttgtatttaatcactaaaaaaatttcacaagaaattttggcatgacctcccctctttctttgagaaattttgaagcttgctcagactagaggaggaataagacatatataaaggggggatttttagtcccggttggtgtacaaaccgggactaaagatcggttggtaacaccaacgggactaaagatctcggggagcctgacaacgtttgacatctttagaaccgggactaaatatcatctttagtcccggtttttaatagaactggaactattgtggatttcggccgaccgaccaaagatggtttctccaccagtgagattccgcctgtaaactgcgagacgaatttattaagcctaattaatccgtcattagcaaatgtttagtgtagcatcacattgtcaaatcatagcgtaattagcctcaaaagattcgtctcgcaatttatatgcaaactatttaattggttttttcgtccacatttaatgctccatgcatgtatctaaatatttgttgtgacagaatttttagaagtttgaagggaaataaacactgcctaagcaaatacacatgccgcaagttgctactgcagtattgccacgtgcatctgtacatgggccctaattgaactcctaagaccaatagcacatgcaagcatgcacaccatgtacttcctcctttctataatgtaactattttttaggttgtcactggtattaaaaaagtatgtgagaatgattggaggaagtatgtgattggttgaaaagagaaagtaggtgaagaagaatggttgtgattggtgagaggagaagctaggtagatgaagaaatagctttattttggaataaggtaatgtgctagaaatagctatattttagaacggaggaagacatggattcataaatggtcactctgaattgacgcttgccaatttctacatcaaggttcttcccatggatagctatagtgcacacctcagggtgacaagatgcattgacggtgatggaaccagatttcgtagacacgaatgcacatatgccccacatcttcaggataaaaggtactagtagcctcaactattgaaaccagacaaataacccctcgactcaatccggagtggttttggatccacgtggcagtgcagtcagcttttttttaaaaaaaaatcagtagaccccacatgccagttctccacccctctctctactggaaaaggatcctctgatttaactgttgtgcagtt

SEQ ID NO: 24900 - DNA, 17562 bp, Oryza sativa
ccctctctactatatcccaatctctccctccctctctctcttctcaccagcacggcggcggcgtgcgaggacgggagcaggcatagcttgctcgggcgctgccggcggcgcaagcggcgggcggccggcagcgggaggtggagttctcccgggcaaccagtggtggaggcggagcggaaggtgctcttcgacctcctccttatcgaccgacgacgcggtcgccgcgggtgggccggcgacgccaattcctctcctcggacgtccatgtccagaccacgccgccacgctcctactcgtcgtcgtaccgtaaaggcgacggctttgtgccggcgctcggcggccaatcgatctgttgtatgtacttcaaggctttggaggtggcgcggcgtggctcgacggcgcgccgccgtcgacgacaacgcgaggcgcgcgggtggaggcgggtggtggcgttcccgctcccctgcaccgcgccagcgctcaccatgtcggcgtagaggcggtcggcgatgacctggttggcggcgtcggaggtgtggtaggcgtcccagaacacgaacgccgtgcggtcgtcgcagagctgcgccgtcggcaggcacagcccgcccaccgtcgtgtccacgtcacaacacgacgtgtgcgatgttggattaagtcttgtgcttagcattttattttctgttagcttgcatgtgagtcacggtggtgaggtcaagtcagtacatggcaaagtgcaagaagacaagaagttcttcagtcctgaactcctgatcaaaagcaaggatgtgatttcctgccgcgaggaataggagtggagtcttgcatggcatctaaacgttgtgcatgctgcgagaagtggcgtaagactcgcttaccatggctgttagttaagcatgtgattagtttacttgcatgataactaacttgagcccgtacttctgcgggtgctcgatgagctccatgacgatggagtagcagtcggtgagggacatgctcgcgctggggagcttcgcgttgagccgctcgaggaggttcttggcggcggcgttgaactgtaccgcgtacgcgttcatgtcgtcctggcacccgcactcggtggcggtgacagcgaccgaggacgccgtggaggagggcgtcggcggcggcgacgcaggtgcaagcgtgtgtggccggcggccgcctccgtcccgccgccctccaccgccggcagcgcccgggcaagctctgcctgctcccgccctagctcgcacgactgccgctgtactggtaagaagagagagagagggagagattgggatagagtagagagagatagaggggtggagaacttataggtggggcccactatttttttaaaaaagaaatgctgactgaactgccacatggacccaaaaccactccggattgagtcggggggttatttatccggtttcaatagttaagggtgtaaaatatctggttttcgagttcgggggcgtaattcggtcgacctctatagttttggaggggggcaattcataatatgaacaatacagggaaaggatggggagcagccgaacaggtggtgctgttgtggctctaggaagtaggaacactggattgcatccagactgttgcacaagctgctctccgctctgacaatagacgtaaatatcattctcttctcttcactttgcatttcatcagaagaacatttgtatggatccaaatattcttactgaccaaaaactatgcacaatgaaagtgatgcatgatatgcacactgtgatttgccaaaccacaacctatgtgacagcaaaaaggtagaaggccctttccctcttcagtgaaattgcataattcttccatgtcaaaaaaaaattgcataattcaaccacttggaatgtataattgatttcgacatataaatattacctgtcactgccgaaatttgtgttgcagggcttcctgcattatcatttatccatccatcgaagtaaacagaggagaaatagattacagcgagtgtggcggtgcaggattttgctagagatctgcaggacactcaaaagcatcaacgtcgctcaactggcaactacaaatctaaaaggcaccattaagttgaacaacaaaatcgaaattaggactaatggggaatcataattgtcacttttagcggaattaggtctcaccagcagaatagaacccgtgcgcggctgggaggataccggcgccacaccctaggcatatggttgcggagtagctaaacctgccgaaggccgaaccagcaagacttgtggaggcagcggcgccggtggaaaggctggaacacagctgcgctgattgtggtggcgagaagtgatccttcatagtagccttgttgagtttttatagtcaatacatatcctccatctccatgacggttcgttgtggaatcaactcattgttcgagttttcaacgaccatcatgcctccctttttaggcactacttgaacagggctaacccattcactatatggcacgggatagataatcccggtatgtatgagttttaagacttcttttttgacgacctccctcatggcattacttagcctcctcctgaggttccctagatggtgtgcaagacaggtctaagggaatgcgatgagtgcaaagggttggactgatgcattttaagtcttggagggaatagccaaaaacaacatgatgcttttctaaaatagcaataagtcgggccgtctccctctcagagagtgtcacttataatgactagagactccgcatcgccatttagaaagtcataacgtaggcctgaacgtaagggctttagctcaattggggttcctgacggctgatccctttttgacagatcaatcgcttctccatattcatcctccccttcattgaattcttcaatggattcattgagtgtagactctaggggcatgaatggagaaaacgaccatcactttctcaattagctcgggaacaggaagaagctccatcaaagaattgattgatggtagcacagggacagaggtggcgattcttcctattttcaggttgagtacaccgatttcggacacatcaaagagtttctctatgggatggccaataagtatgtcgaaatcagatatgtcgaacacatggaaatctaagatggcctcaatgccgttatgccgcatatgcactccagagataatccctaaaccttcggtcgtagagtttgtggaaatttagaaggttttgatggttggttccaacggtctatcccctaagcaatcaaatgcaaaggttgtggatataatattagcaccaacagagggattatagcaagcacgaaccaaatttcctctagtgagacacgtaacggttgaggagaggcaaccgatcagaattgcttcagaagagagctctccttccctcgaccatttattactcatgatgttgatcaatctcttcaccatctctttaagcatagctttattgagaggttcatcagaattgaccttggttggtggtctcttcttgcaggaataattcgaggtgtttccataatcttcgaaaagatcctcctcgaactgaaattgtatttccggagaatgaatttcttcttcctccggttcttgcgactaggatgaggattcaacagaggttcctcatggatacgggacaacttcgcttgagctgaaagaattgttctctcatatcagatctaagagttatcttccttcggcggttgtcttgtgtgcgaacgatcttccggcggaaatatcgagatcttcagcagacgccttgtctaacccataccgaaaatattgtaacaacacatggtcgtgtaaagacaagtctgtgccatactgagttaacaatgaaaacctggtccaggttgcaccgagagattccttctcgttctgtcagaaagaaaggatgtctaatcgaagattaatcacacggattaatggaaagaaagtaaggcagaacttacacttaagcccctcccattcaccgtggaatttcttgactgaaagaatgtaccattgcttcgcttcatctctaaaagaaaaaggaaacaactttcactttaaagtttgtaggcatgaacgcactagctcaaagtcccgaagacagaggtatgggttttcactaataccaccatagaaggtttgctctcaaaccatggctataaaggcatgactgatttcgtagccatccgaaaggattggttttgaagaacagtacggctcacaaagatcaacccgaggagctgaaaggttttgaattgtgggttgctccatcaaggaaatgaatgaaagaagatgaaataaaaataaagatacaagaataacctagattcggataaattagcaaccgtccacagcaatggcgccataaatgcttgttggtatttcttacgaccatacataaatctgcaagcgcacggaataccgcggtaacactttaccttcgagtgaccagaaaaggatatcgaacttagggaacatgtgtatgctacctaaggagactatccaaggacaacaattattggtaggctacctaggctagagaggattttctatgcgttttaattatctaaactaagtaaaggtaatttttgttttgggcaccgacccctgttggtctgccaacgtgtttaaacacatgcataaagtattaaatataggctataaaataactaattgcacaaattgtgactaatttacgagatgaatcttttaagcctaattgctccatgatttgacaatgtggtgctacgttaagcatttgctaatgacgaattaattaggcttaataaatttatctcgcggtttatggatggattctgtaattagtttttttattagtacccgaacaccatatataatatccgatgtgacacgcccgaaactttatacctgtatatcaagcaccccctcggccatggaagtttttcaagatgtggcggtcaagatcgttctggttggagaggtgacgataccaccacgagcactcgctggcacccacccaccacacaacaccactcaccaccccacgcacgcgccttcactccgattactcaccgccggaacggcgaatggcaggtgagccgccaccaatggcggcacctcagccggcgcgtttaccctccctcaccggagctttcttttcatttcttcttttttttttttgtctgcagccccgcggcggccggcggcggcgaaggcgaggaatggaggaggggcggggaggacgagccggtggatggcggctgacgggagcaagcggtggggggagacgttcttcctgctctacacgcccttctggctcacgctctgcctcggcgtcgtcgtccccttcaagctctacgaggtagccacccatccatccatccgttctttccttctcttctcgctcgatacgtctgaatcttgggcgagtttggggacgccttgttggatcttccgcatccggttctttgaggggagatcggatctcggcgatttcaaaatggatattaggtcgggtgataaaaataatatatattttttgttgctatgtgcagaggttcacggagctggagtacctagttgttgggttggtgtccacagtgcctgccttcgtcatcccgctcttcctcgtaggcaaggtacttttggctccatctctcctcaaaatacatcgactctgaattgggatctaactgatgtgatcgtataattaactgttggttctttagaggtagggtaattagaggcttgctttattttcttttagttaaaagaacaatgttgggagagtagtgttttgctatattgttcatagaaatgactgattgacagtttgacacatattgtgggcaagacagaaaccagaattattagctatacgcacgtcgaccataaatggtcaaagtactttctgactttctggtgcttgacagttgacatagcagcagtgatccaatgacgtatacacatgagcctgtttgatgtattaatcgcaagaacaccaaaatttggagggtaaactattaaatactcctgggacagccacaggctggtaagttttagatggagggagagagtagtgggagctgagtgtaagagctgagaggatattggaaaggactgggatcatgtgcggtcctagttgtgattgtcttctcatggcttaaattggggctactgcttattttgtggtcacaactatgactgcacccaaatcaagtacgggagagacataatactagtttttgttgctttcccaactgaggaaggaatacctgttgtctggctaagtagtttagtgacaaatgagggaaattggctacatggcacctcaatttgatggtgttttctctgagacatgaaaattcctagctttgctaaaaacacaatattttctggttaagagctacttcctccatcccaaaatgtaagcattttagaggttggcacgtgtattaagagagtaggtgggaatgattgaaggaaggtcgtgattggtggagaagataaattaggtgaaggagaatggttgtgattggttgagaggaggtatgtggagaaatagcttcattttgggacaaggtacggtgctagaaatagctatattttgggagggaggtagtagatggcacctgggaggtggggacattaaaatattctcatgtacttctgtaccagcaccagaccatttctaccatgatcctctcatactgttctttggcttacaaagtgtattcttttgttaaacttcgtccatgaaattgtatttcttatcttgaattcagtaaccatgacttagaagctaattttgctaatgttttaatttttcaggcagatagtgttagaagtttgaaagatcggtattgggttaaggtaagtgttttatacgatcttctgaaagacaaactgagttctaaaagaaaatgtagcgaaagaaggccaaagctgtatcttttcaataaatttgatcctgtaacgtgttttcgctacagcttataaactttactttattgagtaaacactttcattttctcaggcaaaatttactgtggaaagaatagctgatacattgaaatatcatcaatttggttacatttgatcttggtgaaataacactattaactaccttatatggttgttttactacgctactgtacaaaaacatttactactgttgtaaattatttactgctacagttatacttaattttgtacacctgctaatacaattaaatacaacagtacttctcagttgtgtatgggcaaattggtagcaaaaatcatattctctttactttatctctttgaacagttttgctaaatctcacatctttctgttgcaggctaatatttggattataattttcagctatgttggtaattacttttggacgcattacttcttcacagttcttggtgcatcatacactttcccatcatggaggatgaacaacgtaagactgtcctcatgttattgttgaccaaatgggatgcatgcaaacgataatctgcacaactgctagcattgcaatatgcgctgatgttttcaaacacggattcaacagtatttctgttcttttttttttcttgcaactcttccatgcaactgtcatggacattcagccaggggggcgagcccacccaacaccctctcggtactgtagcgcggtactgtatcagtctgttaggtggtattagattgagtcctttcttaggggttaagtcgtcccatctaaggatggattgtatccctttaccattaagtaataaatcagattagtttaatccaatacctctcaatgcccttcccaacctaaatctacctctcacccctagtagccgctgctgcccggctatcctcccagcggtgtttatcccataatggccttgggtcgtgaaaacaaattttaaaaagtaacttctatacaaacaccggccactgtaatgcattggactatgatctgaaagtttacctaatggcacttaggctgtgttcttttggaggggttgggaacccctcctctccacatgcaaaacggagcgatagattaacgcattattaattaagtattaagtataaaaaacttgaaaaatggattaatatgattttttaaagcaactttcctatagaaactttttgcaaaacaccaccgtttagcagtttgaaaagcgtgcgcacggaaaacgagggagatgggttgagaactcagggcaaagaacacagcctaaggctgtgtttgggaggaggggttaggaaaaaatggattaatatgatttttcaaaacaactttcatatagaaattttttacataaatcaccgtttagcggtttgaaaagcatgcgcgcggaaaacgagagaggtgggttgggaaaatggggggaagaaatgcatatgctcacaaaaatgaaatgcatatgctccttttaatggctgaaccatatggctcacttgaacattgcctacaacaaaatttccttttgttgaagctcggtcagtgttactgttgacttttatctgtcataaccttctagaattttattaatttattatgttagggacttctgtatgtaaaagagggctgccattatctatcaatgcgaacaagatataaatcaattaatcctctctatctttcctatgctcctgtttctttcatatatgttcctctatcatgtgcccagtcatttccttctacctctcaaacattctgctaataatctcaaaaaacttgtaccatactgttgtttctcctctcagctatttgcttgtatcctctgttatttgtcgcagaagtacagaacaagaatatgggaaagtcctgtctccactctccactgccgttttgatttggagatgatttgaccatgcattttgatagataatggaagaaaattttgacttgacatttgcttgctttcttatctttcgttagtttccatttagtgttgcaacttgcaagtaatgatggggtctgagaatttcacatgtactagtgctctttaagaatgttttagttaccttcagattaaagattgtttttattattttttttaaatgctatgcttaagaacacttcatacattccctcctgttctcctatattaaaatctgaggtcactacaagccaaaatagattctattctgcaactgtttcgtgaaggatattgctcatagtgtaaatatggaaaagtggccaatagttcaagtccattcacttttactagtgattgctgtgtactacattacttgcaagttgaactaacaaatgtgttcttgtttctttgttcttattgcttgttaaatttctttcatgtttcaggtaccccatacaacatttctcctgacccacgcttgctttcttttctatcacatgacatcaaatatgagccttcgcaaattacatcattctacagctcatttgccccagtttcttcgatggtcatttgaagctgcatgggttttagcactctcatacttcatagcttacctggaaaccttagccattgcaaatgtatgttctctcttgcatagagtattaataatacacagatttcttctgcctagtgctatttaattatcatgttctttcaatttccatttagtggtacggacgtagggttcagtaaatctgtgttctgttttatgaaatgaactactctgttggatccaatttactacattacgtatagcttgctgtgaattgcacaacagaaaatctgtggtaatgccttccagtcaggtcagataccattagacagaccctctgggtacactacttttgaacactgggagaaggttttctacaatctgtaattgtgattgttttctacaaatctgttgttgtgaatattggaccaattattcttgagatgatactagcaaacttatgtgctcactcttgctgttctagggtcaatatttaatgcgtactatattttcttttggtcaaagtggccaagttacataggatggagaagtgttttacaatgtcctattatgataacatatgatagtgaagttgttcccaccttttttactttgtttttcacaatactattatttccctttgtgcctgatgttttctgtgacctttgcagtttccgtattatgaattcatcgacagggatataatgtacaaagtaggctcactgttttatgcaatatacttcatcgtcagcttcccaatgttttcaaggtgaaattagtcagaattatcgttatagttatttactcctatttcaatgttggctattcatctgtttggtttgaaatatgtttgtttccctgtttctgttatgcagttaaacatcaagttgtctagctgtaatggttaatagctttgtcaaattccttactccaataccatctatttacaccaactgggtacatggccactaagtgaataaaattctagaataatgcattagcacacttgtcccttgaaacaaatcatctatcaagagcatagctacagccatgcacccatatccatactgtaatcaccatgaatagacctgcacagcatgaattctgctgctgttatgacactggatagttctgaatatgtccgtagctttgtataactacatgtgattttccattcaggatcgatgaaaatgaagagaagtggagcctttccagagtggccgtcgacgccttgggtgcagctatgcttgtaacaataatcctcgacctgtggcgcatattcttggggccaattgtacccatccctgaatcaagacgctgcggtcaaccggggcttgcatggttccaggtgcagaacgagagcgtctaacccagcaatgccgcgaattcgacagcaaaccatcatcagctacgcctaccattctccagccagtcctcccctctactggaagttctagtgtggcgtcagcatgtgcgcctcttgctgtcagcttgatttgtttcttgtatgcgatgtcccatgggtaacaactagtaaggatgctgatatggttttcttgatctagaatactaggatttatgagccgacagccggacagatactccaataagctataacaataaagattctttgatgtgatcagaagttgagttgtgttggatttgctatgttcgttgcgccctgttttagggagtttccagtagctgtacatactcccaaaattcatcctaactagtgtttgaagtcacattcgtgtgactatgaccatcctactataaatggtgcaagaaaatctatcaataatattatattattcaacgatatatgagaaaaggaatataaaatatttcatatatagaaatattttttgcgcgtttgctacacagatgagagtgttttgtcgtgccctttttttttctttatgttgatcatcataattacaaacttgaaaaataaaattattcttagaacacaaacttgaaaattcagcttttctcttgcagctctagaggattaaggaattgaagaacggaatcgatagatagatagatctatctgcagcttttccttgaaatctctatatacggtttcggggatggaaatgaggcagatgattgggccacgtggcttattgagaatttaggttagctcatttgaaaatcagccacgtgtccctatgcaatctctgattctgctatgattatgctacatcattaatcgtgcattttaccgtgcaatctacagtgaactttcagataaatatattttagttaggtagaaaaaaatctgagctaaactataaaacaccagcatgcagttgtagattatagaggcttctggaaaatcttttttccttcatcatcaaaataaaaaaaaaggcaagagattccagaggttacaaaagaaaattggatctgtccctttgcaaccaaagaaattccttctccttcgattatgaaaaataagaaaataataaggatcaaagagggaaaagtagaaagaaaaatgccgtaagctacttcacctactcggcacaatagccatcttctgcttcctggtggttgttactctgtagccacgtggacgagccatttgagctcgtctcaacgccgtatcccacagtcacataagagctcaatcgtcgctgcagtaggatatcatatactcatagctccattcggaccttttacgacagataaatcgaagctctagccattgccactgaatagagttgattggtaaccgacagactggagagcatcagcgcatgcggttgctggagtcgacaccaggggacagtgagccctgctggagagaaacgagaagtcaatagcatagcgagggatggaagagaagagaatgccaaaaatatctcaagacagagagcgaacgagagaaataggatggagagagagagacgagcggagggtacggtgaaacctgatatgccgatgaagaggaccagatttaccgcgggagagagagtcaaccttcttgataactttgcatttacacccctagaaatactaattattatatgatctactgaataaaaatattcacaaaagtaccactagattgatcatttcaacaatcaaatgttttacgataatagaccttgggaggcttggatttctaagactggtgatgaccggagcctgtacagcctggttgtctaacgcctgtaaattggggagccagcattgtacgttgggatatcagttttatttacctcgcacagagcccatcccaaattggagtaattttgaatttgttaaatattttctgtaatgtggtaaatttcttaaatcttataaattctaaaatcttatgtatcttccaataatagttttatatttgcaattttgtaaattaaaacggaagttgaataaggtgaaaagtattaggccacgtttggttgtttgccagctagacaaactagattgctaaagttgccgatcttgctttaccaagctgtttaggctccgttctatacagagtctaggatgaagattaagtgcgcatgtgaaacgagataaatcattagcttatgattaattaagttttaatcatttaaaacttaaaaaatagatctatttgatattttaaagcaacttatatataaattgtttcgtacgaaatacatcgtttagcaattcgaaaaacgtgctaatggaaaacaagttaaaatctgcatcttaattattagttgtttagttttttgactggcagttcctgcaaagaaacgtttgtggttaaaggaaatccaatttggctctccaccacgatagctttttctcacccgtttgagctatcttgtctcaaaagttataattactttatggttccgaacggtgggcctcgccaggtcaggctaggcttaagctagccttagatccaaacatacccttagtgtttcttttttttttttttgccatacaacaattttgcaaactctaaatattataccaccaacatttcattcatccttgatcgctatttgtttaaaagaaaatataaatattaataccaacatttcattcatccttgatcgctatttgtttaaaagaaaatataaatattaaagaacatgatgtaccatcgaaatactttgcacgataaatatatcaatacttatcaaaacatcattaaaaatgattacttctcaaatagaaaatctcactggctaaaaaaataagtaaaagctaacgaataaagcttcggtccttttgaatttatatcttttgttttaaatataaactaaataattctatagaaaacccaataatatttatatgctatagaggagcaatgaatatcaatcttctgggcgcgtccattttctagtaggtagcgaattcagggtgctttggcatgatattgcgctcagatcgctgcaaaaggtcatcaatcttctgctgcactgtccagtacaatccatagtcttcggcaagggccttggctggaggagagtctccatctcctgtagtcatggtgggagtagcagcggaggaggtaggggttgtttccatgggaaaggcagcggcggcaccacgggaaagcacaagccctaatggatcacctctctttgcaattaaaaagtagaggcagaggatgaagtcggacaatgtgcaactatttaaaagtaaattttgtaaaaccgagttattgtagttcaagttacaacatcatcaggtatgaaaaaaaaatggtgtgtaaactttatatttgcatataaattttaaaaaatatactatatcacatttggaccatgaacacatgttaacagaccaagccctaaaaaaaaaggaaaagaggaaacggactaaacccatgaagaaaaagggccacgtgtttatttagctgaaaatagaaattattaccacatagaccgaaagagatccaaccaccttagccgaaagaggaatgggtagatctgaccacgcggattgggtcacgcacgaccgtgcacccattagaattttcggttcccttcccatgcgaacttctcgggatcgcctgccatctgcccccacacaatcgctcccctcccacatgaacttccagggataagcagaatgtgcgccctgcgcacaggaaattctagggattagcggaatgggaaccttgtcatcctgattgaggttctagattggagatatcctgttagagatatagttttgtatctcttgccgtttttctctaattccctcccgattttgtttttataagttgattgtaaagataacgaagtaccatgtcgatatgtactcgtggtccgtaattaatcgagttgtcgcgttgactcaattacgctttcatgctatctgatgttttcctagcttccgcctaaaaccctagccgcgcattgcccctctctctctctctctctctctgcgtgtcacctctccctcaccacacacatgtccagcctccccttctcctccaccgaggccattgataccacgtcttctatcgtcgccgatgcagttcacgcacgccttacaatctactgttgatttcgacgttaagtccaccttagcgacccacgctgccgactctgcggcaactatcctatttcttgccagttttccctgattctctcatggttctatttctataagtcgattatagagataatgaagtgttctgcctatctgtactcgtggtccacacttaatcgaattatcacattgactcagttacgctttcatggtatcaaatgtttttcctagcttctgcctaaaaccctagccgtccgccgcttctctccaccatgtgccatatccaacctctccctctccctctccccccacaaatgtcgttgacacctcatcttagggcatatacaaaggtagaatctaatatgagctctctatattaattaatgtcactagagattatcctcgtataatagtagagacaataagatttctaaaccattaatgcactaaataatttttttttgttatacttctttccttttctccaccctcatgcaacaaattttccgttaataaatgctaagagtagactctgaaccgttgtcatgcgtagcaacgatgtttctcctttcttccctctctttcttccacgtcaccaaatttacttgcatgacaatgaagagagcccgttattaaacaccagtatttgcatgcccttatgttgtcacccatgcagttcgcgcggccttccaatctaccgtcgattccaaggccgagtctacctcagcgacccacggcaccgactctgtggctaccacggtgtgtaccgcgaccaacggtgagggcctctcctatggcgcgccatcttcttacgtctcgccgccgccactcagcttcggccccaatgatctaaattttttttgagaaaaactatgggacggtgtaccgtctcaacggtatagtttataatttatacttaccaatcactcaccgattctttttctctctgaaagcgtgtcgtgtgttgtcctttcacattaaggctgctgactagtgacgactgacgagagttctcttttctcctagagtacaaaacagctatgaaatactctagtacagcactatttctacacctctttaggtccatatgggtctaacacctccttcaactagcaaagttagaattaagcactagagctagtagcatgagcctaaacaaagcatgttagcggcacgtgagcaagtttggttgtacggcatggtccatctttttatttgattgttgaatagaagtatataacccataaatatcagaattagtggtatcacatctgaagtctcgtgccatcacaccctatatttggtatcagatccgctactaagatgtatcaacccggtatctaggtattggatccggtactcaggtatcaaacccaacctaggtatcgaatccgttacttataggtatcagacccaatacctacgtattagacttagtattcataggtatcatactcggtacctgggtatccgacccagtacatacaggtatcggaactgatactcataggtattagatcagacacccgatacccgggtatccaatccaatactcataggtatcatacgcgataccggattcggtactcataggtatcaaacctgacctaggtatcaaatccaatactcataggtatcagacccgatacttaggtatcagacttggtattcataagtatcatactcggtacctgggtatccgacccgttacgcacaggtactggaataaatactcataggtatcagataagatacccgatacccaggtatccgatcggtactcataggtatcagacgcgatacctagttatcggatccagtacttataggtatcagagccgatagctcggcatcagatcttgtatttataggtttcatacttggtacctaggtatttgacccagtacatggatatcagatatgataatctagcatctatgtatcacatactagagtttctaagatgtggtataaccaagagcccaacatgacatatctaattagaatccattgtatccatatataatctaggtaattatttgtctggtctaatccgtgcatggcataggacacatgcaaatagatgcaaccaatcttaaacacatagctaggctactgtaacaccctgaaaattcggccaataaaaacaaaaccctaaaaataaggattttcaaaaactttttcaataaattgcatcatgccaactttattcgcctatttcattggattttgaattcggagtttgttgatcgcaaataaagaataaataattaggaataaaccctaaaaatcaagttggctaaataaataattaaaatataaattaaaataaagattaggtgaggttagaaataaataaaatattatcacgaccatattagcaataattaaattttagtacgatggaataagaattaaccctaattaaaaattcaaataaattatataaataaaatacgagtagtattaatttagggtgaatttttagttagaataacacaaatatggagtaaacttcatttatgcaaaaattagaatctatagggctatatttaaatagaaaatgggctaaaatcgggataaataggaaaagtcactgtacattacggcataggtgttcgatgtggtaccctagccct

SEQ ID NO: 24901 - DNA, 8505 bp, Oryza sativa
gagaggagggagaagaagccgggagggagagaaaagagaaaaggaaagaaaagaaagagaaaaagaaagaaaagaaaagagaaaagagaaaaaaagaaaagaaaagagaaaaagggaaatagaatagggaggttaatagtttagaaaatttaaaataattagaatttaattatatattaattatagtcgtagaattgcaaaatttaatataaattatagattattcttggtaatttctaacagaaatcaattcgcggtagtaatttagatgtaattaataattaaacaattagatgaattcttatagattattatagattatttttgggtaatctctataagtaatcgattcacggtagaaattcggatttaagtactagggattttagccgtgtattatatttaatcatttagtcatagactaaattaaatcgtataatattataagatagaaatttctaacctattatatggatataatgctcgtgtagattaaattaaaaacttatgataacaaaatatttatacccgcaaaatagtttaaatcgaaattgggtttgtgtcacacccagaaattcacgaaccagaatttctaagctgaatgtgtattaaacccctgtccaggaccagccagggtacacaaacgacaattgttgacatacagatccacgtcttacaaaaatataaaagattacaaatgcagtggaaaaagataaaagcgagctgagcctgaagactagactcctgtagcggacgactccattccaaaggcatccttgacggcagcgacgaaaccaacctcttcgagacatcttcactgagaaggacttcaactctggtgtgggggaaaagagagcaagactgagtactacccactgtactcagcaagtcataccggaagaggaggtatgatgcaggatataaccaaagaaggctaggggttcttttgcacaaagctagcatttaaaagcagtagttgaaagcaataaaatagctgtagtaattaatcaatattaaccaatcactgtccaacgctacaccatattgtaacaggcccaaccaaccacctgaactacaccagttcaatagctaactaggggtgagactaatcacagtgaatctggccgaccgcccataaccgcgggcacggctattcgaatagttttactctgatcagaggtgtacaactgtacccacaagacacagccccacgacatgtttccgtgcgccgacatgccaccacgacataccggaaagaggccgtgacatgacccttcgcataaccccctctaaccaatcgcaccacacctcaggtttcacccccactcctcgcaaggcagcgggcagtcccctctcgtgccacggtgaatctggaagccgatcaaccggacaccccggccgacccaactccatcacgctcacccttgcctgggtacgtcggctagaggaaagctacactacaagcccagccgttgcccacgctggcttgtggtaagtacgataagttcttccagggcatcctgcgaaccggtccttaatcgccatgggcacaactagcaaaaccatgcacccacagcccaccatgtagtgtgttttaattaactaacaccattacggtggcattaatccaaagctataccaataatcaaagtctatgtattaatgtggttccccatttgtgtactagttgaactaagcatggctaagcattccctgaaccaacatctaatcattttagtaccccagttatcaatggcataagataaacaatacatggctgagtagtaggacccatcccacatgatattgtaaaagaatgcaacatttaatggaaacgcgggacatttgtaaattgggtacaatatgatcaattgtaatgcatggcttgccttgctctcgcactgatgagaccacagcaacgtcttcaagaaaccgtggatcgacgaaacggctgaaatctacgcgacaaacaaagcacacaagcaaaacatgctataagactactgaaacaggaaacaaaaccatttttaatggattctatacatttttatgaatttactgagacttgaacgggcttaaacggagctcggatgaattagttatgatatttagaagattctctgtgtttattactataacaaaagtccttaaatcatttattgcgtaataagtcccagggctgacgtcatcaaaggggggtcggcgccgacaggcaggacccacatgtcagtgaagcacggggtggccggtctaccgtggaccgggaccacgcgggtggtccaccgccggtccacgagatcgacggcccggatcggcccgggactgatcggacggtgcagcggcgacctggctcggctcggctcggcacaaagccggccggccggccatggcaaaggcggcggcgcgcgcgcgtcgccggcgacggcaaccggcggcgggagacggcggcgcaaaggcgctggcgcacgaccggggcggcggctcgacccgacgcggctaggagggagagggaggggaaaagaggagggggatgcctcaccgagagtggccggcgcggaggaggacgaccgcgaacggcgacggcgagccacaggaggacaacggcggcgggcggacgagctccgagatgccctaagagaggcaaggagagagattagagggagaggggtggaccacggcgagcggaacccatggccgaaggcagcggtagaggtggtgctcaccggagtgcgaggggatgcgggctccggcgacggacctcgacggaggaggtgcggacggggtggaccttggccacgcaaacccgacggtggcgacggcgcgatgtggcggcgagcctagcggcggctagcggcggccggagtagcgggagcggcggcggcggatgggtgcacggcgcgggagcgatggagggcacgagagagttcggcgagatggggaaaaagagagagggggtggcggtggagcttaaataggcgagggggaactcggacgtggccggtaggggcgggattagccggccgacatggggagtgggggaggagagagaggcgggattcaaaattcgaatcccgaccatctcgggcgcaggcgcgagcgggagagagggggaagtgggtgcgggagacgcggcacacgaccggggcggccgacgtggcccggagggggcgggacgtgggcgcggcggcggtttcggcgctggtggcgacgtgggggcggcggccggaggaaggggacaaccccgacaggtggggcccacctgtcggcgtcccggggagagagaggaggcggccggcctgactgggcctcggcccgcggccggcccagcgggaagagggggagggaaaaagagaatgggccggcggcccaagaagaggaaaaggagggaaaagaaaacgaaaaggaggaaaagattttccttgggatttaatattgtactttgcttattttaattggttaaaattatttccaagactctgaaaattccactaaaagtcttgttaatgtattggagcatggggaactcaagaaaaattccaccacgccgaatttgattattaaatgcatttattagttgaggattagctctaggttaattcaacaatttctttaggtgatttatttaacaaattttaaagctggaaaggggaacttcagggcgtgacagtttgccctagttcgtggatagtaaagttaatataaaagaatcgactctcgcattcgacttccatttggatttatttggatttttatttgaattctaaccgaattcaaatcaattttcgcacgtaactatagagcccgagagagttgcggatccaagcgaaggtcaagacccgcaagactttgagcaaggcaagtcatcactattctttgaacatgttgatcccaattgcgaaattatttttatttacaaataagattgcatgcaatgatgaacatcctatttgtgaatataccataccttgattattgtttacccttattcccttgtaaccatgattacgtaggagtccctagtcaagtatgacaaatgcttagaaatgctactctagaatcatgcatactcatatttatcaaatgctaaatgcttaggcaattacctttgggaaggtaattgagctgcggcatgtggagacatgagcgccacattgccatgatgttgatgacatgatttgtgaaaggagaaataaaattaaacaactgttttcgactggggcggacggaggatttgggtggtatccggaaaaggctagtaccgtccccggtcaattaaggaccgagccatgaagttaagcatgaaacgacccccgtacaaccgcacttttcgtatgggtatagacctagtggaatagatagctgagcggaggcagtatccatgcatagtggtttcttgatgtgtgaggcaggggctctacggtggggcagccattggtagaaccgcgaggcgggtgtctacagtggtgtcgccgtcggtaggactgccatgtgagaatttaaacataattataacttaatgcatgtgtgagtctttccttcccgggtgcatcagaactcctctcactgctagaaaccgtgtacacctagagtgcatgaggatgtaaagttcatggaacgggtactgccaatgcgaggttatcgaaaagctttgccgtgacacgtctcatgtgttgagacgaggctcatgtgttgggcagtcgcggagtgcgggtaaagtgtacatccactgcagtgtgagtaaaccaaatctattcgaatagtcgtgctcgcggttattgagcaccgggacatgtattacacttggctaaactctaaattcttaacttgtgtgggatgggatattgcatgatgatttctatactgatggagccacttcctgaggggcgggaacgtggacgtcctcagaaaaccatgatgactcgatggcgggaagctatccttgggatcacaatggatggtggacagaaccgtcattgtttaatatgaacactggtactaaaatttgatcagtctgtgctaggtcttagggttgtgaaaaagaattataaaacttgctttgcgcaaaagaaccatagccatcctttgaatacccctgtcatgtgcattgttgctgtggtggcttgttgagtacggttggtactcacccttgcaaatataaacttaatcagaggccggagatgaagcttcggaggatccctatgcctattaccaggagggtgatgaagacgatggcgctcagtaggtcttagttacggtcgttgcctgtggcaatggcgtgtcgctgccttaactccgctgccttatctacttctgtttttggaatgtattccggaccgctcggtccgatgatttaagactatgcctacgggcttttgatgtaataattcgcactagactttcgtgtatgtgcatttggtatttcagctatgaactcatgtgtaccagactacttgatccagggaaatggcactgtttacacaattgattcctgttataaaaacaggggtccacagctactaggctctgccataataagtaccctacatagctagggtacgggactactagtagctattacagggatttggcatgcatagcaagctagtagtacctccggttttatttactagctaggctagtaccaaaggcaggacttaggcatgctaggtactagctagctatcaggaacaagactatacagtgatacacacagcaaacgtgcgtgatgataatcctagcagcacgcgacatactcgggagaagccggcacgtggggccgcggcatgggggataagtggtataccgttcaacggtataccgttgtgtagtctctctttttttttcttgaaatctccaatatctcatgattggaaatagtatcatgtatctctttgggcatactctaataagaaagaagcacttagcctctctatctgacatatgacatacattgctcatgccattaggccttaattaactaattttaacaaaaggtagtagtaaaaatacaacattaaatcattcacgctaatgctaaaggagcacaaggatagtatcaagcacggaggaaacgtgtaaaaccaatccaggcatccaaaactggagacctgagaattataatcaggattcagggaagtttgataaatttgctgtttctcaaactaaggctgtgtttagatccaaagtttggatccaaaattcagtcattttccatcacatcaacctgtcatacacacataacttttcagtcacatcatctccaatttcaaccaaaatccaaactttgcgctgaactaaacacagcctaaggtggataaatatgtacaatggcatgtacacagcaaaatggtgaaaagttatttacattttatccttacttggttattgtcgcacagcttagctagaaaccttgcaagttaagaagagatgaaacgtggcatatgtacactagtcttgcaggaaaaagaaaaagaaaaagaaaaaggatactgctatattgcttcaggcctcaacctcttcaggtacttgttcatctgttgctgaaacgaactcttctgttatgctcgtatctgggttggcatcctccatgtttctatctggatgggactcctgttgcattatgctttcctttatcattgacatcagagattccaggacattcttgttttcagcgagataacatttaagagcatcctttccatggaaattttgcccgttcaagtgatagaatactcctgattttgttatgaacttgtgtttgaagcctacttcaataatctccaattcacgactcaggcccttaccaaactcaagctcaaggtgtacagtcttaaatgggggtgcatgcttgttcttgacaatcttgacctgaatttgtgtgcctacaacctgttggattgaaactggatcggggttatataatgaaacaagaactgaacatgaaacatctacgaaattacaaaacctattattactaaattcaatatttatttttgtgttacctttttggcaaaatgggacactacatagaaagcaaatattattgatacgattgtgttacctcttctgacttttttataagaccaatccttttggtgttcaagcggacagaagcatagaactttaaggcattccctccacaggttacttctgctggtgctccgaatccactaaatgtgcttaatttcgatcttacctgtacacatacccagaaatgatcactctgttacctctaaataaacatcaaaagttcttttgaactaagtgattaggcttggttagaattacaatactggacataatactaacccataatacaccctgcaaacgcacccaaaaaaacgtcatattgtacaaggaaacaactccactaaactatttcctgtcttagtttgcatacatggttggaggatagtttgagttccgtgtctttgttcttcattatagagttaatatatcctctcttactataaagttatagctcactaattcctaaagcttaacatacaaagatgccacatcatcatccactaataattgttacatttaaacatcatggaagcatgctatattatctataattcaataatctattaaattttagagatttaaaatgtaagcaggttaaatcatcatcccacataattcacataatagttaaatatatctctccatcatttcttttataatatcctatatacctatataattcatcctcacttagttcatattatttttctctctcattaagtcatatcacatcaattgtttttaatccttagatgcttaatctatggttcaaattatctctcttttcttctctcattaaaccatatcatcttactccctccgtttcacaatgtaagtcattctagcatttcccacattcatattgatgttaatgaatctagacatatatatctatcttagattcattcccattaatatgaatgtgcgaaatgctataatgacttacattgtgaaacggaggaagtaatttttttagcccttagatgtatggtctaaattatcttccttcttttgatctctcataaagccacatcattttacttttacatttgaatcatcattctaaatacaatttaaatttaaatcacaacaacttatgtaaacttatgtttatgtaagcttatgttgattaaactatcttacacattatttttctttgttgtatcattgcaaactcctgcagtaacgtgcggggtttcacctagtattacataatttcgtgacaaccgtcaacctgaaaaatgtccgaagcccacgtttgactatgggaaaattttttatataaaaaagcaaaactctggttttttaataatataatagggtggtgttttaggagtgctggaactagagttatcaaggctgacccagccatcaactttctggaggtctaggtcacatgtccaacagctgggtatttatttaaatattgaaataaattaatgggaggaagtgactatttatactttgcgtgcggac

SEQ ID NO: 24902 - DNA, 621 bp, Oryza sativa
tcacctcctcctcgccaccgcacgctgtcgagccgtcctcaccgctgcgtcaagccgccgcaccgccgcgcgccgtcgagccctcctcgccgctcgcctcctcctcgccaccgcaccgcagccgacgacgacctggagggcgccgcgccgagagaagggataagggagaagggatgagagagagagtgagggatatttaagtaaaggagatggtaccggttctaacacaaataggtgccggttctatcattaaattcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacata

SEQ ID NO: 24903 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnnnnnnnnnnnttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaatcggctcagttttaattcacgagcttgaaggaaaagagagggttgtgttttatttaagtcgtcggctcttggatgcagaaacaagatattcccctgtggagaagttgtgcttgtgcttatatttttcttgtacaaggttaaggcattatctattgtccaacgaatgcactgtcatatgcaaagccgatgtcggtaagtacatgttatcggctccatttttgaaaggaaggtttgaaaa

SEQ ID NO: 24904 - DNA, 1191 bp, Oryza sativa
cagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaacaaaattacaattagaccatttaatgattaatttaatatgtggttaattactgaaatgctctttgtatgattaaaaattaggaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcatcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttgttgtgactgttcttgacctgcagaaaaagattcaccaatttggagtggcttgatacgctgcctctggctactaccttgtgcctcctgggataca

SEQ ID NO: 24905 - DNA, 661 bp, Oryza sativa
catactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatactcggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgcttggcttgtggttggcacgataaatgtctcccaacagta

SEQ ID NO: 24906 - DNA, 941 bp, Oryza sativa
cgaattcgagctcggtacccattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggtgaaatcgtgacaagaccctccacataaccctcccctaaccatccacaccacgctaaggtttcacccccacccctcaaaaggcagtgggcggtcccctcttgcgccgcagtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccatgaaccggtccttaactgccatgggtgcgaccagcaaaaccatgcactcacagcccgccattcagaatattttaattaactgacacccttgcggtggcaccaatctaaagctatgccaatagacaaagtctatgtaataatgtgatccctttttgtgtactagttgagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgaactgatgagacctcagcaacg

SEQ ID NO: 24907 - DNA, 1232 bp, Oryza sativa
  unsure (1)..(1232): unsure at all n locations
ccacatgacattgtgaaagaatgcaacatttaatagaaatgcagggtgtttgttaattgggtacaatatgatcaaatgtaaagcatgacttgccttgctctcgaactgatgagacctcagcaacgtcttcgagaaaccgcggatcgacgaaacggccgaaacccacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggcgccgacaggtggggcccatgggtcagcggctcaaaggggagaggaagggggcgccggcatgtgggccccacgggcagtggctcaaggtggccggtctaccgtagaccgggaccacgcgggtggtccaccgccggtccacgggaccgacggtccggatcggccgggaggccgatcggacggcacggcagcggctaggcacggcttcaaaaccgaccggccggccatggcaaccggctgtgacgcgcacggtcgccggcgacggcaatcggcggcgcgggaagcaacggcggacggggtacaggacggcggcgtcgaccgaaggtgacggcgagcgcgtggagagaggcggcgcaaacgagagagaggggaagagggaggaggggaggatcctcaccggcgagtatggcggccggggcggaggatgaaggtggcggcgacgacctggcgatgaggaggggcggacgggtggcggcggcacctacggagggtgttgagaaggattaggagtagagagagtgaccacggcggccaccattgttggccggagacgaaggagaatggatagctcaccggcgtgcgaggagaaccgggctccggtggggtttagcggaaatcgagcggcggccgaggtggctcacgcggcggcaatgctaatggcggcggcggcttggcgcggcggcggctctagcggctgcggcgcgcgaccggaggtggcggcaagcggcggcgctagtggcgaacggcgcgcgaccggtaggaggcacgnnnnnnnnnnnnnnnnnnnnnnnnnnnnnnnnnnnnnnnnnnnnnnnnnnnnnnnnnnnnnn

SEQ ID NO: 24908 - DNA, 220 bp, Oryza sativa
acagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggct

SEQ ID NO: 24909 - DNA, 7993 bp, Oryza sativa
  unsure (1)..(7993): unsure at all n locations
cgggaaaccctggaagaattcctcgtacttatcacaagccagcgtgggcaacggctgggcttgtagtgtagctttcctctaactgatgcatccaggcaagggtgggcgtgatggagattggatgggccctgcgacggcctatgcggcttccggattcatctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtccagttgtacacctctgatcagagtaaaactattcgaatagccatgcccgcggttatgggcggtcaaccagattcgctgtgattagtttcaccctagtctagtctaatggaattgaatagtataggtggatggttgggcctgttgcaatgtggtgtagcgttggacagtggatgtttaatattgattaattattacaaatgttttactgtttccaactactgtttataaatgctcgctttatgcaaatgaaccactatagctatccctcgatacttccctgcatcatacccctattccggtatgacgtgctgagtacagtgggtagtactcagtcttgctctatttttcccaaaccccagagtttgagtatgcgtcagatggtggcttctccgaggagtaggcttcgtccgtgccgtcgagaatgcctgtggagtggggatcccgctgcggtgcaagtcaaggcttagccccatttatcttttaattttccactgcatttatgtaagacttttataatgtttgtaagacgtggatctgtatgtcaactttgttgtttctgttccccggccggtcctggacgagaattttaatgcacattctgcttggaattctattcgagaatttctgggcgtgacaacaatgctggaggattgtttcaaatattacaagggatgtcaagattgtcaaaaatttggagcgattcaaagggcacaggcatcggctatgaatcctattattaaaccatggccatttagaggttggggaattgatatgatcggtatgattaatccgccatcaagcaaagggcataagtttatattggtggcaaccgattattttaccaagtgggtagaagcgattcctttgaagaaggttgattctggggatgctatacaatttgttcaagagcatataatttatcgatttggtattccccaagccattacaaccgatcaaggttcaatcttcgtgtccgatgagtttgttcagtttgccgaaagcatgagtatcaaattgttgaattcttcaccatattatgcacaagctaatgggcaagccgaggcatctaacaagagtttgatcaaattgattaagagaaagatttttgattatcctcggcagtggcatactcgattggccgaagcgttgtggtcttatcggatggcttgtcgtggattgatccaagtccctccttataagcttgtttatggacatgaggctgttttaccatgggaagttagaatcggctcaagaagaacggagttgcaaaatgatttgacagccgatgaatattataatctcatagccgatgaaagggaagacttggttcaatctagattgcgagcccttgcaaaggttaccaaggataaggaacgagttgctcaacattacaacaagaagggggtgcccaagactttttcggatggtgaacttgtatagaagttgattttgccgattgggactcaggatagtaaatttggcaagtggtcaccgaattgggaaggaccgttccaaatctataaggttgtatctaggggatcttacatgttgcaaggactcgatggagaagtttatggacgagcgctaaatgtaaaatatttgaagaaatattactcaagtgtttgggttaatgcatgatcggctggtgttgccgatacattatagccgatgtattcacatcgccttgagatggccgatgttatatcgcccttagttggtttcatattgtaatcggatatggtttgccgatgtacaatggctgatattgctatatcgcccttagtacaaattataattttatcaatgcttttgacattgtaaaattaggggggcacatatatgaaaaattgcaaatttttgagcaaaaaatatggagttatattgaatcggcataaaggttatcaagatgagttagataaagagctagagtttcttagccgattacaaaatttcctaagatctattacacaagatatcactgagacaagtagcgctggatagccgatatagctctttgcctaatttgttctacttcttcaatggcttgggcatcttgagcatcggtttcagagatgaatcttagggacttggtcatatcagcgacattcttgatagccgatttcagccttgccttttgttcttcgacagattgtgggagatcgactagcttcttgtgttccagatccagatcggcattgcattcttggagttgtgccaagagctcaatcttccgagcttcaagccgatcaatattagacctgatcgggccttcagatagttgatcaagtttggacttttcttcatgcacgagttgccgattggcttggatggtagcttcaatctctttgcgttctcggcgttcggctagtttctgcttggctttctccagcttgaattgatgctgttcaagataagtagctggagtaaggacattggctagttcttcaggaattagagcttgaacttcgtgtagccgggtcctaattgatccacagtcgaccaccaagctgcctagagaagatgcctctagccgatgagagatatcttcaagagttttcttcacatcatcggataagggggctaaggctttgcttgtggtatcctcttctgtctcatcaaagtagtccttgatgtcaatagagaatagatcggctaagacccgtaagaacaatttcaagagagttaggagctaaatagacatagccgatctaagttcttgtatcaaagggaaacttactgggatagcaggagcggctggttgttcttcttcctcaacgcggtgactccctatagccgatggagtttggtcactggatgattgctgtacagggggagaaggaggaggaggctaaaaagagacaagtattagataagatcggatgagatcaactgctgaaagaattaagaacatcttattggtggagccggtttgagagttggtgctgccgatttcttcttaacagcaattctctttttctgcaaagacaagattaataagtaatcggctgaagataaaatggttataaaagggaatcagggaatggtacttaccctcgagaaatgagctggggcagaaggagttgaaggggtttgattgggtgaagccgatggtgttttatctgtatcacttacttcggctgcggcttgatcaacatcttctccgatttcctcttcatccaaagcttgttcaatggatggatcaagggcaggcagatcatcggttggcttgggtttctgttttttggccttcttcttgagagccagaaccgatggatcaattgctggcactttggttttccttttcctgcctgcatcggctggttctctcatctgcccttggagcagacttacggtcttaggggcatgatagccgataactggaggggttagtccaccaccattgggcaataagcctggggtatactatatatctctgccactgttgctttggtgtggatgggaagattctgttgtctgtaggataaagggaaaagttggtttaagattcaagttggttaacaagttatgcaaatgaaataagcaaagtaaggatgtacctgagggacaacatcagggaatagatctgtcatatacatagaggccgactgatggaatagatgctgcttccattctccccaccatctatcaaaatttctgctcctgaatcttgctagttctatattctcaatgctgcccaagggaggaccttggatgttgagtagccgatccatcatcagggttgatgaaatttctccgcggcattgaattttgtcagcaaagaacaagccgatggggagttggcaaattccaaattgcctggccgaattctttgggtgatagaattcataggagacttgaatgtttctcccttgatgaataccgacaggaagaatgcatgggctgattgcagctgagaagacttctctagacttttggaatctctcatgattgatgtctttgaatctaaagtccaatgggagatccaaatgcactgagtcttcataaggaaaccaaactcgagcatctttctgaaaaccttcatagaagctgcagaaccaatccttgagcaattcggctcttaattttgctcctgcatcggctggtgtggatgcatattctccatatgacatgcatctgcgatgggtgcggtcttctttatcatcttctacaatcggctccagtcttgggaattcggcttctgtcacaaatggccgattgacgactgtcatgaccatcaggttgagccaagactgtagcagccaccatggtccacctgctccaaccactgagccgacgactatcttggccgatgcattgttcagcatttggtataagtagccgaggaggatcttgcctagaggaaattctctttttgattccagagcctcggctgcaaactggcagttggttgtacgaccacaactagatccacagaaaaggaacttttctagccacatgagcaaaaaggccacatgttctcgaggagtaacagatccttggcccatatatgccgccacataaccagaccaaccacctatgctcttggtcctaaagtcgtattgattattggtgttcagactcatagggttagccgatgaggtcacatctagaccaatgatcatggtgatatcaatcagagttggggtcatcggaccttggttgaacagaaaagcgttgatggtattggaccagaagtacgtggcggcagccattaagggttcatccttagccgaatttgctatggtgagggcgagtgcttggccgattccaatctcgtcctagtgagtttgcttgttagccgatacacgcttgtaccatgtggtccagcttttctcaggggaagttttttctagagatggccaagacttgaaggtgttcttccaatgacctagattagggttggccaatctgaaagggattctattggtttcgccaatgatgaaattagtgggtcgacatcgccgatcggaccaaggaaataatgtctctcgtgcgatagacttgggattgtgaccagattggaaagatgctaataatccaaaagggacagaggagaagaaaacaagatgagatgggcacatacatcagcatattcgactgatggcgcggcagacaggctggcggaggtcgacatcgctgcaggcggaaatttggacggagaagagatcgcctggaaatcgctttgtgcatcgagggggtcgccggagagagagaggacggagtttgcttcggcagtgaaaatggaggaaacggtgtgagatttctcggggacaacggttagtatttaaagcgctgaataacagtcggaaaatggcaagcacgatattctctcggagtcgacgtatgacaaatccgaaacattatccaatattccggacttggggggcatgtgttaacgaccaaatttggtaatccaaggatcggatgtgaaggaggaatcgagacggagttcaagatagagattgtcccagaaacagagtaaggatcggctaaggtccgaatcggctacgaccaagatcggcagagttcgagtcggacgggattagccgattgagccaagtccgacaatatgacacaacacacgttcaatacaatctcggcgcatcaccaccctttttattttcgttttgtttcgacgagttcttgctttcgggttgagctgcaacggttacgatcttcaagaagaggtaaaacttgttatggcggcttgcgttctcgagattagtgcttccatcttcatgacactctaatcttgtttatgtaattcgtcgagttatcatatatcttacataatctctggcaatatcgctatctaacctacaatcggctaacatctgtcagtagaaggcagccgattaggttaaatatcgatattgacttagattatataagatatccatcactctatgacacatccaacggcttgattgtctagatgttgtccttcttttcatacttatagctgcatcagttgagtttgatcttatgagtcgtgattagaatctcaaatctctagcctgtctttggttgccgattagggtagtatcggagtttcagctgatcttacctaacttaactatattcatcttatatgctttactgatatgttaaatctgccctttatgttaagatcttgttgcgttaaaagtatattaggctttctgtttgatatattctacttgcattaatatcttaatatagagtggtatcggagtattagccgatacatgctagatctatctgatcggctatgctatgtacatatatagtctcattattaatatatatttcgatttaagtgatttatactatctcggcatagcgaccgatctatcccaatcacaaggattgcgtattgttaatatctacagccgatcgagtagatttagtatatccgacataaggattgtgtattgttaatatctacagccgatcgagtagatttaattctgtcttacttattaatgactgccgatcgatgcatatatgacatcggctcaaagataaatgatatgtcatcggcatttagccgatcggcgtttatggatttaatcgcggtttctttgtctttgtttcttattgattgcaggatcaaattaattggcacgctcacacacccaaaggcaagttttggacctgcactagagttaagcagatctcccaggcctcgtgtttttacatcaacaaaacccaaattcatccctacagccccacatccatacagcacattcgcattcatatttcacattcacatccacattctacattccacattccacatccacatcacatttcacattcacatttcacaattcacattcacattcacattcacattcatcacaacaaataaaaacctacaagccattcatcacaacatataaaaacctacaagcctaagtcaaaattcgtaaatccaaactcaaaatatatatcctaaacatttgcatataaatcctaaacatttgcatatatatcctaactcaaaatatgcgtagtttaaaattcctaagtcaaaagattgtaagtctaaatttttaggtcgaaaaattcctatgtctagattatgaacattaatatgaaaaattcctaagtctgcaatatttaagaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtctnnnnnnnnnnnnnnnnnnnnnnnnnnnnnnnnnnnnnnnnnnnnnnnnnnnnnnn

SEQ ID NO: 24910 - DNA, 1599 bp, Oryza sativa
tcaaaagattgtaagtctaaatttttaggtcgaaaaattcctatgtctagattatgaacattaatatgaaaaattcctaagtctgcaatatttaaaaattcataagtgcaaaaatataaatgcgattgtattttacctccaacatggggtgagcctatgattttaagagtttctcatcctcaagtcatcgagcatgtaatagaaaacatagaatagaatccataataatagcaaatattcaaatgcattacacataaagtacacttccatagttcatgcataaacactaattaaatacatttttttcacataaatctagctagtaggtttttttttcctaggagctaatttcttcgcggcttggtgccgagggggaggggcagaagattgcactcgttgtggggccttgttgatgttgtattcgccacgacatgatgacggatgaacccgcaaaactcgtcagtgagagctttgaagacgtgtggtagaatttcacttgtatcgagacccaatttctgcaacgcaaggatggaagcacgtagaaatttacttagtacttaaatagaattgctcaatgttatgacttaggtacctgaagcatgtcatacctcagcattgcggtgattgtatccatcctctacaaaatatagcatgtaccgcatgacgtagaatccacagaggtcgatggcctctggttgacgaaggatatatttatgttcgaagatccgaaattcagttgcatcaatcttgcatctcccatacgatcttccggacctacagtacttcttatatgccctatttagtgcactgaaaatagtttggtacttgtctatccctctcctcaggctatcatatatgcaaattgaactatcgtcgatgttgattacgaggaggatccaatgatggctacacatagtgacaatttatcaataacttgatatgggtcgaggggcaaacataactggaaatcgatgatagtgacttactgagaaaggtaaggaaataaaatgtggtcacatccattaagtttggcgagggcatcaaagagatagcggtcaatttcagcttcggatgtgcattgcttgtcaaagtttacaacggctgggtctagaaaagctatcttatggttcatggatctaacctgataagagcaatgcccgcaaaaggagaacacagttgagaattactgagtacgtagaatgctatggattaagaacgacaagatatcaaaggactcaaaatgaccacaattgcaggaggcagatatcgaattcccttctttggtacaactggaagagttccttaaattctacaaagcatgtattactggggtggtgaaaatccacatcagtgtagtaggcaccgaacatcccgacccccttttttggcctcctccaaataccattcatgcagccaatgcgcttgagttcctaaggattcaatttccgtgtcaagcaccatcggttgaccaagttggaatcgcagtacaatcggggcctcttcaagttcatctagattgtctaggcttttcaaaccagctgacttgcagaaatcaacttccttggacgctttctcttcaaggtacaactccctactgag

SEQ ID NO: 24911 - DNA, 3130 bp, Oryza sativa
  unsure (1)..(3130): unsure at all n locations
nnnnnnnnnnnnnnnnnnnnnnnnnnnnnnnnnnnnnnnnaccaaaaagtgaagtgatgctggcattgattgtcttcttaggcagcgatgttgttggctttgacactaagtatgaattggaatgtgtgagtcactatttgcttgatggaacagacatctgtgatgcacttggtgttcgggtcttttttctgagtgggggtggacttgtggacttctccggacgatgtggttcattaggtgtgttttcacgaggtggactgaaggtcctctgtcgaggcggagaaggagctagatttgcacctcgtccgtttgaagggctggaagcaccgtcgcctggatcccctgccccatcgttcaacgtgataacgatgtagcgtttgggccatatgatcaggttgtgaagagcagcgcccagagtgtcaaccccttcctccggaggaaactgtagcacataacctctgtattggcttggcacgtcttccacttcaacccttgagtggcctacaggcaatggaacaccatgtattgtttgccctgcacatattggatgtgccacaccgcgtgcaatctcctgagtaatgttgctttgaagagggacatggagcacgcacggcatatgtgttgttatgtcgtccacaacataacgtgatgtgtcctgttctggaggggggttatccgcggacgcgcaagtgctccgtttggcacctgggttaaccacttggtcaccagcttgcccctgttgtcttggtaacccattgggaaacagcactgcaagttgttcctttacctgacgggccacctctaatctcatacgtttggcctcctcttctctcatgggtcttcttggatgggcccgatacatgtgtgcatcatctgggaacccttcctttcatggaacggaaccaacgcctctcgtgcgtccagggtgctctttcatccccagtgccaatgtgaactcatctttttctcttactggcacatatttaccctgtctcgccaaggaaacagcctcggtgatcttttctttcagctcttgctatcgaggtcccagtgcaaccaactcccctgaatccgatagttgagccttcctggcgtacgcgtagtgctttgtccgggtcccccatccatctatctcaacaactatacctgcttggcacagttgttcctccttctcttcccatttggggatattcttagcatatctgctcggcccaagtcggtgaggaagcttgttcaacgcggagttggccttgtttagggtgctcacttctcttgcctcttgagatgttttccagttcacaaactcatcccattaatctgtcaacttctgatacctgggtttctcaaaatccagggtccggttgcgttggaccaacttcgcgttcaagtcagtcctccactttctgaataatgtgctcatcttcgataaggctcccttctttgctagctcttcttggccttttggaaaggtgaatgtcagcttcaactttcgccaacattcttccttcaggttatgtggcaccgtccagtcgagttgtgttacatcatttgttttccaatgtctatacttgatgggaatgaaatccttgacgatacatccacacgccctaccatagggagttactgccgtcgatggttcgtgtggccacccagtttcagtgagcactgtcacaacgtagtgaccatccggcatcgagctaggacccctaggctacctcccatatgagacggttgaatcctggcccgaaccaccagtggaagtgccaacctccttggaaattgcaaattcgattagttcgaatggtccattagagttggaatttgctaatgcactattgcgtgaaatatacgtcgaaattacctcgctgccttcggaatgctcttgatttaagtttaagaatgcgctagggctggcattatgttcaccctcagatccggagctagcgaattcttcgtgttccatctagtcatcatcgagcataataacattactaatgttgaaaaataacatggtctaaaggtgtaagatattttgtgctctcggaactgctacaagcacaaaacaggaatatatttgctctcagatggcgggttgccaacttaatggcctcctcgccaaaatatggcaggctgccaattgcacggcctccatgccatggtgtactaggtcgtcatcgattatgtgtggcagtataaacagagacgagaataaagggcaattcaaaaatagtgaacaaaagagaataagggagagagcgtgtggataagagagatagagggtgaagtgggtaagtggttggccgggtaattaaatagtaggagataggtgccggttttataccctaatccggcacaattcacaaatcacacaaataaatgaaatactgccacacataatctcccatcatatgaatttcatcatcgagcagcaagttatattcacatggggagtttggaaagattgggtaaatgttcagatgtgcattccaagatatacttttcctttaccaaacaagaaatgaggatgatggatcatggaaacagaacctaagggcatgaacatattaatactagtaatataacctaagtaagcaagtaagcaacctaagtaagcaacattttaaatcagcagcagcataaaaaaaagctattagcaatccagggagcatgctcatataagtattggctcacacgaaaaactgtactcttatcataataccatagatctgatcaactgtatgagatcatacaaaatactggtaatatgtaagacggatgctctcctagtgtcctgacaaaaaattgcaggccagcattgttacagaacaaagtggccttaactttagtgagtttatgattaaaatttagacaattctgatcaactaggcaaaattttaaatttgaaacaataggaaaataagtgtactctccatctccatcccaaaatatagtaacagattagacactgcctattactacattacaatagcgtgtcgattcagtaaataggcaactgcatcaaaaatcaccctgggaaaccatgctaggccatgcacagtgagaaacgactgtcctaaaatattaatatttagcataatcgacagatgtagtattgtatccaggtattagt

SEQ ID NO: 24912 - DNA, 1794 bp, Oryza sativa
  unsure (1)..(1794): unsure at all n locations
ttcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacatacaacgcttggtcattctcttcagcagttgcctcgttttccgtctcgatatcaattgtgggtagcggtggctcatcgggctgatcgtagtcatcttcgtcaatgatattctccattccgacaatacttcgcttgccttctaatacaacatgacatggcctcatgagtgatgggtccttaatatagaatatttacttaacggactttgcaagcacgaatggttcatcttcgtagccaacatcattgaggtcaacgatgatcgttccatgcttgtcaatcttcaaaccccttggaattttgacccatttgcattggaatagagggactttgagggctccgtaatctaactcctagattgactctatgaaaccgtaataagtctgcttattgccgcctcatcgtaggcatcgatgcgcacagcactgttttgatttgtactcttgttgtcctgagtcttggtgtaaaaggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaaatgcagcgggaaagattaaagcgagctaaaccgggaagcttgacttcagcagcgggcgacgccactccacaggcaaaccttgacggcagcgacgaaaccaacctctctgagacggctctaactaagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaannnnnnnnnnnnnnnnnnnnnnnnnnnnnnnnnnnnnnnnnnnnnnnnnnnnnnnnnna

SEQ ID NO: 24913 - DNA, 1461 bp, Oryza sativa
  unsure (1)..(1461): unsure at all n locations
acgagggtgagtatcgttgggtttgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgagtatggttgttcaggatggttgggcctgtacagcatgggtgtgctgttcagtgttgattaaaatttttaattaattactctactgttttactactcttaactctttgctaannnnnnnnnnnnnnnnnnnnnnnnnnnnnnnnnnnnnnnnnnnnnnnnnnnnnnn

SEQ ID NO: 24914 - DNA, 789 bp, Oryza sativa
  unsure (1)..(789): unsure at all n locations
nnnnnnnnnnnnnnnnnnnnnnnnnnnnnnnnnnnnnnnnnnaaataagggtaacgccttctctcccagcctcgatatgaaccgacttagggcggccatgcaatcggtgacgcattgcacatccctaagtttgctggggggggcgcatccgctctatagcccgtatcttctcggggttggcctcaatgcctcgggcagagaccaagaacccgagaagcttgcccgcatgtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactctggatggatgacctcacggatgaatccggcctccagaagtcgtgccacctcctcgcggatgaaggcttgacgttccggggcct

SEQ ID NO: 24915 - DNA, 7804 bp, Oryza sativa
  unsure (1)..(7804): unsure at all n locations
tgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggttgcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcctcttctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccgtcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccgtgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaacaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatctttccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgatcaatttggccacatcgtccagccaacgttgggctggagactccgggtcatgggcgacgggcgggtgacgtaggagcgcgcccgcagcttggagcgcgccctggggcgtgctgccatcgccgtagacgaggaggcgacgctccccatctcgccgcccttctccacctcctgtgggtgtcgaagtcgcggatccttcggccctctcgagcgccttctcccgcataggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagtcccctacctggcgcgccagatgacggagcgtggggctcctcactgggagaccgcacaggcccccctttgccagttcggccggggactcagggtgagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatgagccagcctctcccttgttctgggttccccatctggaaaagtccagtcccccctcccagtgggcaaggtcctccttttatatcttaaggggataccacatgcaccatttctctcttttttgtggggacttaccccaccttttcataaatggacggagatttgtatagttgccgtccgagtcaccatctgatgagacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccaccaaacccgcgatctgaccagtctgtgactggtcacagaccggataaacgagtgcactgcactgcgttacatgcggcatgacgcgctcagccaaaccgcaataaatgtggttaggtgagccccattgtgctcacctaacccatacacgcggagcaaaaacccacgaggggtcggggcgcctcggccctcggggccgaggcgggtgcggcccgaccccctcggggggactaagaggagggcgaacacatcaccctcgggcccgacgtcctcgggggtgccaggccacgtgtgcgattgtgtctgcctcaaacctctagtcatgatactcctgatcccatgtcaccgacagacggcgtgaagatcagcgaaattgagccacaagaaaccttcctcggccatgaaagcatcaagtgatgttcaaacagctaatgacattaggcctttcttgttggcgtccgtgtaccatttatgtaatcttctcatctcccacggaccttcttcaagtgcataatccagccaaaaggctttgccattttcaaacactgccagacaatcatctgttccaaagtattttgggccggcaagttcaccggtcttcttctcatcaacatctctttccttggcacgttttttaccacctcagaaggcggttaccatccacttcaccttctgattatccttggacttggagttgtggcttttgaccagtttaggcacttcggacttgtcgatgacatagtcatcgaccgagggtgcgtccacgttgtcttttgcaggagatggatcctcatacacatctggttctatttcgacccattccaaacctgttgcgacttcgatttcggttctattgctggcataattgacaatattgctgatgtagatgccacttcagtgctcttaggttgctcatgttcttccaccttatcattcgatagttgtttttgaggaggtctcagtggtttcgacagagcattgttgccagtcccaaagagtatatctttatgtgctacaatactataatgtcaaccgcatccccaagtacggatatgccatcaggagtttggatgtccagatcgtatgactctaaccctttgttcaccacttgcaactgcactttcgcataatcatatggaatagtgttatcgtgataaattcttcaagggatatccattccaatcgcagccacaagggttcttccagctctaccatgtgggacgtattctctttcaagcctgttgacggtcgttatcgataagtttcgaccatcaatatagccaaaatagaggagaactagtgatgcttgcaatgcatatacatgttagaataataatattccactagtattaggttcactaaccttttgcagagaataaaaataaagtggaggagaatcgacatcaacatagatgataaatcaatcgggcgatgttgagaatcagacttatgtatgaatgggccaagaacttagaattgacacgacaaactgggccaaaattcacaagtttgcatagaagaacaacggaggaggccgctagccgaaattgggctggattgggccggccctagatttggccgaaccagggggttaggccgaaccctcatcagcgccatctgatccagggcttcgcctggacggtgtggattatcccccaatgacggttggagggtatttctgaccattccaaccatcacaatcgtcattgggaggctataaaaggagttgctcttctcacttcactcacacacctcaagcaatagctctctcatattctctcaagtttagtttagtagtatctagctagtggaataagaatagagtagaaatcaggagtccggaagccttcggaagagttcgggtatgactctagtagctttcctttcctcttttgtaagctttgtacttttattagaatactcttctttatacatttatggtattgaaatactttccgagtatatgaatgcctactttatattatgttcatgttatactgaatatactgctagcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccgcgtgtgtatataatcctatgttaattcactggggagggtattcctccttatttagccccggttgtatggtcataatgggctgtcgtaaggaactcgacagtcaggggtggcttctcagagtaccaggagagcatcggatagagggtactagctagtatatcagataacaagaatgtatgtatactatatatattagaagtataggaatagattatctttctcttttctttccacttagcttagataatatattatgagaataagtagctaatgcttgtgtgtcactctacccttggattattctaacccctgcttagaatatgattatcacaagtaatatataaattattagtcaagttctctctacatgatcttcccacgggataaaataaatatgatacccttggaatactctcgggtgaattgctacaatggtatatccgtgcgcttgcggataaactctataaccataatataccataagtatttttgcgccattgctgggaattatatttctaataatgttgttaagaaataccaacaagcatttctagcgccgttgaaggggaagattcataacagagattaactgaactaatactttatatttacctctgtataaccttggttgttttcacttttgttgtgaaaacagggtcgtgcatgactggtttcaacttgccgggaaacttcaaggaaaatctagaagctttcatccggagcatcaggtcgcgagtcattgctccgcagaaaactctaccgacagagaaaccagttgtaccaacgccatcatccttcaagactatggctgacaagacccttcgcgagttcgctgctccctctgctgagaatgtggccatttggccacagatcaacatgggagacgtggatttcgacttgaagtccagcctcgttacgttggcacaggctagcccgttctgtggcaagcctaacgaggatgccaacgctcatctacagcagttcctggagatctgtagcacgtgcaccatgaagggcgtcggtcccgacgccgtcaggctaaggctgtttccgttctccctcctcgggagagtgaagcagtggttctacgccaatcatgctgctgtcaacacctaggacaaatgttctacggcattcctctcgaaattcttcccaacgggcaaaaccaatgcccttcatggacggattccagtttccagcagacaagggacgagtccattcgggaagcatgggaacgtctgcaggagtatgtggccgcatgtcctcatcatgggatggaagactgattaatcctgcagaacttttataatagactcaccccaatgtcccgccatcacatggtcgaggcagctggaggagcattcttctctaaaacggttcgaggaaccgttgatttaatagagaagatggtctccaatatgggttggagcgaggaacgactccagnnnnnnnnnnnnnnnnnnnnnnnnnnnnnnnnnnnnnntgttagtgatatgccctagaggcaatcatagagatgattgtatcacatactatgtttacatatttatttgacattgttccttgaaatagataactccttattggttaatgaatatgtgattctttcatgagactctttatgttgtttgttactatttctaaaggatccttgatcaaatatcatatgtggaacaaatatgtttatatgatcagcacatgtattaattgatgatcatgcctcatggatcatggtatagagataccaaattaataatgtggacacatgttggtgaacatgttgttggatagacccaacatgagacactacaagagccctatgtgttgtgtcatcagtgatctcatttagtgttggtgttgaatccttagacctgagattatcatggttctcaacatgtgtagtagcttacttagggactgctaaacgctactccgtaaatgggtagctataaaagtagttttcggatatgctatgaaacatgtagtgggatatgaataatcaagatgggatttgaccctcctatggagagatatgtctgggcccctcgatgttgtagattatggaagtgcatggccatggcaaaggtggaggagtcaatcacaagttacataatctatcaacaggttcgagtgaatgattgagctattagaggatggcatatatctagccttgagcttaatcgatatcgtgaggcaaaggggttcatacaagtatacactagaggttcagccgatatgatctttatgtatgcacggtgggtcaattcgttctactaggagccgctgttgacgcatggaccgaaaaggagttttcgggttgcagccgagtatacatgaacctacagggtcgcacgcttaatgggccggactaaggggattggatggagatccaatatgagcatacttcgtatagggatccaaataggagtcttacgggccttggaggcccgagtgatggatcctatatattcgtgaggggtgtgaccggtggaggcattgcatcacgtgagaaaccctagccgtcacttccctccccgagcaaaaccctagccgcgcgcgggtgctagcacatctgcgcgtggcgtttcgtccctgtatgtgtggataccggtagaggcgccgctggtttgcggtgctgatcagcgtaggagtacggcaaggagaacgcacgaggaggagaaggtcgagccggtgcgatcgactacttcctctacaacgacgcgtgctacttcgcgagagtttcttcgacttctcagtgtcttcttccgctgcgcagcgcgtcgagtggtaacgatatatgatctaatacttgcttggttcctggtttatgcgatagaaatgtttgatttatgctatcgtagcttacgcttatcccaacagtggtatcagagccgccttgtatagtttatgatctagatcattgcatat

SEQ ID NO: 24916 - DNA, 2611 bp, Oryza sativa
agatctatgtaccccgtgacatggtaggatagattccctcatatctatgtaccgccgtgtgcgttgccccttagatttcgcttggggtttttatatctatcttactttactgctgttgtatattggatatgacatggtaggatagattccctcagaaaaattaagtgtgatttatgctcttccagtaattgcacctaatacggttgtgatcataagtgatgggtttgtcatagcaaagtgtcactttttatcatgataaaataggatagatgtcggacatctatgtgcggagattattggtttacttgacaaggttattaaaacagttttggaccttggggcataggttgggttggacatggagatgtcaccccaacagcacaagagtcacatatgatgtgattagcaaggtgttgcttacctattttgatagttgtctagctatgatgccaaagctcactagacactaataaaatgaggatcttgactcactatgttactagagggaattttgtttcacaatacatagtggaagtatcttttgttaaattgtttaatgaaaggttaaatgtaaacatgatgctgattttgcatacatatatttctattgtagatcatggcagctcctgcatcatccaattttaacttgcggtctattcttgagaaagagaagttgactggaataaacttcatggattggtatcgcaacctgagaactgttctcaggcaagagcacaaagagtttgtgcttacagagccttttccagctaacttgcccaacaatgctcctgctgctcaacgtagggagcatgaaaagcgatgcaatgattatcttgatacaagctatctcatgcttgctactatgtcccctgagcttcaaaggaaatatgatgcattggatgctcatacgataatcacgagactacgtaacatgtttgaggaccaagcaagagctgagaggtttaatacctcaaagtccttggttgcgtgcaggctagcagaaggtaatccaatgagcccacatgtgatcaaaatgattggttacgccgagagtctggataagcttggttttccccttagccgagagttggttactgatttgattctccagtcgctacctcccagctttgagccgttcataatgaatttcaatatgaacaacctgaacaggaccttggcagaattgcatgggatgctaaagactgctgaggaaagcattaagaaaaactccaaccatgtgatagttgtgcataagcgcaagcccaacaacaagaaaagttgtcaaaagagaaagctaaactctgatgagatcacgagtactagcaactctaagaccaaggttcaaaagacagggcccgctaaggatgcagagtgcttcttttgcaaggagacaggtcattggaagagaaactgtaagaaatacctagagcagttcaagcagaagcagcaggatggaaagagttccacctcaggtattaatgttatagaaattaatcttgctacttcctctactgattcttaggtatttgataccgggtcagttgctcacatatgcaaatcgttgcaggggctgaaaagaagtaggagcttagcaagaggcgaagtggacaatgattgttcagtctattataatgacattttctatttccatgcacccatgatgaatggcttatacattgtgaatcttgatggatgttcagtctataacattaatgcaaaaaggcaacgtcctaatgatttgaatcccacttttatttggcattgtcgcttgggtcatataaatgagaaacgcatggagaagcttcatagagatggacttctacactcttttgattttaaatcatttgagacatgcgaatcttgtttacttggcaaaatgacaaaggcacctttcacgggtcaaagtgaaagggcaagtgaactattgggactagtacatactgatgtatgtggaccaatgagctcaactgccaaaggtggttttgggtactttattacctttaccgctgactttagtagatatggttatgtctacttaatgaggcataagtctgagtactttgaaaagttcaaggaatttcagaatgaggtacaaaatcatttgggcaagacaatcaagtatctacgatttgatcgtggtggaaagtacttgagcctagaatttggcaatcatctaaaggaatgtgcaattgttccacaactcactccgccaggaacgcctcagtggaatggggtgtctgaacggaggaatcgtacattgttggacatggtacgatcaatgatgagccaaactgatctgccgctaagcttttggggttacgctctagagacagttgcgttcacactaaacagggttccatcaaaatcagtggataagacaccatatgagatatggactgggaagcgtcccagtttgtctttcctaaagatttggggctgtgtggtctatgtaaaacgtttgcaatcagacaaactcacacctaaatcagataaatgcttctttgtgggatatcctaaggaaacgaaaggatattatttttataatcgggaagagggcaaagtgtttgtcgcccgacacggtgttttcttggaaaaagagtttatttcaaga

SEQ ID NO: 24917 - DNA, 6857 bp, Oryza sativa
  unsure (1)..(6857): unsure at all n locations
cttgaatccgttaagacatcgttgaaaaatagtttttcaatgaaggacttaggggaagcaacatatattctgggcataaggatctatagagatagatcaaagaggctaattggattaagccagagtacatacattgaaaggtgttgaagatgttcaacatgcaagattctaagaaaggtttcttaccgatgtcacatggcattaatcttggcaagaatcagtgtgctcaaacgactgatgagcgaaacaagatgagtgtgattccatatgccttggcaatcagattcatcatgtatgctatgctatgtacacgtccagatgtttcatattcacttagtgcaacaagccgataccaatcagatccatgtgagagtcactggatagctgtaaagaatatcctgaagtacttgagaagaactaaggatatgttcctagtcaatggaggacaggaagagctcgttgtaaatggttacaccgacgcaagcttccaaactgacaaagatgattttagatcacagtctggatttgtgttctgcctgaatggaggcgctgtgagttggaagagttccaagcaagatacagtgtctaattatacaacagaagccgaatacattgcctcttctgaagcagcaaaggaggctgtttggataaagaaattcatttctcgactaggtgtggtgactagtgcttctagcccaatggacctctattgcgataatagtggtgccattgcgcaagccaaggagcctagatcgcatcaaaagtccaaacacattttacggcggtatcacctcattcgcgagatagtgggtagaggagatgtgaagatatgcaaaatacatacggatttgaatgttgcagatccgttgacaaagccactccctcagcctaagcatgaggcacacactagggcaatgggtatatgatacgttcatgattgactctagtgcaagtgagagactgttagtgatatgccctagaggcaattatagagatgattgtatcacatactttgtttacatatttatccaacattgttccttgaaatagataactccttattggttaatgaatatgtgattctttcatgagaatcattatgttgtttgttactatttctaaaggatccctgatcaaatatcatatgtggaacaaatatgtttatatgatcagcacatatattaattgatgatcatgtctcatggatcatggtatagagataccaaattaataatatggacacatgttggtgaacatgttgttggatagacccaacatgagacactgcaagagccatatgtgttgtgtcatcagtgatctcatttagtgttggtgttgaatccttagacctgagattatcatgcttctcaacatgtgtagtagcttacttagggactgctaaacgctactccgtaaatgggtagctataaaagtagttttcgggtatgctatgaaacatgttgtgggatatgaataatcaagatgggatttgcccctcctatggagagatatctctgggtccctcaatgttatagattatggaagtgcatggccatggcaaaggtgattgaggagtcaatcacaagttatataatctatcaagtggtaacgatctatgatctaatacttgcatggttcctggtttacgcgatagaaatttttgatttatgctatcttagcctacgcgtatcccaacatgcacatagtcaaggagacggaattacttgctgccaagcttgacctcctcatgaagcgcttagacgaccacgacaaacggcctcaagacactgtcaaggctctggactcacacgttacatgtgaggtctgcggcaacacgggtcactctaggaacgactgccgggaaacccgtgaggaggcgatgtatatgggcaacaacaacaacaacgggtatcgtccacaaggaggccaggggtggaaccaaccacgcctatattatcaagggggtaacaacaatggtaacttttctaaccaaccctccttgaaggatctcgtcattgcacaagctaaaaccactgatgcgctaaacaaaaagctcgctgccaatgacaagatccttgaaaatataaatgttaagctagatggtttgcttccgcttttcaaaaccaactgagctttaataaaatgatagaaacccacctagctcagttggcatctttagtccctgcaaaagaaactgggaggattccggggcaacccgactcctcccttgaaaatgttaaggcgatcacgacgatgggaggtaagtccactcgtgatccaccatatcctaaccctgcacgaactaacgggattacaaaagaagcgctatctagtgactcagctgacaaagaggtttagcaagaaaagaccatgccgcaggagtactacgacgcacggttgctgtcgtttcttcaacggagtaggaaaccgttagtagacgagcaattcgctcgttttgttgaagtaatccagaaaatccacataaacgtgctgttgttggatgctatgcaagtactaacatatgcccgttatctcaaggacatactcaacaacaagagaccactcccaacaacggaggtggttaagctgacggagcaatgcagcaacgtgatactccacaagctcccaaagaagaagaaagatccggggtgtcctgctcgatcggggtacagcagttcgaccaggccttatgcgatcttggagccagtgtcagcgtcatgccaaaagacgtctttgacaagctcaacttcacggtgttggcaccaacactgatgcgcctacaactagctgactcgttagtccgttacccagcagggatggcggtggatgtgccagtcaagatacgggatttcttcatcccggttgactttgtggtgctagacatggacacgggaaaagagatgtcgctcatcctggggcgcccattccttagcactacggaagccaacattgacgtgggagcgggaagtatccgttttcatattaacgggaaggaggaaaagtttgagtttcaaccaagggtcgaacaatgctccatggtcaggataaagtacgggccgaacccgcagaatattcaagtggtcgaagtggagccacccaagacggatagcctggtgaagttcatgcagaatttcctagagaaggaaacaacgatgcctaggaaccgttattggaggacgttgataaaaccaactataccggccaagaagtcagagcagtcggctgagaagaagccgccttctgcaccaaagccatggaaggtgtggagggaaaagccaaacacgcccgctccatcacctccagagacgggtggaaaatccacgaactgaatcagaaggaggtacagtcttgcacgtcggattttaaatgacgcgaccttcgccataggaaattggtatgtatctgcatttttgctttcaacaatttgaatttatgcatcaacacatgtttgaatttcaaaatttccatttaggattctttgagttttgaggaaaatcttcaaatgaatttttcagagcaaaccaaaataaaattttcaacgaaaattcactgtgccacgactgcactaaccgttggaatccaacggccgaaagtggtgccggttgggcccacgaggggttcgaccgaaccggccaggcaacagttacctaccatttttggctgggcaacggctattgggtcccacatgtcttttctgacagttgtgggtaccctataaaaaccagccggccgagagggaattccaccccatttcaatacattttcattccctctccaaagtttgttctcaagttcattcaagcttttatagttttcctcaaattcaaacactagttgcatatatacaagttgctttggtggaactaaccggtgggtgaaactcttgctattctaacccccgtcgggttagtctgttcttgctccattgtgcagaatgaggagccgattgtctcatctgtccaaggggtccggctcttcatcaagtcatcatgatgagtctagtactcattcatcagctgatgtctcgttggaagacgccgaagctccgcgacgactcctgaacgacaccgacctcgaccttgtctgtgatcgggagagaaaagcctactacatgctgagcaaccgggagtatgctcatacacgagaatactctccggagctgctgaaaaagatagatatggatgttgaatttcgtgctatttggaaagctgttggttggcagagatttgctgtggtagatgagcctggttctcgtttgcttactttgcaatttctatgcactttgaaagaaatagaagatggattttcctttcgctttttccgtaaggagtttacccttacatggaaaagcttaagcacacttcttggttttcacgattgctgtaaaatcgatctctagaaaggaatttctgggttcgagaaaaataggttttgggaagatatttctggtgctccaatttgcaagaaacctatgatgaatgatatccataatcctacacttaggctcatgcacaaatggattgctatgactttgtttcctagaggtgatcttagaccattaggggggatgaattgattatcatgtttgccatggttagaaagatcaaaattgctcctgtgaaatgtatgataagacaatggttagaaagtataaagttctctgctcctgttgagtgcacttctctgattactcagatagcaaaaggggtaggtgtcgttagcaacaaaattgcttttatctcagccgctcgtccgtgtatggatgagacctatctagtgcaagggcatattctgaagtatggagtggatggatctttgatttactttttccccggttgtacaaataaaatcccgttgccaaatgcagggtatcatttgtataactgacatgaactaaccattcccctgtagagcatagaagaatctcgtgcaagtggagcatacagggagacacgcaacatgacaaggaatgaacgggaaagttcatcatcctcaacactcgtgcagatgtatgaggcaggttgggaaccaactggggatgcacccggatggacccaagttccacgccacagcattagagtctcaagctgggcaagtgccagtgaggaccggtggcgtgtgcctcatgatatccaatggggggacaaccaacgtcttagatcaagtggtatgcctccatctccaagtgaatggcgctcgagttcttctcgatgggacttgggtgaaatcactaggagaatggatacccttgatgtgcagacgggggagatccagtacaacctcacggaacacatagctcaaacgtaagaatggcaacaatctgctgatgctcagtttgccaacatcaacaacatgatgcagcaacagcacgatgatgttcaagcgtacttccgctttcaggggttcaatccttatcaaggaccctgagggaaagccaagcttggggggagatatctctccccccactgaggtaacttgtatcacattgcatatttccctttccaattgcatatttccctttccaattacatatttgctttccaattgcatcttataaacttgaagacaacataaaaatttgcaaaatagaaaataccaaaaaaaaagataggataggtttgagttatgctaggtaagacaagctagttctctttgttgaaatgatgaagagttgctctgttttatatctcttatatataggttcataggtaagtgctctctcaaaggttaaatataaatagcaaacaattatctgggaacctgaggtaaatgagctgcaaaggttcaagcttggggggttttgttgacagtcgttatcgatcagtttcgaccatcaatattgccaaaatagaggagaactaataatgcttgcaatgcatatacatgttagaataataatattccactagtattaggttcactaaccttttgcagagaataacaataaagtggaggagaatcgacatcaacacagacaataaatcaattaggcgatgtcgagaattagacttatgtatgagtgggccaagaactcagaattgacacgacaaaccgggccaaaattcacaagtctgcagagaagaacaacggaggaggccgccagccaaaaatgggctggattgggccggccccaggttcggccgaatcctcctcagcgccatccgatccagggctttgcctggacggtgtggattagcccccaatgacggttggagggtatttccgaccattccaaccgtcacaaccgtcattgggaggctataaaaggagttgctcttctcacttcagtcacacatgtcaagcaagagctctcatattctctcaagttagtttagtagtctcaagctagtggaataggaatagagtagaaatcaggagtccggaagtcttcggaagagtttgggtatggctctagtaattttcctttcctcttttgtaagctttgtacttttattagagtattcttctttatatatttatggtatcgaaatactttccgagtatatgaatgccaacttttcattatgttcatgttatactgaatatgttgctaggttatctgggagatgctttggtgcgggtataatgtttgcgtatgcaattatactctatgtcatgacgatgatattagagtagtatctggtagtttagacgtggtgtctagattatgggatatcattatttggggttatatgctgcggatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24918 - DNA, 768 bp, Oryza sativa
gcgaattcgagctcggtaccccctttaatattctccctcccacactagccgttggtgggcccaacacaaaggtgccggttttttgtatgtgaagacaaaggtgccagtttttggtctagaactggcacctttgttccgatagtgcttttcatgcctcacacaaaggtgccgttgttggatcgagaaccggcacctttcttccaatagtgcttttcatgccccacacaaaggtgccggttaggaagacaaaggtgccggttttgggtctagaaccagcacctttgttccgacagttgtacttatactccatcccttgccactcgagctgattgagcaagaagagagcggtgcctctccttcttgcctgattagctagaggaggggaggagggtttgctccattttttttgtggcgtttgtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcata

SEQ ID NO: 24919 - DNA, 4486 bp, Oryza sativa
tcggatggtaccgactcaatcaggtgataaaggtgcagcagatggttctcaaggggttcaaggtgatggttctcaaggaacttaaggtgatggttctcagggatttcaatgtgagaatcttaaccatgatggcaacacggcacagctacagtttaacaacattcaagaatggattgactatgtcgcgcaacatgctttgatttatcaatctggagtgttagtcaacactttgtcaaacatggttgatggctcaatagcttaataccaggctacaggaccggtctatttgccaggaggtgttttcacgaactatcagcccttgatcactaataatcagccagctgtttagccaattcctcccaatgcaccatcggctcaaccgacagcacctgtatcagctcttgcacctgttgcaccatcatcggcaccaggtcaactaattaatcctcggttgttggtgggagagcagccacaacatagtggacaaaaatgtgaatcggctaatccaagaccaagttgcagctatgttcttgccagctcagcctactgttgacccaatccagcaacagccgattcaacagacgccaccgaggtagcaggttgtgcagccgattcaacaaacaccaccaagacagcaggttgtgtagccaattcaacaaacgccatcgaggcaacaggttgttcagccgattcagcagcaaggtttgatgaatgcatcggctaggtttagaacacctgacaatcagctaaggcagcacgctgcgaatcaagttgtccaagagcatttggttcataatgtgcaaccagatcaaacggtgaaacctcaagttattcccgaacatttggtgcgcaatgtacaaccaaacattcagaattatcaagggggcaatttaaattatcagtatcagcctccatcgccgcaagttcaatatcagcaaggaggatcggcttagcctcagttcgctcctcaatacaatcaattcgagcccgtgccacaacaatcacagggggtgcctcagcaacgaccatgggccgatatgattgcagatgtgatgagagagcagtttgggcttaagccgaaggatgctggaaacttgtatcggcatccataccctgagtggttttagagagttccattgcctaaccgattcaaggttccatatttttcaaaattctcaggcaggacagtgtttcaacctatgaacacgttagccgattcttagctcagagtggtgaagcatcggctgtggatgccttggttttcttccttgccatgtggatcaatcaacagttgggccgatttggagaagcattttcatagctatttctatagtggggttcatgagatgaaactgtcggatttaacggcgagtaagcaaagacatgatgagcctgtgtaggactacattcaaagatttagagagatgaggaataaatgctacagcttgagtttaattgatgcctagttagccgatttggcttttcatggtatggtagctccgatcacggagaagttctcgtctcaagactttgatagtttgtcacatcttgcacagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggctgataagatctttgatttgctacttcgggagaaatagattgaacttcctgccggtcatacaatcccatcggctgaggaattaggcaagaggaggtattgtaagtggcataattttgggtctcattctaccaatgattgtaaagtcttcagacagcagatccaagaggctattgaagggggcaaaatcaagtttgatgactccaagaggccgatgaaggttgatggcaatccttttcctgtcaatatggtgcacacagctggccgaacagccgacgaaggaagggctagaggttttcaggtgaattcggctaggattatcaataagtatcagaagaaatatgacaagcagcgggagaggcattatgaagaagacgatggtagctttaatcctcattggggttgtgagttctttagattttgctggaatgaaggtatgaggttgccgtctattgaagactgccctgggtgcagctatgttacagaaagttcaagccgatcgtataatagaggcaatcggctaaggcaaataagagttcctgttgatcaaagattgggtccagtgaaccaagatcgtggccaagaggacaatgaagacaggaagactcaatggtgtccttctggtatttttacaaagaatcagaagagaagggttcaaatgttgaggaacagggaacgctttcaggaggttgagcaagaaatcaaccattggctgaaggagacgaagccgaagcaggagtggcgcgttaagaatcaagttcctacagcagacgaagccacaaccgatgaagcaaaaagattggctaaagggaaaagtgtcgtgactgcatcggttaacatggtattcacgttaccttctgaatttggggtcaaacaagccaatgttgatgaagttgaggaagaatcagctaaattgattttatcatgagaacaagaagtctttaagaaaccagaagggacggagaatcggcatcttaagccattgtatgtaaatggctatatcaatgggaagccgatgtctaaaatgatggtcgatggtggggttgtggtgaatttgatgccttatgctacatttaggaagctgggcagaaatgctgaggatctcatcaagacaaacatggtgctcaaagattttggtggcaatccattagaaaccaaaggagttttgaatgtggagctgacagtcggcagcaagactaaccctacaacattttttgtcttcgatgggaagggttcctacagcttattgcttggaagggattggatccatgccaattgttgtattccttcaaccatgcatcaatgcttgattcagtggcaagacgacaagattgaaatcgtgttagccgacaagtcagtcaacgttgctagtgccgatttagctctttgggagatgcctggtctcgattgcttatctggaaaagtttgggatggagattttctaaaagtgtccaattgtgatatacaaccaattgaagatggagagcccaagcttttattttgagggtgtcgtggagggttcaaatgtctacaccaaggacacagtagatgatctcaatgacaagcaaggacagggtttcatgtcggctgatgatttggaagatattgatataggtccaggtgatcgaccaaggccgacatttatcagtaagaacttatctccagagtttagaaccaagttgatagagctcttaaaggaattcagagattgctttgcttgggagtattatgagatgccaggactcagccgatcgattgttgaacatcggctacctatcaaactaggggttagaccacatcaacagcctccgagaagatgcaaagccgatatgctcgaacctgtcaaggctgagattaaacgtttatatgatgctggttttattcgtccttgccaatgtgggtttctagtatagttcctgttatcaagaaaaacggcaaggttagggtgtgcattgatttcagggatttaaacaaagctacccccaaggatgagtatccaatgccagtggccgatcagttggttgatgctgcttcagggcacaagatattgagttttatggatggaaatgcaggatataatcagattttcatggccgaagaagatatccataagacagattttcatggtgcaatcggcttatttgagtgggttgtaatgacttttggcttgaaaagtgctggagctacatatcaaagagccatgaattatatatatcatgatctgatcggctggttggttgaggtttacattgatgatgtggttgttaagtctaaagagatagaggaccacatagccgatttgaggaaggtttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaat

SEQ ID NO: 24920 - DNA, 2105 bp, Oryza sativa
ttgcttatactattaaaccttatgcaactaacaatcaggctgagtatgaggcagttctcaaagggttgcagttactcaaggaagttgaagccaatgctattgaaattatgggagattctttgctagtgatcagtcaattggtaggggagtatgagtgcaaaaatgatatattaatgatttataatgagaagtgccgagaactgatgaaagagtttcggttggtgactttgagacatgtatctcgagaacataatattgaagctaatgatttggcccaaggggcgtcgggatataagccgatgatcaaagatgtcaaaatagaggttgccgcattaacattcgatgattggagatatgatgtgcatcattatttgcagaatccatctcaatcggcttctcagaaattgcgatataaagcgttgaagtatactttattggacgacgagctctattatcgtacgattgatggggtgttgcttaaatgtttgagtgccgatcaggctaaggttgcaatcagtgaggttcatgaagaaatttgtggcactcatcaatcagctcataagatgaagtggttacttcgacgtgcaggatatttttggccgacaattgtcacaccctgaagttctttcccaagcctaaattgaagttactagccgtcaacccgtgccttacacaggttattggtagtggtagtataaagatcaaaattttaaccatacgttcactacgttggccatattcgaattgtagcatgttagattgaaataatagttaactactcccttcgtcccagaatataagcatttttagagttagacaacggttattaagaaagttggtacaattaaataggggagtgttgtggctgaaggagaagtggagatagctggaaaaattgaatggtggaggattgtgattcgttaagaagagaatgttggtggtaaattgttatattttgggacaaattctaaaggctagaagttgttatattttggtacagaatgaatactacttgttaattattaatttcgaatcaaacaaatgctaaatttgtgatacatccaacttttttatttgatattgtggaattctggaattaattaagtatttagttgtgtctgtggtcgagtttaaatttaagtacaccctgtaatttaataattttgaaattaaaaaaaaatagttatactcagtatggaccctagaagatataagatatatgtaattagcttttttgttttatcattcccaaaactcataataataattagtgatctatggtctcttgtctatttgtaccggttaagtacaaattaaagagtctacgatattgccaattgcatgttttattttttcacaaaccccaaataaaacctaatgttgtgattttgcgattttgccaccatacatgctatttaaggtgaatttggtcacgtctatcagatcaagcctagattgtttactcttgctgcaagtaattctcatatgaacctacgtagtacatgataaatatttgtttacgtgcatgattatttgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctagtaagtatgcttctctctctctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacccttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagtaagctgcaaactacatgtacatatgcattgcatacgggatat

SEQ ID NO: 24921 - DNA, 1878 bp, Oryza sativa
cccaaacgaatgaacatgaacactgaacagtaagctgcaaactacatgtacatatgcattgcatacgggatataccgcgcatatggaaaattaaatatagttgattgcattcagagaattatagatcaatatatttttatctgcttctactgtcattaaacaacttgtcaaaatcagacaacttagaacatgcaagtttaatggaataaaaaaacacattcaatatgtaaaagatgatcagcaaatagttgatcattccaatcaaaaccataaattgagtgcgtcctaattaaatagactgctaaatatgtattgcaaattgaacacgcaaaccatgcaaattcaaaggaatacgtatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaacagggatgaacgatacctctggagcgatcactgattcactggaaacttttaacttctcctcatgattgaggcaaattgtcgctgatcgggaccacagtctgggatcaaggtcgactgcagcctatgcatatctcatcgccctcgctcacgttcttctcgatcgcgttcgccgtttctttatcgcttcttaatttccaatctgatttctcacgatggaacttggagataaattagatggattctgtccttccatcgataactggatagataggatttgcaaggagcccactgagtttaagattgattggcccacgatgttaaagtattgcaggatctacggtgtagattaaacgacttatctaattgatgctcagatctttctggttaacgtgagagctccaaaaaagtgtccgattagtataggtatagatagatagataaatggtctcaaggaaataccggtgtaaagcaagagtaaaccctaataaattaatgcaaataataaccggatttggcatgtggaatttttcttgagttctacatgtcgaaatacgctaacaagatttttagtggaattttgagagctctggaaataattttaaccaattaaaattgatcacaagcaatatttaatcccaggaaaactcatttccttttttcctttttttctttcttttctttttcccttttctctttcgaatgggccgccggcccattctctcctccctccccttcccgctgggccggccgaaggccgaggcccagctgagccggccgcctctcctctctctcggggtcgccgacaggtggggcccacctatcgggcccgtctcccttctccagccggcgccgacgcgccccgcaaccaccgccacgcctcgctcccgcgtcttccggggcacgtcggccacgcccgcgcgtgcgcccgtgtctcccgcacccactccctctctctcccgcccgcgcccacgctcgtgacggcccggattcgattttcgaatcccgcctctctctcctcccccactcccccacgtcggccggcgattcccgcctctcccggccacgtccggacccctctctctatttaagcaccaccgccacccctatcttttttttcccagctcgccgagtcctcccgtcttttctaacgccctagcgccatcaccctcctctccgtcgctgtcgccgccgctccggtcgccgctagccaccgctagatgccgtgccgagccgcgccgtcgacgccatcgcgttcgccgtcgtgcgggccattccgtccaccccttcttcgtcggaatccaccgccggaattcactccttgccgtgcgccggtgagcaccg

SEQ ID NO: 24922 - DNA, 5156 bp, Oryza sativa
  unsure (1)..(5156): unsure at all n locations
tcgtcggtgaggcccctcctcccctttctccctctctcccgcgccgcttagccgctgcgctgacgcccaaccgcttagccgctgctgtcgccatccgcgtcgccgcgacgccgccgctctctgccgctggccggtcgccgccggtcgcccccttgcgccgccgctgcgtcaagccacgccgccgtgcgccatggccgccgggccggcttgagccgcacgtgcgcgccggccgcgtaccgccccctccgccgtccgatccaccccgagtggatcggggccgtcggttcggctgcccgcgtggctgccgcgtgtgcgccgcgtcggcgccacgagtgcaccacgtggcgcaccgctccttcccggtccgtggacccagtccaccatggaccgccctccccgagtcactgccatgtgggacccgcatgtcggcgccgcccctctctctctcgggatttatgtattgcgcaataaatcaattaaggatttttctgttatagtaaaaacacagtgaatcttctaaaattcatatctaattcatctgagctccgtttatgcccattcaagtctcagtaaatcaagaaaaatgcatagaatccattaaaaatggttttgttctctgtttcagtagtcttacagcctgtttctattgtttgctttgtatgtcgcttagattccggctctcccgacgctccggtgtactttgaaatagtcgccgaggttcctccagcagcagagcaaggcaagtcatgcttgtcacttaatcatgttgatcctatattgcaaatgctccattgttttccttcaaatactgcattgttttataatattaccatgggatgtatacctactgttatagccatgttatttttgtaccatgttcctttgttagcctgggatataacatgactacatattgaactaggggttgcttagccatgcttagttcaactagcacagaatggggaaaattatatttaatgtatagacttcaggttctagtgttgatgttggattagagccaccgtcctggtgtcgcttcattaaaatttgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgacgcatccaggcaagggtgggcgtgatggagtttggatgggccctgcgatggcctatacggcttccggattcatctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcgctgtgattagtttcaccctagtctagtctaatggaattgaatagtataggtggatggttgggcctgttgcaatgtggtgtagcgttggacagtggatgtttaatattgattaattattacaaatgttttactgtttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagatggccgaccacccaaccaactaccgcggagaaggcattgacgattttgtggcagagttggctcgcatgaccctggtggtgggctaccccaatgcgtcggagtactcgactgttccgccgctcagtggcaagcttcctcaccgtgttcgtctggaggttcatggctaagtgggcacctgcctcgctaacatggtggttgtggcatctggaggcacagcagatcacgcctgtcaggaggcagcatatctgatgatggccagacttcgtgagcgcgacaactacatcttctgcaacacggcgtaccgtttccaccctcgccgagcaagtggtgacggtgtcagcaccttccgtccgacagccggtgagaacgacaccaccttcggtcacatgtgcgcaatgatgaggggaatggacaggatgcactcggatctgcacaaggcgtccaaggccttgaatgatgggaagctcgtgaggatcatagctctgaaggatgagatagcacgcctgaagaaggagaatgctcacttgaagggtctccccattcccggaggagtccggatccgcaccatgccccgcaagtcgacgactgcacccgtgcgcatttagcttgcgcccaggaacccacctccgcccgcagctctcgcagctcctccagttccgcccgcagttcccgcagctcctgcagctccacctccagtcccggctccagtcccagtgtcagctcccgcgtctgctctctccttcgctccagcatcagccgccaggggtccagccagtggcaacggaggttggttgcctgctactcccagtggcagccgcgaccacagtagcagcagttccagtggctcagagctgggcagcggcgagacgtatctgctagactccaggagccgctcagagggacctggcgacgagcaggaggacgccttcgactccaccgaccgcaggagccgttccgagcattaggctcgctttcccttagtttaccgactgcttagtatttgtctgttagtttgtgtgtttaggtttgttcgcttgtgggtcagtcgacatttgatatcatgtgcctatgatatggctgtcttaataaggatttgcttgctgtttaaagtgtttcaattcagatcagaacaattgcagtttaaattcctataaaataaagcttagttcctgagcatctgtttttcttcttttccaccccctccgtctgctcttccttcagatggccaacaccaggaatggcagccgtgcagcaggtgagggcagcaacggcgaagaacgcaccgacggtgggtatcccaacagcgcctccggcaatggtccgcccccgctccccgagaatccgactcttgccccagtaatggctcatcaaactcagatgatggcagccatgatgcagcagatgcagcagcggcaccagcagatgcaccagaggatgcagcagcaagccgagcagcagtagcaacagtttggtccccctccccctcagtccaagctactagagtttttacgcgtcaggccacccaccttctccagcaccaccaaccctatggaggcaaatgactggctccacaccatagagaagaagctcaatctcctacagtgcaatgatcaggagaaggttgccttcgccacacaccagctccaaggtcccgtgtcagcttggtgggacaatcacatggccacccgtccggcaggtacggaggtcacttgggtggagttctgtcgcagctttaggaaggcgtaggtgcccgacggggtcgtggcacagaagaagagagaattccgggcactccaccagggcaaccggacggtaactgagtacctccatgagttcaatcgcctagcgtgatatgcaccggaggatgtccgcactgacgcagagaagcaggagaagttcctagcaggcctagatgacgagctgaccaaccagttgatctctggagactacgccgactttgagggggatcctctggttgacaaggcaattcgtcaggaggatcagcgcaacaaagtggacaggaagagaaaggcagcgcagttccggtcaaaccaaggaagtcaccagcgaccgcgcttcactcccggacagcagggtggacctaccaccatgatcgtccgccagcatcgccctttcaactcgagcagcttccacccgggcgctagtggcagctagaaccaccagggaggtcagctcaactgcagtgcagctctgcgcccaccaatggcaccggcacaatcagttccatcagcccaagccaagaaggagactagagcaaagccaaggtcctgtttcaactgtggcgagcatggccactttgccaacaagtgcccgaagccaaggcgtgccgggccaaggtttgcccaagctcgtgtcaaccacgcgtccgcagaggaggcgcaagcagcaccagaggtcgtactgggtacgtttcttgtcaactcagtccctgctacagtactttttgattctggtgcaacgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgggatccaaagacctagatgtcattcttgggctggattggctgaccaagttcaannnnnnnnnnnnnnnnnnnnnnnnnnnnnnnnnnnnnnnnnnnnnnnnnnnnnnnnnnnnnnnnn

SEQ ID NO: 24923 - DNA, 3014 bp, Oryza sativa
cgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgaatccaaagacctagatgtcattcttgggctggattggctgaccaagttcaagggagtcattgattgtgcgaatcgcacagtcaccttgaccaatgagaagggagaaaccatggtgtacaagtcaccagtctcaccgaagcagagaatctccttaaatcaaattgaggtggaaaaccctgtgaccaccgaggagaagagttcgcggaaattggaggatatccccatagtctgcgagtacccagaagtgttccccgaagacctcactaccatgccacctaagagagagattgaattccggattgatttggcaccgggaaatgccccaatttacaagagaccgtacagaatggtagccaatgagctagcagaggtcaagaagcaggttgatgagcagttgcagaaagggtacattcgactaagtacttcaccttggggtgctccggtcatttttgtggataagaaggacaagacgaagagaatgtgcgtcgattatcgcgcactcaatgaggtcacaatcaagaacaaatatcctttgccgcgaattgatgatttgtttgatcaactgaatggagctaaagtgttttctaaaatagacctgcgatcaggctatcaccagttgagaattcgggaagaggatattcccaagacagccttcaccactcggtatgggttgtatgagtgcacggttatgtcttttggacttaccaatgcacccgcattcttcatgaacttgatgaacaaaatgttcatggaatttctggataagtttgtggtggtattcatcgatgacattcttatctattccaaattggaagaagaacatgagcgacatctccgtctggtactcgagaagttggaggagcaccagttatatgccaagttcagtaaatgcgacttttggctatcggaggtcaaattcttgggtcacgtcattacagctcagggcgtggcagttgatccgtcgaatgtggagtcagttaccaagtggaccccacctaagaccgtgtcacaaattcggagttttcttggacttgcgggttattaccgtcggttcattgaaaatttctccaggatcgccagacctatgactcagttgcttaagaaagatgagaaatttaaatggacagctgagtgtgacaagagttttgaggagttcaataagaaattagtatccactccagttctgattttgcccgaccagacgaaagacttccaagtctattgcaacgcgtcccgtcatgggcttggatgtgttctaatgcaagagggcagagtggtcgcttatgcctcgcggcagttgcgtccgcatgaagggaactatccgacacatgacttggagttggcagcggtggtttatgctttaaaaatctggacgcgttatctgattggcaaccgctgcgaagtatatacggaccataagagtctaaaatatatcttcacccaacctgatgtaaatctccgacagcgaagatggttggagttaatcaaggattacgacatgagcattcactatcatccgggcaaagccaatgtggtggcagatgcattaagcaggaagagctattgcaataccttatgcactgaaggcatgtgtaaggaattgcagcaggagcttgaacacctcaacttggggcttgtagaatacgggtacgtggctgccctagaggcacgacctacgctcgtggatcaagtcagagcagctcaagtaaatgatcctgaaatagcggatatgaaaaagaatatgagggtcggaaaagcccgggatttccacgaagatgaacatggcacaatctggttgggagaaagattgtgcgtacctgacgacaaggaactaaaggatctgatactcaccgaggctcatcagactcagtactccattcatccaggcaacaccaaaatgtaacaagacctcaaagaaaagttttggtgagtcagcatgagaagagaaatagctgaatttgtcgcactctgcgacgtttgccaacgagtgaaggcagagcaccaaaggccagcaggttttctacaacctcttcagatcccgaaatggaaatgggaggagattggaatggacttcataacaggactgccccggacatcatctggccacgattcaatctgggtagtcgtgaatcgactcactaaagttgcccatttcattccagtgcataccacgtatacggggaagaaattggcagagctgtacttggcaaggatcatgtgtctgcatggagtacccaagaagattgtatctgatcgagggagtcagttcacctcaaaattttggcagaagctgcaggaagaattggggacccgtttgaatttcagcacaacctaccatccgcagacagatggccaaaccgaaagggtcaatcagatcttggaagatatgctacgtgcatgtgtgctcgattttggtggagcatgggataaaagtctgccttatgcggaattctcgtacaacaacagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcgacagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatg

SEQ ID NO: 24924 - DNA, 938 bp, Oryza sativa
aattggggacccgtttgaatttcagcacaacctaccatccgcagacagatggccaaaccgaaagggtcaatcagatcttggaagatatgctacgtgcatgtgtgctcgattttggtggagcatgggataaaagtttgccttatgcggaattctcgtacaacaccagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcggcagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatgatcggcatccatgtcatgttccatgtatcccagttaaagaagtgcttgagggtacccgaagaacaagccgattcggagcacattgacatccaagaagatctgacctatgtggagaagccagttcgtatccttgagaccagtgaaaggaggacaagaaacaaggtcaccaggttctgcagggttcagtggagccaccacttagaagaataagcaacctgggaaagggaaaatgggttaaaggccgcccatccgcacctcttcaccagctcttccgaatctcggggtcgagattccgtttaaggggggtaggtttgtcacaccctgaagttctttcccaagcctaaattgaagttataaatggtctcaagaaaatacaggtgtaaagcaagagtaaaccct

SEQ ID NO: 24925 - DNA, 1235 bp, Oryza sativa
  unsure (1)..(1235): unsure at all n locations
nnnnnnnnnnnnnnnnnnnnnnnnnnnnnnnnnnnnnnnnnnnnnnnnnnnnnnnnnnnnnnctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttcttgacctgcagaaaaagattcaccaatttggagtggcttgatacgctgcctctggctactaccttgtgcctcctgggatacagtcattttccttttacggttatccatcttgttcttcttgtcttccagtcgaattgctttatcaaccaactcctgaaaatcctcatagtcatgagagatcaacataactgacagttcatccttcggaccttccaagaatttctcttgcctttcctcgtcagtacgcacatcttctggagcatagcgagccagacgattgaactcatgaagatactctgccacggtacgatccttttgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatcc

SEQ ID NO: 24926 - DNA, 5713 bp, Oryza sativa
tttttttgtggcgtttgtgtcacgcccggtaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccacgggcacggctattcgaatagttttactctgaccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttgaagaaaaatcctgaaaatacttggacactcaaagtacttaaaaaaattacaattagaccatttaatgattaatttaatatgtggttaattactgaaatgctctttgtatgattaaaaattatgaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacagtttggttaaatattgaagcctaaaggtaaatattcattatttctcgcttcgtttaactcttggttgttgatttgaattgtcgtgtgctgcacgtatgcatgtaaaatacgctatgggtgttgtttttagggataattctttttatctcttttgtgtctattgttggatgaaatgctaaatttgcgttaatgttttcttcgatctacgtcatggccattagtcaaattaatgcttgtcaaactatgttaaggccacgaaaatatccattgatagtttgatttatctcaaatttatgttaagggtgcccatcgatccgctagaggaggtggaagcggttttgcttgatttttcttgggttttggttgaagattaaagcctacaaggtaaatattcagaatttctcaccccgattcacacccgctcgttgaattgaactgccatgcagtaatacatgtaaaatgcactagtcattaatttgtatggatccataagtcattcgtagatctgttctcgggtgttatgctaaatttgaattaatggtttattccatctatgccatcgtcattaatgtttcacattagccaaatattatttcggattgacaaaaaatagaatttttttaatatttttgttagccatgactatctaattaaggtgacgtgggtgtgtgcaaaaacctctattttgtcgtagggtaaaatggtcattcctagttgtttttattctaatgtgcttgtaaatgatgaaatcttcattgtttttttccttcatggtttgtaataaatgataataaccgcaggtacccactggatataatggatctagaatggataactatagcggatcgtgactctgtggagtatttcaggggagtaacggctctcgttgccacgtccaccagcacaaacttagtcgatgcaccagaatatatttggtgtccatgccatgattgtaagaaagacagacaacttccagctcagcgggtccattcacatatccttacaaggggttttatggacaatttccttagcgaggagaatcaaggtgagggaagtgctggcaactgtcatgggcatgatgcggatgtaggctacgaggaggaggaggaccaaacatgtgtcgatcacggtgaacctaatctagatcagatgttgcgcgacggggagagatttgacactgatgatagggaatatcacaagttcacaaccatggtgaaggactccaaaactccaatttacaatggatgtaaggcagagcacagcaagctccaagtggtcctatcgctgcttcacttgaaggcgagcaacggatggtctgataagagcttcatgagttgctagagctcttgaaagaaattcttcctacagacaatgtcttgccagaatcgacgtaccaacccaaaaaagttacatgtccccttagtcttgacatacagaaaattcacgcttgtctaaatgattgcattctgtatcgtggtgaatttgcagatttggagtaatgcccggtatgcaagggagcggaagcacatgtgcatccacatcgagcggtgagacccctctattcaaaaagaagtctgtcttttgggacttgccatattgggaagacctggatattcgtcatgcgatcgatgtgatgcacgtgatgcacgtggagaagaacgtgtgccaaggcgtgctcggggtattgttgaacacacctggcaagatgaaagacacttcgcaagcacggaaagatctcaaagacatgggcatcaggaaagagctgcatcctcaggacagaggaaatgaccgctattacctatctccggcatgctacactcttagtgctgcagaaaaaacgagtatgttggaatgcatgtggggtgtcaaagtcccatccggttactgtgcgaacattaagagactggttagcatgaaagataagaggttggttggaatgaagtcacatgactgccatgttcttatgacgcaactgctaccggtcgcaattagggtatccttctagaaaaggtccaagacccaatcatcaagttgtgccagttcttcaatgcgataaaccaaaaggttatcgatccggcttcattgggcaagcttcaggaggacgcgattctcaacttttgccagctggagatgttgttccctctttctttcttcgatatcatggtgcatctgattgttcatcttgtggaacaagtaaagatcttaggtccagcatatctgcatagcatgtgggctttcgagaggtttatgggcatcataaagaaatatgtcaggaatagatcaagacccgaaggcagcatcgtcgagggttattgtcacaccctgaagtttcccctttttcttgctttaaaaattggttaaataaattgcccgaagaaattatcttaattaacctagagctaaatccctagttaataaatgcaattaataatcggaaatagcgtgtggaatttttcttgagtaccccatgctccaatgcattaacaagatttttagtggaattttcagagccttggaaataattttaaccaattaaaaatcaccaaaatgcaattttaaatcccaggaaaaatcctttcttctttttctttttcttttccttcttttttctctattgggccgtcggctcactctctccacgcgctcggcctccttactttgggccggcccgttcccctttcccctctctccgggacgctgacaggtggggcccacctgtcaggtcgtccccttcctccagccgcccgccccacgacggcaaccgccgcagaaaccgtccgcgccg

SEQ ID NO: 24927 - DNA, 1079 bp, Oryza sativa
tcagtacgcacatcttctgaagaatagcgagccagacgattgaactcatgaagatactctgccacggtacgatccttttgctccaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtccttaaggtttgaccatttggcttatcctacagtcaagatggctctgataccaacttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaat

SEQ ID NO: 24928 - DNA, 686 bp, Oryza sativa
  unsure (1)..(686): unsure at all n locations
tgggtgccccgtggtaaggggaagctcggccacccttccttttcggtcgccggtcatcggaagctccgccgccccgtgcaacccaagccgccgccgtcgcctcctggtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggttttattagtctttttcttcgttttgcgtgttagcttgtcgtttccgtcgttgcgaaggttcgtgagtgcgtccgaagtgatcaagaagattacttgaagaccgattattgcaaggcaagtcacacagatcctaaacacaatcctttgagcatgttgatcctatatttaaattctctttcaactgtgcatttattttnnnnnnnnnnnnnnnnnnnnnnnnnnnnnnnnnnnnnnnnnnnnnnnnnnnnnnnnnnnnnnnnnn

SEQ ID NO: 24929 - DNA, 1258 bp, Oryza sativa
cttagcctgatcggcactcaaacatttaagcaaccccccatcaatcgtacgataatagagctcgtcgtccaataaagtatacttcaacgctttatatcgcaatttctgagaagccgattaagatggattctgcaaataatgatgcacatcatatctccaatcatcgaatgttaatgcggcaacctctattttgacatctttgatcatcggcttatatcccgacgccccttgggccaaatcattagcttcaatattatgttctcgagatacatgtctcaaagtcaccaaccgaaactctttcatcagttctcggcacttctcattataaatcattaatatatcatttttgcactcatactcccctaccaattgactgatcactagcaaagaatctcccataatttcaatagcattggcttcaacttccttgagtaactgcaaccctttgagaactgcctcatactcagcctgattgttagttgcataaggtttaatagtataagcaaactcaaaacttgccccccgaggagaaattataaccaagccgataccacaaccatgagtgcatactgatccatcaaaaaacaatgtccacagcacaacctcaaccgagccgattgaatcatcacgatgatcaacgataaaatcggctatagcttgccccctgactgccttcggtgactcataccgaagatcaaattccgttaaggaaaatatccacttttcaacccttcctttcaaaaatggagccgataacatgtacttaacgacatcggctttgcatatgacagtgcattcgttggacaatagataatgccttaaccttgtacaagaaaaatataagcacaagcacaacttctccacaggggaatatcttgtttctgcatccaagagccgacgacttaaataaaacacaaccctctcttttccttcaagctcctgaattaaaactgagccgattaacttctcaccggctgataaatataacctaaaaggtatccccttttggggagggatcaaaactggaggagatctaagatattccttaatactatccaaagccttctgttgctctgctccccaagtaaacttttgatcagctttcaatcttaacaatggtgtaaaaggttctaaccttccagataaattagaaataaaccttctaacaaaatttatcttgccgatcatctcctacaattctgtcttattctctggaggctgaattttcttgattgcattaacactcctttgagttacc

SEQ ID NO: 24930 - DNA, 713 bp, Oryza sativa
ttgggagcagtaaaacatttgtaataattaatcaatattaaacatcccactgtccaacgctacaccatgttgcaacaggcccaaccatccacctatactattcaattccattagactagactagggtgaaactaatcacggtgaatctggttgaccgcccacaaccgcgggcacggctattcgaatagttttactctgatcagaggtatacaactgtacccacaagacacagccccacgacacgtttccgtgcgccgacatgccaccagacataccggaaagaggccgtgacaggacccttcgcataaccccctctaaccaagcacaccacacctcaggtttcacccccactccttgcaaggcagcgggcagtcccctctcgtgccttggtgaatccggaagccgtataggccatcgcagggcccatccaaactccatcacgcccacccttgcctggatgcgtcaactagaggaaagctatactacaagcccagccgttgcccacgctggcttgtggtaagtacgaggaattcttccagggtttcccgcgaaccggtccttaattgccatgggtgcgactagcaaaaccatgcacccatagcccaccatttaacaaattttaatgaagcgacaccaggacggtggctctaatccaacatcaacactaaaacctgaagtctatacattaaatataattttccccattctgtgct

SEQ ID NO: 24931 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnnnnnatcccaccattctgatgcagattagaaaaggtagaaggagaggggttacactaaagacaagaccttaactaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatttgaacacttaagattcgactatcatcttcttattcctcgatccacttgacttgcagaagttgacaacatcgacgtcttcgagtttctccatcaagataacgactactcaagttgaaagaggaagggggaagaacgacaaaacgatttgcaaagaattctagataagggagaaaggaaaattttcacaaattatgttttcggaagatttgtccttaagggttgaccatttggcttatcctacagtcaagatggctctgataccaacttgtcacgccccgaaaattactagtaatttccgaacttatttgtgcat

SEQ ID NO: 24932 - DNA, 538 bp, Oryza sativa
cagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcag

SEQ ID NO: 24933 - DNA, 1165 bp, Oryza sativa
  unsure (1)..(1165): unsure at all n locations
nnnnnnnnnnnnnnnnnnnnnnnnnnnnnnnnnnnnnncttcaaagcaacattactcaggttattgcactcggtgtggcacatccaatatgtgcagggcaaacaatacatggtgttccattgcctgtaggccactcaagggttgaagtggaagacgtgccaagccaatacagaggttatgtgctacagttttcttcggaggaaggggttgacactctgggcgctgctcttcacaacctgatcatatggcccaaacgctacatcgttatcacgttgaacgatggggcaggggatccaggcgacggtgcttccagcccttcaaacggacgaggtgcaaatctagctccttctccgcctcgacagaggaccttcagtccacctcgtgaaaacacacctaatgaaccacatcgtccggagaagtccacaagtccacccccactcagaaaaaagacccgaacaccaagtgcatcacagatgtctgttccatcaagcaaatagtgactcacacattccaattcatacttagtgtcaaagccaacaacatcgctgcctaagaagacaatcaatgccagcatcacttcactttttggtcctaagaagctcgaggaaccaaagattccaattcctccgaatgtcatcgagcatttcatcaagtgcgcaccaccgaagtcacctaagaagcctatatcggacttctggagaattcttggcaaaaaagatatgcaagctcagtagggagttgtaccttgaagagaaagcgtccaaggaagttgatttctgcaagtcagctggtttgaaaagcctagacaatctagatgaacttgaagaggccccgattgtactgcgattccaacttggtcaaccgatggtgcttgacacggaaattgaatccttaggaactcaagcgcattggctgcatgaatggtatttggaggaggccaaaaaagggggtcgggatgttcggtgcctactacactgatgtggattttcaccaccccagtaatacatgctttgtagaatttaaggaactcttccagttgtaccaaagaagggaattcgatatctgcctcctgcaattgtggtcattttgagtcctttgatatcttgtcgttcttaatccatagcattctacgtactcagtaattctcaactgtgttctccttttg

SEQ ID NO: 24934 - DNA, 1798 bp, Oryza sativa
  unsure (1)..(1798): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggagatcactgttgacttcttcctgtcattgcgccaatctagaattggtggtatgcgatggtggcacactttacgagaggagaatgatatggaagctggtgtaagaacgtaggctacttgattccgtggcaattagctactgttatgtaatataaattcaattcaatatcataaactacaacactagctagctatatgccaggttatgcatgtcacaacatttttgtccataagccttctcttactggctaggtgtggtagatagtctgaccgcgtgcagggagatgcatcttctcaattacaagattagagtttaagactcttttcatttaatgggttggttttggttgagggtcgtcctaattctgagttaaatgtgtattgaacttggtttgttgtcggtatgcatcataggtatgaagaggccggagtttagattgtaagccttccattatccaacatgttttgatgggtgctatagtggtcattggtaagtgagcaaaacaatttggttaagagagctgaaataacacatatataagtagtacatgagtccttttcgaatgattcaaaagcactcaagtttctaatgtaccggaaaaattgcaaagaaaaagatacaaatataaaaccaagcagcactactgtgtgaataaaaaccactgctacggtgaaattttaaccatcgattagggaatttgcatcgagcaaacaaaacagcttctacgtattaatatcccaagtcctaggtgggataacttcaaaaacatcaagtgggagttgctttggtctgtggcccccctagtcactccaggagggaccggttcgggcagcgaaaccctagccgccaccttcgccttttcttcctactcccttgctcctcactgccaccctgagcatgccgacggcggctagcgcgaccactaggacgtaagctgcggagccagtttccgagcacacgctcgcttgcagcgacggtgacacggcgggcactcgcggtgatggagatggcaccgacacggtggcgctacgaagtaggtgctcatggcgatggtgtccctctcatgctatggctccaaggtggtggatggccagggtcggcggcccgagcttcagggaggggtcagatccatggccgccttggccagatttggccaggttggtggtgtttgaatctggaggctcggggcatgcatgtcgatgaatggcgacacgtggtgcgtggtggcggggtcatcaccttctcctttcactgcatttttttgtggttggtggtggcacagtgacggtccaggtgtgcagtaagtcgttcacccctctgttggccaacattctcccctccatgttgctcctccccttctatggtcgatctgcttccatattgggtcattgggagctccgtggcaagggtagatgtggtgcctttgttgagctcacgacgtcgagatgacggactgtcctatgtgaccgcttgagctgcttgggtgttggggctggatggggaaacggtggcgaaaagctagacgtgattatgcctggtttgatgacagcgacgccctatggtgcagatcccctccttgtaggcgccattgtggggttctatccctactgctaccacaccacactccgggtgaaaaccttgatttggattttccgacaagcggcgacggcgtatcacatcatgtcctctatggtgct

SEQ ID NO: 24935 - DNA, 13455 bp, Oryza sativa
  unsure (1)..(13455): unsure at all n locations
aaattctacgtggtcgaagcattcttgttactttgcggcaagctcggcaacgataccctatgtttaggctttgccattgttggttgtttggttggatggtgtgtgcagtgttcggtgtgttgcgcttgttcagccggcctgtgtttggtgagacttgtgtagttgagttgttttttcttttcatttaacccgttgggtttttatccccgcttattgaaatataattggagcccttcggctggtttcgtttcaataaacaaacatattattatccataaaaaaggtgagtgatcgaagaaaaaaatttgctgtagttcagtggcaaatcaggacgaaaaatagaagaatggctcatgttgaagctatggcataagataagggtagtagagatgattttgctagccagtattggactattggctaccaaattttaatctcataatagatacgtaaaaaatgagtagcaatttgtaggcttgttagcatcttaatttgtaggctgtgttcttttggaggagttgggaaccccctcgcacagaaaatggagcgatagattaacacatgattaattaagtattagctataaaaaacttcaaaaagggattaataagactttttaaaacaatttttctatataatcttttttgtaaaacgcatacagtttagcagtttgaaagtgtgcatgcggaaaatgagggagatgagtcgggaactcatggaaaagaacataatggttgtaatgtaacacacgagtgccggtcagccacagcaagtcagtgatacggttgtaattgtgagtacatgtctacatattaaacattcagaactaattatgactgcaattcacacatccacgagttggctatagatggccaaaaggcctgaggcccgacggcccggcccatggcacggcattttggcccggcccaagcacggcatggcccgacggaggtcgggcccatgccggcccggcccgaccaccgggccatgccggcccggcccgaccaccgggccatgcctgggcccctccaccggcacgttggcccggcccggcatgatgggttggcagttaggcccgataaaaaaaaatatgggagtaaaaatagacatattatatgccatggacgaaagagtagggatctaaaatagacttttttttatctatacatatgtcagccaaagaggagggacggcaaatagacttattttagctatacatatgtcagcccaaagaggaaggatggaaaatagacttattttacctatacatatgaaatagcccaaagaggagggacgaaaaatagacttattttaaaaaaggcccgatgggccacccatgccttcggaccggcacggcacggcccgacagctggtgggccgtgcctggacgggaggtgcagcccatcggccggcacggcctggcacgaagtgcctatcgggtcatgccggcccgatgactgctgggccgtgcccagccatgcctgggccgggccgtgctgggcgggccctttggccatatatagagttggccattcctaaatcccctgtctccgccggttcagccactagctgcgcgggcgcagtcgtggccccgtgtctccggtgccgtcacgccatggttggcacttggaagccttatgccctttatattgcccacgaaggcccaaatatccaatccctgtcaaccagcagaagcccgaagcccatgttttcaggtagaaatggaacaagttcaccaccaagtttgtttgacatcccttattctaaatattagaaaccttcatcccctaaactatacataactgtacaatttagatccatagcagtttgtatgcccggtttcgctggcatggcattctattcagcaaagttaaaataaaaaaaatatgtggggcccgcgccaccaacatctttctctcctttcttcccaagcaaccgccccgagggggggggggtgaggggcaccgggaggagaggaggccggcgagcctaggagggagagggcgagagaagcggccggaggaggtatggacagtgccggacgactgctcgacggactgcaggaacctgagcaccttcttccagctgccgctgcacctctccaggagctccccgcgcgtggcgggccagggcccatggccgcgagtgccgcacgtgcgacgcatagtcttgacacggcgtgctcggcgagcgggcagagcacgagacatgtggcctcaagcctcgcgaggttcccggcggcgaggcggccggaggtcaggacctccccgataaggtggctgggtagctcctccatcgaaaagcttgcggcgccttctccctcatcgccatggatccacccctccttctgcgatccccgcctccacgcgatgaaatcttggcggtcttggccatggacgacgacccgccaccgtcgaagatgccggtgatgaccgggtgactaggtgacccggcgagcagcgccatcaccatggatagccctgcggccgtcggtcccgtcctcctcggttgccgccaccgtctggcacgatcatcccaggctatttctcgatggctgggtactccagaggacaccgtcttggggtcacaggtaggcgctcgttgctgcccaactgcagggagccccggctcgccacgctccgaccatgcctccacatcgccaccgcagcgttcgatttcggccgcaccgccctcgacaggaataagttcacctactgtcgtgagccttccttctttagttatcataggtgtgaacactagagagggggaagaagaggccagcatccagcagcctcgcacgtgagcgtcgtcgtcgccgtcgggtgcggcggcggcagagcctctcgaggtggcggagctcggctgggcttgccggccgtctctccctcttctgccgccggcgacctcacgagaagagagcaggagagaagaggagaagaaagaaaagaaaaaagagacgtgggtcccatattattttttctcacttacatgtgggctcccatatactttttttttaactaggatgccacgtcagtgaaactagatatctatactactatgggacctaaattgcacggttttatatagtttaggggtaaagatttctgatattgaggataagggatgtcaaaaaaataagggatggcaggtgaacttattccggtagaaattagtcctgcatcagaatttctcataatggcgacatagattatggatggattattcatgttttatacacttctaaaaatacactttcttctataactttacattttagtaccaattaaatattttttttctaagctatttattagccttataatattacagaacttttacgctacaatatacgagtagtatgctgccattataaatgatctaactttataggccgatttgatcttccaattaattactccctccgttttgactttctttctagttaaattttgtaaagttcaatcaagtttatagaaaaaattaaaaacatctaaaatatgaaattagttttattaaatctaatgttgaatatagtttgataatatatatttgtttttttaaataatactatatttttctaaaaatttggtctagaaacaaaaagtcaaacgacttataaacggagagagtagattacagtataaaatttcgtaaaatttaaaaaggtagatttgtctttctacgtggtggttcgggtcccctttggctggccatggtaatcatgttctaccttactctgcgcgatgattcattgttcatgggaggagagatgggtgaccaggcttttctaaagtagggggattagcagtgtttagtgtgccttcgattcgggtcaggctatattggaggtttggatagcaggtggggctggaggtaaggaatgaagaagctttatcagttgaattggttcctcatttaaataacgatttatctttctttttttcggtgagtcatgtcaaatcataggctacaccaattttgatagtagctaaactacctcaaatggtcatctcactactatgaaaaccatttttcgtggtggccattttgaatttttgctggcggattttgcagccgtcaaaaagcaaaggccagtgaagatcaagatcttcgctagcggttattgaccgcaagaaaaaatgggagccgctagagtcgaagcaaaggccagtgaagatcaagatcttcgttagcggtcatcttaagccagccgccagtaaaaatccagtttcgctggcgttggcttaagacggccgtcagcgaaaatggatttttgctggcggctatgttaaatcggcctccagtgaaagtctattttgggcccaaaaagaaatacccatgcagctgcccattgattcattaattttaaaattcaaatccatatctagattcgccgctcatttccaaattcaaacatgaaatacaaaatcatcatcagcacagatcaaacagatcaaacatcatttacacagatcaaaacatgtgcatcatctggaataacatgcaaaaaaaaaagaaaaaaaaaatcaaatctagcagcacggtcggaggagggagccgcgggagcacggtcgacggcgtcgaggtcggagaggagggagacgagcagcatggtcgacggcaccgaggtcggtgctgccctccccgtggtccggcggcggcggatctggcctccccgcggcccggtagtggcggatctggcctccccacggccgggcggcggcggttccggcctccccgaggcccggcggcggtggatccggcctccccgtgcacccgagctcctctcgcggccacgcccgagagccgccgcccactcccgggtgccaccgcccacgcccgagctcgccgccgccttcgccgcgcactccgtggagggagagggagttggaagaggaagagaaggatgtttccttcaaccttgaaatcttgaatgcagcgtttggtaaagaacatcatcttttaggtgattgttcttaaataggcccggttgaacttaggaagatgtgaaaacaggagtttctgtctttctaatgacaaatttgtttgtgatatttagtacgtacgatgccctttatgcactatgaatgtaatgatctacatggaataatattatcgtgcttgtcacagctacttaattagaagcctatacaacaaagcaaaggaaattgcagatgcagatgatgaaaagagtaaaacctcagacgcttcattggtggataaatacaattcctccaaacgatcagtatctctcgtgcaaaagcataaagagagcaaaaaggaaaaaaagaaaagaagcagaagcaacgagagaaagaagaaagggaagggaaccatcaaccacccatggaagccttgtgaccgcgagaaggacctgactgctgggcggcaaaatgtcaatttagatcctgagaacatggcacaaggattgtcatcccgtttttcctctggagctgttcagaggaacttcaaggatgaccatgttggctaatcacagatgaagcatgcatgaccatgttggtcactagtatcctggtattatgagattgtcctgtttcttcatgatattgttggtttgaaaaagaaaataaagtggggtaagattgtcatgtttttccatgatattgttggctcccagttagtacttggtactcctactatcctaaatccagaaatagatttggtgcatgtttctttgaaggatctgttgaattgtcttgtggcatgtagttagttaatttttgattaaggtgcatatgctactatggtactaataagaattaattatgtctgattcatgtggatagtctctaagttattaaataaaattgtagaggaattacttacaatcaaaagttagattagatggggctggtcatgggctgaagatttgacgaaatgttccttctgtgattatgaacatgtatgcagttagctgattattaatgaacagttagctgaatttttagaagtgtatttacaggtgcctgtcaggcttttgacacaaataattatactaactttgacatattgttttggtgtgcagttttctgatatgtgatgtccacgggccttttgtttgctgcaacaatgatgcaaggaaatgtattatgatgtatgtcggaaagtgttgttactagatagaactattaaggcaatgaagctcaagttatgtcttgttcaatttgatactggtaactgggagagatatttgtgtgtcctaaatctcaatgtgtattggctcttaatgttggttgcctttttttttttgcaatattgtaacaattacgacatggattttgcagcaggtcttcagtatttctttaattttctacaattttcgtaattttctaggcattttcggaaaacctcatggcggccggccgacgtggagtgagaacttcactaccactggcgcggggacctttactactttacgacgatgggtgaccgcccgtagggggtttattgcacaaggcccctgcagaggaaaagcttgatcccagcgaatagaagatggaattgctttgctcttttctttctttgatgcttggaaggaaggcctataaccaatcaatagtaaacatcccgctaacttggtcagggagcatttagacggtgcagttagtattgaccactaccgccaagtccataattcaaaaattgatgaattcannnnnnnnnnnnnnnnnnnnnnnnnnnnnnnnnnnnnnnnnnnnnnnnnnngaagaccccaccgtggtatgcgccaataagaccaccaaaggctcaatatgggggatttccgttggatgtgatctccttatatatcttttttctgtattttcctgaaaaattatattttgtttgtgccgtatttcgaattatgtgcataatattttgaaatttctggagtgagactattaaattgatatgatatctcaccactcactattatttaccacaccaataatatacttagatcccatgggttaaggggattatatcccacggtgaaggggattgacgtggggattgggtggtgggaggggatccacccaatccctgcctagtggtattttccctggggaaaaacaaccccaactaccgaacaagcctttagtcgtagctgttttgttagcatcgtatttggatggaagcgggagttatcctcgtgccaagaaaaacgagagagcaccctcatcatcactgaacggctaattaatcctccactggcttgcacactagcatatttaatttattgtattgcaatttgcaacagggtgttttgtttcttctcaaagttggtaaagacctacttcctggtcgccgtctttttcttaaattaactttgtgactttgtaaagaagacctgtctgcagattccaagataccggtcgaagagtaggtcttccatatgatttatatcatgtccatgtacgccctgctcattggctaattaattaagttccagggcaaaggaagactttgccaacttgcataactatagaacgactcgcagatcgatctacctcccaagagtcactattaatatatatatatatatatatcaagaaccgagaaatatatatgattactccatatatatagtgtgtactctttgctaggtaggagtagatcgatcgagccagtcgcccagtgctgctcctgcagcgatggcggaggcagccgggacgagggcttcacagcagcaggaggaagcagctgggattgagaacggaggaggcaaggaccagctgccagaagatacaagtaagttaaacataacagtcctctggcttgcaatctactttaggttgatggacggcttcgggaagctggcacttgcctgggccaccgttgtgctgctaggtggattctccaccctgataaagcccaaggacttttggttcgtcaccatcatcgtggtcatgcaaataacaaggtgcgtatcaatacgacatccctatatatataaagtagaagttaactaaactgctaattagtttccgtttccaccatcaattgatacataggaaaagtgctggcttgttcttgggcactcgatcacaagagaaaaattgggcgtcccatggctacaggcagtgcccctctttcactgtgaatagcctgcacacgccagcccctctctctctcctatgcatgcatgcatgtgtgtgtatcgctctaacgagtttcaaatattttcccttaaattagttattatctcacatatgatccaattacacccatatttattaaattactagaaaaaatatccatgcgttgcaacgggaaaataccttaaatcacttagatccgtactttcctttctcaaaacttcggcaaactcaatttgaaaatttgaaagcgaattcaactttcccttttgaattactttcttcttttactagtctccccttgtttaaaattcgtttaaattctcgtatatcaaaattcactaaagatacaaaagtccatataatcacacgttgtgaccgatgatggatgaaaaacggaagcccattaagatttttctacaaagtaggtggtgaagatattccaggagaaaaacaagataaaaagaggagaaaagagaggagattgaaaggagagggagataatcaagattatcggcacaaaagaaaagaagaaaaagaaaacgaaaaaaaggaagagaaaaaaacaagctgattaggggaggggtgtgcgtggcgcccaagtgtaggagcgcgagatggacggtgggatggtgttgggttggttgggttagactgggagagagagggattgggatgggatggtggtgtttaatagttattctagactcacgtgcgtggaattggatatgggtgacatataactagcttaaaaccaacttaaacacggatgaagcaccaaagtttcggctgaaacatcttcaatttttatatagtagagactagaaaattaaaggtgtccgtgcgttgcaacgggaaaaactaatgttatgataataattatagttattttatagtttcatgggaattaggatatggcatattcatggacataaataatgaattaaatctatacctaattctatatcatgacaaagaaataattacatttttgttgactccatttagctagaaataatttaatatgaagaatgaaaacatatttcaaatttaagtaatttttaatggctaaaaatagtgcttgaactaagtttgttaacggaaaaatagtttaaatcggttgaaaataaataaaacacaattagtctcataattagaaggatgttgtgaccggcctgttaagtgcactgggcccatgtgacaggtcatggcacaagtcgacataggtgcgctgagagtcgttggattcgatagaacggttaggaacttaggatcactcgtgatttagataaacattgcctgttaaaaccctaaccttaaattcattcctcctctctcccaccgcgagcgatggcgcactcccccatcatgagcgatggcacggtgccctcccttagcatgtgtggcggcggcgggggcggcgcccttcccctccatgagcaacagcagcgtcgccctccttaatatgggtggcggtggcagctccctcccccaccacgagtgacggcgtcctcccacggcttcaacatgcggatccagcggcgacgacgaagtcgacgacttgttgcgggcggatccaacgtcggcagtgtcggcgcaaatccggcgacgaggcggcttccaacgggcggatccgacggcggcttcccgagagcagatccggcagtgacaaaggatttcatatttatctttgaatttttttatccaccttacccaatgtgttactcgcgcgtgtgagaacggaggacatcattcgattggacttacagacaaaaaattgatgtgacaaatggatagcccatattgatcagtaacatacctaaggccctgtttagatcccacactaaaatttttcaccttgtcatattgttgatgcgaaaaacacacactggcctgcgagatctgcttaactccagtgcaggtccaaaggttgacgagatgcgggagtgccagtcagtttgactctgcaactgacaagatatgcaaatagtagatcaataagccgatcggctgacaagccgatggagcaattccagccgatgccgataccagctgatagcgatagggttttgaacaatcggctatatgtccaatgtagataatgatataaaggcgatcggctgatgatgataaataataataatataatccagtataaaccaatcggccaacattatgatataatagaacaagtactgatccgaaggttaaagcatacatcggctggaggtctgatgtcataaaatccacaagattagatagatcaattaaacctttgttgtcatcggctaaatcgaacttatatgtatatgcaatccttataagccgatgcaacatctagataacttatcggctagcactccgataaaatattagcatgaaccgatcggcttaacaagacctatattatcaacaacaatctagtaggttgaacctaaccgatgcagcacgagattgtatatagtaatctaatactcgatgagccaatagatctgtctaatgtgatagatataacaaatctatttagaacaacattgtgattgtagagatatatcggctaagatagaagatcggacctaaccgagacagtcccaactaaaccgatgtgtctctaaacacaatgtaattagagatataattgagatatcaggtaggcaaatatatcaaccaaaccagagcgatccaagagattgaagcgatgcagccttgaacaacaccaatgtagccgatagattcaccagggctggtagaacgtaggacttacctcttcgccggagatcgaaagccgatgcagccccgcgtcagctgccaaattccgtcggatgataagtaaaaacctcaagaaagaggatggcgatgcgccgagagtagttgtattgatcgtgtgattgattacaatgaccctgggtgtacatatttatactcatggggagatactagtccttataggacaagaaagaaactttcctaaagataaaaggaaaacataaagtccttagaggacactaaacacactttcctaaagataaaaggaaactaacaaactattcctaattaatagataacttgccatgttgcatcctccttgaactcggttacttctcgataaacttcctttaatagattaatttccttaaccgaatatagcaggaattcggctattgacgacttggtaattctcatcggccgattccaggactctgaaaccgatattgactttaggccgatgataacttcgggcttaccaaatttgatcgttagcacatgccccccagttttggagtatgaaaactcatgcttcaaaattatcttatttcttgtcttgataactacaaaactgatcttcctttgcttattgtaatcagctttcatgagcctatactgtttgcattagatgagccaggttgtcaaactcatggcaaaagaatctctctctgataggtgttgacaatccttggaatgcgagatctgctagttgctcatcatttaggctcaaaccataacatcggctgcggacattacgaaatctctgaatatattccatagccgattctccttcttgctgctcaaccgatattaagtatgaaagcttcaactcattgattccagcaaagaagtagtcattaaattgcttctcaagatcggcccaccctctgatagaatttgatgatagcgatgaaaaccatgtgaaagccgattcagtcaaagacaacggaaaaaatctaactttcagagcttcctcagccgatgcttccccacattgcgctaagaatcaactgatgtgttccattgtagatatatcatcttgccctgaaaattgggagaagtctagaaccttgtattggtgtggcaatagaaccctatcaaatcacttatgatatgacagtcgatatacagaaatatgttccttaggtttaattccaaactgctcttctatcatctttgcaattctatcggcccaatcattgttatattggcattcttcaccatgcccatattgatgaagttcgtctggccgatattgatatagcccatcatgttgatactgatatgcttgcccccaagccgatactgttgttgttcatcaatctgccccccgagctggcttttctggataattaaatcgtcaactgataccttgatcaaattttgtaacgtatccgccaaaactccagattgattaaacaatgcgcgatgaactgcttcatcaactgtatcttgaagtatttcaactatcggctcaggagattgttccttcttggtattgacttcctcttcagacatgttgggtgcgaaattcgggtcccatcgggcatgccaaaaatgtgttgatgcaaaaaacacacactggccttggagatttgcttagctctagtgcaggtccaaaggttgacgagatacgggcgtgccagtcagtttgaccctgcaacagacaagatatgcaaatagtagataaaaggaaaacataaagtccttataggacactaaacacattttcctaaagataaaaggaaactaacaaactatttctaattaatagataacttgtcgtgctgcatcctccttgaactcggtcacttctggataagcttcctttaatatattaatttccttaaccgaatatagcaggaattcggctattggcgacttggtaattctcatcggccgattccaggactctgaagccgatactgactttaggccgatgataacttcgggcataccaaatttcgtcgttaacacacatcgaacgtttggacacatgcatggagtattaaatataaacgaaaaaaaataactaattacatagattgcatgtaaattgcgagatgaatcttttaagcctaattacgcttgatttgataatatggtgttacagtaaacatctgctaatgacggattaattaggcttaataagttcgtctcgcggtttacaggtggattctgttatttgtttcgttattagactgcatttctctactattataaaaattaaagatgtttttgctgtattttggtacgtcacccgtgtttgagtcggtttttaagttcgttcgcttttagaaatatagatccgcgtttggcttggattttaagcttattttcttttggaaatacaaaaggagtcgtagaaggaatatctttaaaaaaacatgcatgctaacttgaggtaaaatacggacttctaattgtaccttatgattttctaaaaagaatatcaaagcggattaccacagtgaattttaccctacttaaactgtataacaacaataaaactaaaatagcatttaccgttacaannnnnnnnnnnnnnnnnnnnnnnnnnnnnnnnnnnnnnnnnnnnnnnnnnnnnnnn

SEQ ID NO: 24936 - DNA, 3237 bp, Oryza sativa
  unsure (1)..(3237): unsure at all n locations
gagtattaaatataaacgaaaaaaaataactaattacatagattgcatgtaaattgcgagatgaatcttttaagcctaattacgcttgatttgataatatggtgttacagtaaacatctgctaatgacggattaattaggcttaataagttcgtctcgcggtttacaggtggattctgttatttgtttcgttattagactgcatttctctactattataaaaattaaagatgtttttgctgtattttggtacgtcacccgtgtttgagtcggtttttaagttcgttcgcttttagaaatatagatccgcgtttggcttggattttaagcttattttcttttggaaatacaaaaggagtcgtagaaggaatatctttaaaaaaacatgcatgctaacttgaggtaaaatacggacttctaattgtaccttatgattttctaaaaagaatatcaaagcggattaccacagtgaattttaccctacttaaactgtataacaacaataaaactaaaatagcatttaccgttacaacgcacgggcatttttctagtaatacttgaaatgtgcgtatgtatatatgatatgacacgccaaaactttacacccctaatctaaccacagcctaaatcaaaccagcccaaaacttccgttttctttttttttatttcttttagtttttcttatggccagatcgctccacgcctcctgaaactaatatttgaatgtttagttcatgctaaaattgaaagtttgaaagtttggttgaaattaaaatgatgtgacgaaaaagttgaaagtttgtgtgtgtaaaaaaattttgatgtgatagaaaaattgaaagtttgaagaaaaaatttggaactaaacaagccctaggctgaattggagtgctcgatccagcgatctaacggggtaggaaaactgatgcacgctcaatacacagatgatttgacacggcgatgaaaaaaagaaaacataaacaattaattagtgcgcaggttacttctaatcggatacatatgcgacgtacgaaaattttcgacaaaaacataaacttttataatagtagatataataattagaaaaaatacccgtgcgttgcaacaggtgaaggctattttaattttattattgttatatggtttagttaaggtgaaaatcatgagctacaattaggagtatgatcatctcaagttaacatgtcagtttttattaaaaaatatttcttatacaatttcttctgtattttcgaaagcgaacgaatttaaaacccgactcaaatacggatatgtatttccaaaagcgaacaaacttaaaaaccgactcgtacacggataacgtaccaaaataccgataaaaatatctttaacttttataatagtagagatagagatagatctatctataaatgtgtcatcctaaaacggaggcaaactttagaccatacgatacaaaaaattattacgatagtcggcaagcccatccaacatccacaaagatcgtgggatggactggttggaatttcaactattggacgaatttccgtaacaccactcgaccacaaaactaggtacgtagagaacatgcatcctccgacttacaaaattagatcaatttacatcccttcgaagtttgcacgatgtttttgttctgatatggtgcatatgtggccacggttcgacttgtcgtcgccttgatccttttcactcaaatgaattttacaataataatcattaggtgggacccacatgtccgaaatcctttctccacccctcccttgccaaccaacagtccaccacgccacatgcatcctctaggattgaagacaccgaggtcgtgagaaagagcgcgggtgtggtagcggctgaggacgatggtggcgacgacaccaccgttaggagagggatggatgcacgtccgtcgtcgacaaagatgcagtcagtgtgagcagaggaggaacatggtgacaacgtccaaggtccatggcgatcacagcggcgaggagctagtgctgctgggtccccaccccacggcgacggagctgcagctgctacaacaacccatcctgccaactggtggaacaggcttaccccacgccgcctactcgagctcagctgcggtttgggctgggtctgtgtcacgcccagaaatttagtccaaattttcagattattttgtatataaatccctatcaaagaatcaaaccagggtacacaatatgatgaattaatatacaaatctaaacataaatattgcgtaaatattttcagaagaaacacttggtcctcacaccgaaaagaaagcagaatcagcggaaaaaggcgatcctcagctccactccacaggcaaaacttaatcggggtatgagccttggtactctaacttcgtcttcggctcaaaagcactacacttctaacctcttatgcctaggtgaatccggaattcgcaaaggtcatcgcaaggcccatccaaactccatcatgctcacccttgcctcgtacgtcacaaaggaaaaagctgcactacaagttcagcatttgcccattctttcttgtcataagcactgtaagtcttaattgccatggtgtgatcataaaaaagatgcacccacaacccaccattaagtcatattttaaatggatagttacgaccaataaaacatggccatgtagttcgagctcgcagctcatcaagatactagaagtagataatgtgattatcccattaggatactagaagtagataatgtgattatcccattaggtaaggtagtggtaattaagcatggctaagcatatcataattctagcaagatcaatataagtgaaacaagctagacaaattatttcccaagtctaacaaagaatggatcacaagtaaacatggcacaagcgagcagataggtaatcccatagtcccatgtaattagcaaagcgtgcaatttatttgcaaacggtaaaaacatttataaagtaggctcaatatgctcaaggggaaggtgtgacttgccttgcttcttcgattgatcttaggaacatttttcctcgcggtcacgatattctgaaaactagcagaatctacacgatggcacacaaaatgaacaaaaaccctaataaaaaccaaataaatagtacatgaaaagtataaacatgtagaactcaattttgtatagaactcannnnnnnnnnnnnnnnnnnnnnnnnnnnnnnnnnnnnnnnnnnnnnnnnnnnnnnnnnn

SEQ ID NO: 24937 - DNA, 13744 bp, Oryza sativa
  unsure (1)..(13744): unsure at all n locations
tttcttgtcataagcactgtaagtcttaattgccatggtgtgatcataaaaaagatgcacccacaacccaccattaagtcatattttaaatggatagttacgaccaataaaacatggccatgtagttcgagctcgcagctcatcaagatactagaagtagataatgtgattatcccattaggatactagaagtagataatgtgattatcccattaggtaaggtagtggtaattaagcatggctaagcatatcataattctagcaagatcaatataagtgaaacaagctagacaaattatttcccaagtctaacaaaggatggatcacaagtaaacatggcacaagcgagcagataggtaatcccatagtcccatgtaattagcaaagcgtgcaatttatttgcaaacggtaaaaacatttataaagtaggctcaatatgctcaaggggaaggtgtgacttgccttgcttcttcgattgatcttaggaacatttttcctcgcggtcacgatattctgaaaactagcagaatctacacgatggcacacaaaatgaacaaaaaccctaataaaaaccaaataaatagtacatgaaaagtataaacatgtagaactcaattttgtatagaactcaattttatataaattatgcaagttgaatggctcaatttggagttcatatgaattagttatgaattttagaagtttttaaccatttaaatcaatttatggaattaaaccaaattattgcgcaattactaattattttaacaaagaaaaacaaggatgctggtgtcatcaatgggccggcgccaacatgtaggccccacacgtcagcaggccaaggggtgtgggggggggggggtcatattgcaacggtcggctgggctatggaccgggtccacggggtgcatgggcgaccgatggcccaaatggcccaaggctgaacaggcggccaagatcagctaggcggcggcagcgaacaaggacgcaggcgcgccggccagcccgagaaggcggtgaccaccgccggcgatggtgagagacacggggagcggcggctggcacaggaagtggcactgcacgcgaaaggcgccggcgagggcgaaaaaagggaaacaaggagagagggggagggtgatctcatcggcaaacatcggcgggcggtgcaggagaggacggcaacgacgatgaccttgcgagcgaaggggcggacaagcggcggcgacaactaaggatggacaataaatcgattagagagagaaggaggatgttgctagctggaggacgggaaatggtgggactcaccggcgtgcgagggaaattgggtttcggtggcggggaacgtcaaccgagtggcggccgtggggctcgtcgtccttgcaaagctggaggaggaagcaacggggcatgggattgccccaatctacggcaattgccggccagaggtggcgaaagggtggtggtctggtggagctcgggttagtgatggaggtggcagctcggtggcggattggagtggagtggcggccaggacgtggcgcggcgctgcgatgcggcaacgtgaacagcacggtgcgatggtggctaggcggtggcagcgtgcgcccggagtggggaacaacggcggtgttccagtggtggaggggaaaaacacgtagtggaggctaaggtggagctcgatgcggtgaagctgctggtggtgggggcgtggcgcagcagtggcgctagcagcagtgatttgtggccgaaatacgacggcgatggtggagcttgtaggtctcagcgagggagtggtttcgggcatcggcaagctcgcaagagaggggtaaacggatgagtggagtaggggggttgatttttctaggcttgggaggctggctcgagcctcgaggtcgggaagagcgggaacaaccagcggagtgaggctccggcgacttgtgcgaaatgtggccttagtgggcatttaactatttgccacttttagatttggcaattaactatttgcacccctatctcaatgacatgtgggtccaaatgtgtcaatgacatgtgggtccattaggaaatagttaattgccacatctaaaagtggtaaatagttaaatatctcacacagggggccacggggatgtgggggaaatgaggcgggaacgtggagacagttcgacgctgtttagatgcgagctcgtgaccgggggggcgccggatttggcaggatgtgagcggcggtgtggtccggccggtcaaccaaccggaggttgaaggagagcccaacaggtgggccccacctactagcggctcgggagataggagggtggcagtgtagacttcgcaaaggggaggtgcaagcgggcggagcagcgagctaggtcagggagagagaagaggggaggatggcctggcccgggagagggaggagaaagcaggtcgtgcggggagcttgggcctaatgtccctggtggttgtggcatcgacatttgtggtcatggcacgggacgcccgcagcagcggagtggtaggcgctaggtgccaagatgtaccgacagccgccttattgcagacgcctaccagtgagctcctgccagggcaagtcaacgccgtgtgtaggttagagcaacggtgccatcttcttccttcaccaccaaagaggcaccgccatgccttgctctttgaaccgagaagagagattagggagacactacagccgaatgctgatgagatcgggaagagggagcctaaggggacagaaagggatagaggcagtacatggcgcggcgatgtatcttgaatcgcccccacgaggtcagcgcaccagcttcaccaacaccgcccaggcttctacaaatttattgatccacagacatcacctgcaaatcaacaaattcacatacaaatcaacaaaatagacatccgtgcagcccgccgtgcagcccaccgcaccgcccgccgccgtgtaggccgctgccgccgtgcacctcgaatccgccggcttgctcgcttcctttaaaggagaggataagagagaggaaagagagaggataagaaaagggaggaagaggaagttaaaatgaggagataagggagggggagtttgcttgaggataatggcgaggtattatatacgacgcatcgatttttaagtcccggttgctcttatcatatgagtctaaaaatagtagggggacacacactttttgaacctggactaaaaataatctttagtcccgggtctaaagatcataaagtggtggtgggcttttcaaccggggttaaagatgatctttagtcccggttcctattcaaaccgggattaatgtggtttttgcaccacccagtaaagatcatttcttcagtagtgatataattaatgcatgtgatataattaatgcatttaatttaattaggtaaactatgacaggcttctaggaaatagctgttgttggttaatgtaaggaaaaaaaagtacgaattacccctaaactattgcgacagtatgaattgccccctcagaccacaaaaccagacatattaaacctcaaactattgaaaccggacgatttaccccctgactcaacccgaagcggttttggtcctacgtggcatacacgtggcaccgacgtggaaatccaatcagcaaaaaataataaaaaataatatatatagggcccacatgtcatattgaccccctcttctttgtcacttctcctctgtgatgttggcgttgggcatggctgggcaagcggcagtgggcacagatgggtggctccggttggcggcaggcacggatggggagggggaataggttggcggcgagctgcgacaggcgcgaatggggggactctccaggcggcggcgggagcagcgggaagggggtgcggctgggagtaagctccagatgacgacgaggcggcggggaggaagcttcggtcgagcggagcgcgatgacgggcatgactggaatgacggtggtgaaggtcgcctcatcggtattcgcatcacacctcggggggacgtgcgccaaggctctgtcgaggtggggactctcatggtcgtggacgtgcgcgatctgtcgctgctgctccttgccacgccctctaccgctcccgccgcgcctgccgccgcttggcgctggcatgctcccacaaatccgccactgccgccgcttcccgtgcctgccctggagggcgacgacaccgccgtcacttcccccgctcgccctagagagcgcagccgcacgtgaccccgctcgacctggagggtgccgtcatcgccgccgcttcccccacccgcccttgacgtcgccgctttccccacccgccctggacgccgctttccagcccgccctggagagcaccaccgccacgtcgctttctatctgccctggaggagatgaagagaggggaaagtggaagaaatacataagcatgacatgtgggaccacctaattttgctgattggatttccacgacggggccatgtgtatgccacgtaggactaaaactgctccggattgaggggggggggtaattcgtctggtttcaatagtttgagattccggggggggggggggcaattcatactatcgcaatatttcaggggggtattcgtactttttccttaatgtagtaatgtgaaacaaccttaagcaagtagcgtaaaagaaaatctatttttcatttgatacatggttttaagaagagtaaatactagacacatttcagattgctacaataatatatagtctatgattttatcaaaaatctgccactttattagtctgacaattcttggagccatctgtcattcatagatgcaatacttaggctggtgtaagttaggtctacatgtcatatacatagaggatcgtaaagtagtagttttgtgataattaaaatctttttctatagctggagtttttgtgaaatacctatctaaagttgttgcaaattaaagcgttatgtttgacaaaataatggtagttttgggaaatttaggacctgttcagattgtagccaaaataaaccttattaagttttggcaatgtcaaaattttggcaagatagcaatattgccaaaattttggcaggatttcttatgtattgatcaaatttggcagcaaactaaatatagacatttttttagtaactttaccaaaaaaaaatgtatggttgaaaatgacatcaaagtgaacagaaccttatactatcttaagaaatatgtgctgatcattttgaaaatggtagggtttttggcggttcccagaaacccgaggatcaactctttattcgggtaccactctcgatgctgcaccgtgacgaacttacgcatgttggactcggaagttggcggaagaacacaataaagaacggagaggccagcaaaggctcgtcaagcgtacgacagaatcaacgcaatgtcctagttcgcatgttttgcccaaagcgccatgtcaagatgaccatattccagacaaccctgacatggatggaggcagctgcactcgtcgcttgcatcttcatatcgttccggcgtttactcaagcaagactacgtcgatccaaaagacaaagttaaggatgaccacaagaacattagaggttccctgaatgtcttctatgggctggcccttgcccatagcatgtcctactacatcttgattgttgcgttccagtttttagtggctccattggtaaggttggtccattctagttacaagcttcatgactggggcatggatgcagtttctgagtatacagccaaaaagctttgggcattcattaggtataatgttagggaagctctcgagatgaatttgatcacctttggaaaggagctggcacgatccgattcaattgatgaccagttgaaaggagttaggattcttgattacatcataagatgggagaagcagcacttatctagagcaggtgttcttgacatctacaagattgagaagtacaaagggagggtgcttacaagtattcgagcttccactgagacactagagagagtggtgaatatgctggggctgaatttgaagagcctagaagaggaagaaactagaggtcatgcagcatccatagtgcttgaacttgctccatacctcctattcgagaatttgcctgcaatgccacagcttatagcctcactactaacgacaggccgagagaggatcaatgaaggcccccatgacataaatagtgtggagctcacttgttatggtgtgaaaattcttgaaaggcttgtagagaatccagataaccgcagatctgtggctgatgccaatgtcgttttgtcgaaaattgtagaactgctaaacttcagagatgattgtaaggtacctgttccagatgaaactgagaatagaagccaagaagagatagttgaggcctcactaaatgtcctgcacaagctagttagcactactggtgagactggcgaagctctacgaagcaccatttccaagaattctgagatcatgagcaacatcagaaaaatcctgtatcagcatgataacaagaacagtagtttatctgttcatgctgtaaaaatcctttcttgcttagcgatgcatgagactgctagagaagtgattggaagttcttgccagatcgtcaggaagcttgtttcgtcggttcttccaaggcctatggatattgttcaagatggcaacaatggatccacagttgctgactcagccgcacaggcattagttctgctaagtactgggagtgaatacaacagggcaaccatccttgataaaattaatctggaagagcttgtcggcatgctctttgatgcttccatggagcaaaggattatgatagcacatctgcttaaacatttgcggacgtattcaggcccaggttatggaaaccaactgaagaaagtaattgacggttctctgccaaaggtaaattctgtcatatagttgagtttttgcctaaaattggaattcgatactaaattttctgcatcaccataccactgaagaatagctgaaatatgtgtcaatgaatacaatttttctgaaggtaaaataaagtgttcgcgtgctataagtttcggtagtaaactatctattctttgtcttccgttacatgttccaattctatttctgttaaaaagctaaatcttatgttttccatgacaatctgtattgcatatttagttagaaacttagaagaaaagtaatatatgttatcaattaatgccatttcagttattggaagaaatcaaagttgcagttcagaagctcgataatcctgaattccctgatggacaaccttctcatgtaacaaacctctctttctaagacatcattgattccatgtagcttccctcatttaaaacgtacactcacttttcttgagtaaactcacttaaaattggtgctgtgtacaactaggacctgaaagaactgaaagctgaagaaggcaaactactagacagctttattggcctcagctcacagatttgccactccttgcaagccattgattttgataaggctctacagagtgccaaccttacaatggatacgtatgctcaagatggtactgagcgtgtgcaaatctcctaccaccgatttcccggggataagaagagtaacactcagtcagatgaaatggctgataaaaaataacgaagattacgttggggtgttcaagaggtatgaaatggacaaggcgctgaaggaagtggcagagacagcaactgagctcgagagcttcgagctattctgcagtggttctggtgttggcaagcatgatgagcccatctcttctgctgtcagatctactttggcgctgcttgcaggagattcagcataatgataacattgattactgcgtttgaaggtatcaaggatcaaggtatatgctgtttgctgctacgtctcgacttccttactcgtagcaggaccaatttgccgtatgtcaatttaattatctacactagaaagatagcctcctgaaataaaattaatgaaattttattatgaatatttatgtgcaggtggctttttattaaaatatttttattatattccaaactaaaattaaacttattttgtgttatttgaatgctgattttttttaattaccattgcaacatataaattctaaaataaaattacttgagatcatgcggttttgaattgatgagaaaatattgtgtcgaaacaatggaggtggttccgtttttgtcaaaatttcactttgttcggttataatcaaaacagcagttgatttttggtaaaataatcatgagcatcaaaaaccaatacccctattatagctagtcatttagattgatccaaaatcatgttatctttcttttcccatcataaaatgtttccaaaaaacttttcaaataagaaacttcttttgtcaaattagcacaaattttacaatcaatcataacacgtttgtttttgcgatatctagagcaagaaagcacttcatcagattttacaattatttttttatgtagtcactattattccttgcataccatttgaccttgctttgttagatatcatgatatttttgagaatccatataaaatttagtatttgaagaagctattgacctaaccaaacatatcgaattgtagtaaggatcactctgaaattttgttaatcttaattggttttttatgaattttctataaatttttaaataataaataaaatctcttcagaggtggtggcttatgaaaaccacctggaaaacgaagtgagatcacatatcagtgagaatccacatttgtacgggtcaactttatcattgagaatccacatttgtgcaggtttacttgtcaactcttttgacactatggagatgaaagatttaaaatatactaatttggacaatagattttaagtttaagatattattttttatagtagatttaacctatattttactttgtacaaaagatttaacatagagaacatggtgatatatcagaaagcaaaagtttctccccaatttaaactacttagaaccctcttgtcatactctggggctaataacatgtttgtggagtatatagctgtcgacgagtgatacttgtataccggatgattagggtattgggatatgttggaacgaggatctacgtaatacgacatcaagcagacaaaagacaaggattatactggttcgggccccttatcaggtaatagccctactctaatttatatgagattgatgatggaaaaccaaagattacaatggaagtagacagaatcggcgacccccggcgacttggttccgcgttttccggctttgtaaactatggtgtgtgttagcgatgagattcgatgccttgcacccttccctgggggtcccttttataccatggatcatcttgatccccaagtaagactcgaagacattggatcttatacgatataacaaaaactctatcccctccgagtaggactttgaaaatcactcgactcgtgtagatattttccatgatttttaacagattccactaacatacatagaaataatccacgtacgtgaaggtataccgtatctgcatattccataagtcgtcgggtaggaggtatgccctatcaggaacctgacaatagcatcttcttaacatagatatgatttagttatttgaacttaacatagatatatgtagtatgagcaaactgtgaagtcggagtagagctcagagtttctaggtgaacattaattcattgtggctgctgcttacggttgtagaagtatatataagagcaatgggaaaacttgagaagactttgcttgcttgtcataataacaaagacaaacgactagcagacctcccaacaaggcggtcttaattcatttgctccaccatattatattactacggccctagattaaaactcttcaatataatactagtatttcgcatgataatatatagatgtggcacggatcgttatgtcgctacaaaaaagcttcgaatctgcacgcatgtggcttcgtatctccagttctccaccccctgcatggtaacagtctagtgatattaaagggcaagaacagttgaacctactaacatatatatactcgctctggcactgaaaaaaccaacttctgggacgtgtttgaacaagtactttttatcccagattcattattgaaagttgatttttgggacaaagaatgaataagtgatcagaataacgacataagatgaaaagaagtggagaagaaattaagttaaggaacgatgaaaattaattatagaattaatatttgcactaactatatatttaagttaaggttgtatttttccttgacggtaaaatgtatttttctgatggtttcacgctcatatatatacactagtacaatagctatttttctgtgcggtcgaatcggtttttgcgtgcggttgcttcacccgtctagaattaagggtctgcgaaaatcgtgatttttttttgcgggtgacgcatacgcacgggaaaataaaaaatcgaaacaaaaaaaaagaaaatcaaaaccaaaaccataaccctaatccaccgccgccgctgccctagccgaggtccgtcgccgtcgcccgcgcggtcgccggcgacggatccagacgctggaagaccgctgccgtcaccgccgccgtcgtcgcccgctcccgacgttggatccgtcgcccactcctatcaccgacgccggatccgccacccccatgcctcctcactgctgccgatgccaccctcccctccggccgttgtccccgtggtcgccggctgaagacgcccctcccctccgccggatctccaaggggagggaggggagggggaggagagccaaagggagagggaggagaggggccacgcgccgccgctgtctccgctggatccgccgcccccatgactccccaccgccgacaacgccaacctcccctccgggcgtcgtccccgtggttgccagccgaagacacccctcctctctaccggatctatcaaatcattattttatatcaaaattttcaaaacacgttgtttaatataaatgttacgcaataatattctctaccagtaaattccaatttatgatctatattaactaattttttacattaattactgaacccactattttatactatttttaataaaaatattttgatatcggttttcgcttaaactgatggacctattaactagacctattaaggacctattaacacgcatgccatatctatcttttataaaagtaaaatgaaacatctcaagacctcatacatgtgcatgtttgccttctgcacatatgacgaagcatcgtatctgaggcagctaaggtgatttgtcaaggtgatccgataaacactatacataccaattaaatttatataattttgctcttatttcaaacaaatattgtttcgaggaaaacaatcaaacatgcgaaaaagaaaaaaagggaaaacttcaacaaattgctgatattttgcactacccaaccaagcaattctgccaatgatttgtgtcctaacaaaaattctttaaaactttggaaaagaatatgaaaattttgaacttctacgaagggaaaaacaatccaaccattaatctatgattaatttggttgtcaataaatcatgcatgttcatgagacgattcgatcaaaataactttgagtccttgtgttgacagaaaacacgagacctaggaaatctgcttaactccagtgcaggtccaaaactcgcattcggatgtgtgagcgtgccagttgatttgatcctgcaatcaacaagaaacaaaaacaaagaaaccgaggttaaattcataaatgatagccgatcggctaattgccaatgacatatcatttatccttgagccgatgtcatatgtgaatcgatcggcagtcataaatatgtaacaaggaactaaatctactcgatcggctgtagatattagcaatatataacccttatatcgatatatactcaaatcaagtgattgggatagatcggtcgtcatgccaagacagtacaaatcacttagattgaaatatatattaacaacaagattatatatgctcatagcatagccgatcagacagatctagtatgtatcagctaatactccgatactactctatattaagatattaaagcaagtagaatacaccaaacaggagcctaatgtacttaaatgcaacaagatcttaatataaagggcagatttaacatatcaattgagcgtataaaatagaagtagttaaatcagataagatcggctaaaactccgatactaccctaatcggcaaccagaaggcaggctagggattgaaattctaagcacgacttaatagatcaaactcaactgatgcagcattaagtatgaaaagaagaacaatatctagacaatcaagccgctggatattttatagggtggtagatatcttatataatctaagccaacgtcgctatttaacctaatcggccgccttctactaacagatgttagccgattataggttagataatgatattgtcagagattatatagaatatatggtaactcgatgaattacataaacaagattagagtatcataaagatggaagcactaatcccgagaacacaagtcgtcataacaagttttacctcttgttgaagatcgaaaccgatgcagctcaacccgaaagaaagaactcgtcgaaataaaactaaagcaaaagggtggcgatgcgccgaaattgtattgaacgtatgtgttaataattacatagggctcgaggtctatttatacccgagaattataagatatgtccatattggacacgactcttatctctaacaaactctaagataccataagtctttgcggcagacttttgcccacatttatctctaataaaatatcctaattaatagatacaattgccttcccaggactctatccatgcgtggcaatcatcttgaagcacatcaacttgaacccgatgtcgtacacaagtcgtattgtcggaatcggctgtatcacttaacccagtctgactcggatttagccgatcccagtcgtagccgacccggactccagccgattcttactctgtttccgcaacaatccttatcttcgattccgcttcgatcctatcttcatctccgatgctgatattaccaaatttggtcattaacaccttgctatcgcaatttttacttgtagcaatattgtatggtatgtgttcaaatggtatacatgatatttactcactcagtccaaaagtaaattcaaatgccatatgaccttgatctatcttctaagtcaatgaatggtttttagatatacccgacctatagtttgcccttataaaatatagtttctaaagaaattataatattacgttacgatagtatagatgtccgcgcatcgtgtgggccaccttcctagttattatatactaaaaatccattaaacttcctataaacattcctaagtcgccacatgtcttcctacaaatgctcttaattcgacacgtggcacttttaaataaggtggacccaccaatttcttttatttaacaaaggacccactattttccttcattgcatttactttaataataaaagaaaaggcccatggggcctgtacacatgtacgtgtgctgcaaactgcacatacgcatgcctataaccggccggtgcatctcctcttttttatttccatgccctattagattnnnnnnnnnnnnnnnnnnnnnnnnnnnnnnnnnnnnnnn

SEQ ID NO: 24938 - DNA, 1369 bp, Oryza sativa
gcacccgagacctcccattgaagatgcgatcgaagacagagacggcgacagtggctcctgagcgctcccaccaggatggcgtcaaggaaagaggcggctgcggctggacgttccaagccctccccccgcggatggggtcaaggatagtgactgcggcaggggctcccaagccctccagtgtggatggcgttgaggacgggtactccccaacctcttgccacagacggcagcggcggcgacagctcccaaccctcccgccgcggatagggccgacaatagcggtgacggactgacggcagtggctcccgaggccttcacggaggtggtcgatgacggcggcagctacggtggtggtcgacgacattggtggagagagaggaaggggagagagaagagaggggagggaggtgaagatgaaactgacagctaggtcccacgtgcggttggggctaacggagatttttgacggaaaacgtgatggagtgatatgattctaattttctcaaattccagtggcacgtagccaatatcgtgaatagtaatgatatttttctaaaatggcatatttgtagtggcatagattcaattaacccttaaaaaatatcacttcatactgcatgcacgcaaccggccctcctcaccttctcttccctttcctttaatctttttttatagtagttgagataatatttgttatttatcataataaattctaaacaactataaattcaaaattacacatacaatttttacatacataaaatgtaatagttgagataggcttaaagtggtgctgacatattttaaattataataaataaataaatgttttgggtcatatattgacccttttcatcgtatatgacaaacaaatggcgacatatattattttatcatatatcacttttacaaacatgcataactaaattcactctactattgaaaacgaagtttagtccatcatattatttaccattaaattaatattttactatctgttttgaatatatttcaacttataaaataaaattatattttaggtcgcatttttattcttttcatgtaatccaaacatacatgaaaattatataacaaatgacaatataaagtatatttattagttgacaaatatttacgactaaataggatgacaaaaaccaaaaatgctattgacaaacgcccaatttcaacaaatgtcatcaacaattttatttataaatggaaaaagtacgaattacttcctcccgaactatcgcggtcgtctgaattaccctcccccaaaccacaaaaccaggcattcttcaccctcaactatacaaaccggacaaattaccccccttgacccaatccgcggtggttttggtccacg

SEQ ID NO: 24939 - DNA, 3625 bp, Oryza sativa
gagagagaaaatagaggatgagaggatgaggagatgataggtgggtcccacaattttttttataaatagagtgctgactggactgccacgcgtacgctacgtggaccaaaaccaccgtggattgggtcgaggggggtaatttgtccggtttgtatagttgagggtgaagaatgtccggttttgtggttcggggagaggggcgtgatttgtactttttcctaaatggaaaaattttatttatataattgctctcttatttcaattttaaattcatttttccaagaacatagtaagaatatgacaaaaggaggtagcaaaagtaaatataaatttgtcataattggataaaattttcctcttaccatatatcttaatagaaagtttcttccattaaaatatcctaaattccataaagatatctatagtacacaagaaaagctatttcttaaagtttagaaactccaaaagtaagatatactaaatattaaaaacacatatagtacaaatgatagttacatgtgaatcaactccattttccacgacacgatattttctcataaactcaagattttacgaattcaaataattagaatttatatgttgatagggtagttagaagaaaatcatgactaacatttaaagcaatcctaaacaaactatggacaaaagaatataataaaaaatcaccaacatgttaatattactcataaaaattcaagcaacaataataaacaaggtgtcaggctgtcagcaacgtactgcgcatgtgcgcgggttacctttctagtttatataatattttaataagacaaataatcaaatataatgctaaaagtcaataacgttatttattaaaagtgaaaacagagggagaacatagataataccaggattatatctagacttctgaaaatacacatccctccattggacgactatactccacaatgtccgcgcaaacttattaaaggattcagtgtttttaccctccttcaggagtattaataaatggagcgtagtcctatttttaactgtcgaccatgttacgttagggaagaccacgcctgccctttagaaagtcagttttagtagcatttatatcatgtccatgtacgccctgctcattggctaattaattaagttccagggcaaaggaagactttgccaacttgcataactatagaacgactcgcagatcgatctacctcccaagagtcactattattattactaattttttttataaagctgacggcgtccatctccatatatacctaaactaacatatgttacaggttgtattcgatctactacgtaccacaccttattttctactatgctcgtccgaccagtataaaatgggggtgatgccaccccagtgttgatgcaacgagaagacagatctaagaaataaattaccaacactcccgatcaatgtctcacaaacccgatcaaaaatgtgcgacgcaccaagattgcgacgccatggcagtgccaccaaaaaatgatgcagaggcatttgatcagcctgatccaaatgatgagaggctgccggaagagaagctcaacaccatggccgtacgcattgcgttcttctacagggtgatgaacggttgtggtgcactggctttcgcatgggccacggtggtgttgctaggtggatacgctaccctcatcaaacagaaggatttctggttcgtgaccatcatcgtcttcatggaagcaacctggtatgtctacatgtgtatatatatatatatatatatatatatatatgcagattaattataaggtcaattttaatttcaagcaatactcgctattccgcaaagttcatagaagggcttccctgtcggttcgtaacaaacagtctctctgctggttttcccactggcaggctgcatggcacggatcaggatcgtctgccttcacggggtaactgcacgagcgtgcagtcagcacacatccaccgtccgagccatccaacggctatcgcgtgacgtgtacccttaaacaaccagcccaggaaagcccacgctcacaagtgatagactgatagcggacacacctctggactccgataacatatgcgttcgttgtcgttatcgccggccgtcgtcgttcacggcggggactgacctgaagctcttcactgggatgcgccgccaccagagccaccgggagctgtagcttcctcgctgtccccttgagcgtcgtgcacgtactccactggtccatcttcttgctaggattggatatgcagcaattggaagcaattcaacatgcttgctgcctgtggaacttggaaaatatggatgccccaagaccaagtagtagcataacacgattacagttacaatgagcagcaagcaaagcttgcgttctgaacttctgattcgatcgactatgcagcaagcaacgtattacgtaaagtacgcattcaatcagctggttttctacggaaacacaacgagaacacctttgtcatgcttgcctccggctgctgctgcgccgctgccgctacagacttgtcctcaacggaagatgggacggcggagattgaacacgacgtacatccgaggagacagcagtgaagcccagctctcgtagcggccaatggtggcgtatgccggtggaaaagcttcaggtcactcggctgacggcagcgcataccggcgtttgagctccgggccactccccaacgcatgcgggtacttcgtcgctgctacttgctgggttttcgtgggcttcgcgatggctggttctgttagctatggcgtgctgcctcgtgagccatcggatggtttggacggtggatgagtgctgaaggcacgcgcgtgcagtcgccccgtgaaggcagacgatcctgatccgcatggcactgatacaacagcgcaagcagtccggtggttgcagtgacctgagtagcaccttaaggtgctgagttcaaatcttcataggagtgaattttagattgggttgttggaggggataattccctaatttaaaaagctgcatatatctatatcttaaaagaattatgtgtcctgagtagcaccttaaggtgctgagttcaaatcttcataggagtgaattttagattggattgttagaggggataatttcctaatttaaaaagctgcatatatctatatcttaaaaaaattatgtggcactgatggtcagggctcataactgccggttctagcactgttcaaaaacacatttgatctcaacattttgcacgaatctcaacattgatctgagggttcacaaagcacgttgttagaattttcatcaacttattgcacgaatctcaacattgatctaaggattcacgaagcgcggtgttagaattttcattgacttttgcacaaatcccgcgctaggggaggggaggggagccggatcccgcactgggggaggccggccagccaccgtcggatccgtgcggtggttggctgccacccgcggaatcccgcgcctccaccatcagagggtgttagtgatatgcccgagaggcaatcatagagatgattgtatcacatactttgtttacatacattactggagaaccccacatctctcccggttcacaaccacctttactcccaggtagcgaacc

SEQ ID NO: 24940 - DNA, 21167 bp, Oryza sativa
  unsure (1)..(21167): unsure at all n locations
aaaggtaaatctttagtcccggttggtatctaaatgatctttactcccggttgatagtaccaaccgggactaaagtggtaatctttagtcccggttggtattatcaaccgggactaaagatcctcggccccctgtcaggcttctgacagaggatgaaccgggactaaagatcatctttagtcctggttgataacaccaaccgggagtaaagatcaatttttttaaccgggactaaaaacaatctttagtcccggttcttattagaaccgggactattgtggaaatcgctcgaccctccaaagatcatttctccagtagtgatatttatccgacattgttccttgaaatagataacttattattggttaatgaatatgtgattctttcatgagactctttatgttatgtgttgctatttctaaaggatccctgatcaaatatcatatgcggaacaaatatgtttagatgatcagcacatgtattaattgatgatcatgtctcatggatcatggtatagagataccaaattaataatgtggacacatgttggtgaacatgttgttggatagacccaacatgagacactacaagagccatatgtgttgtgtcatcggtgatctcatttagtgttggtgttgaattcttagatctgagattatcatgattctcaacatgtgtagtagcttacttagggactgctaaacgctactccgtaattgggtagttataaaagtagttttcgggtatgctatgaaacatgtagtgggatatgaataatcaagatgggatttgcccctcctatggagagatatgtctgggcccctcgatgttgtagattatggaagtgcatggccatgccaaaggtgattgaggagtcaatcacaagttatataatctattaacaggttcgagtgaataattgagctattagaggatggcacatatctagccttgagcttaatcaatattgtgaggcaaaggggtttatacaagtatacactagaggttcagccgatatgatttttatgtatgcccggtgggtcaatacgttctgctgggggccgctattgacacgtggatcgaaaaagggttttcgggttacagctgagtatacatgaacctacagggtcgcacaattaatggcctgaaaataaggggattggatggatatccaatataagcttaattcggataggatccgaatagaagtcatacgggccttggaggcccgagtgatggatcctacatattcgtgaggggtgtgaccggcggaggtattgcatcacgtgagaaaccctagccgtcacttccctccccgagcaaaaccctagccgcgcgcgggtgctagcatatctgcgcgtggcgttccgtccctgtacgtgtggataccggtagaggcgccactggtttgcggtgctgatcggcgtgggagtacggcgaggagaacgcacgaggaggagaaggtcgagccggtgcgatcgactacttcctctacatcgacacgcgctacttcgcgagagttccttcgacttctcagcgtcttcttccgctgcgcagcgcgtcgagtggtaacaatctatgatctaatacttgcatggttcctgatttacgcgatagaaaattttgatttatgctatcgtagcctacgcgtatcctaactgtggggcccaccgtgcgcggtagagcgtggaggacaccgccgcgcgccgtagctcatcccttctgtcgtcgtcgcctacacccactgttgccatcgccgccgccgttgcctacacccgccgctgccgctgtcgctgtcaggagagaggagaggagaggagtgaggccgcgtagaaaggagaggaaaaagaggagaggagagaagagaaagagatagagaggagaggagagaaagaggagaaaatttaaagtgagtaagagggaaaagagggaggggtatttttgcgtgtggaccttttaataggtccgcttgtgaaaataggctcacttttgtgcatggtccatttaagatgtgcgcatgcaaaaatcaatttttccgtgcggtcctcttaaggagccgcacacgaaaatagaggacaattttcacatacgcagccagttataatccgtttgcaatttaaatgggtccctgtacatgaaaatcgttttttagtagtgagtacttcctatgggctggtaatacatgtttttttattacaatatatatagagatatcaataaatatatgattttgttgtagcactttttgagaccaatatacatatatatgtttactatatttgaaaaacaaatatttcagatgttatttatagttaaagtttttaaagttttataatagtgttatccaaaacaataagtattattattaaaaaaataataagtactatgagaaagtaacttgaaaactctcttaacctggctcggcagaaatatcccgaggaaaacgaggtacagcccacaaaaccatagcaaagcaatagcagcccgataggccattcggcctgattcggccacaacctgacagcccacaaggcccacaacagccgagctcaatgtctcaataataaccagaataagtgcagttggactctctcttaacggtcgaatcatattcatatccctaaaccacaagtggatatctccccgagctattgaaaccgatagtgttgacttagtcttcattttacgtggcgtttatgtgacattaaaattaaaagaatatgtgtgacccatttatccgtcaaaaagaatattatagggccacgtatcatcctctcttttaacacttcttcctccttcctctcatctctcccttatctctctttccttttcccttcggccgtggcgagcccctgaataagcgcggtgaagatggcgatgagctggcctgtccactccaagagatagcagctctcgttccattctatgtccgtctcgtcgtagagtggctccggcttctcaataaaactccatgtcatgttgctcgggttgaacatgaacactcgtcgtcgaacgggaacaggagagggttgtgaaaagacagtggaaacggcgggttgtggtcgaagtctttcgctgtccagtcctcgtctccctgacgcctgtcttcaccctcgttgtctcgatgccttgccactcgctggcgcacaccaccattaaattaatcaggggatcccagcacggaggtgaaagatatgctgccgaagaagggccctctcgtcattggcgggagatgcatgatgcgccctttcgttgggtttagcaagaaaacctcgtcgtcgccctcctttccgagaacccacccatgccacgagcaacgatgcgcccgtggctccggctcgtcggagctggtgcagtatcccagctcgtacttcttcccggtcatggggttgaaggtggcgagtaggccgtccgttcttgcataagcccttccgttcgggnnccgcgccatggccgaagggaggagaaagagagagataagggaggaggaagaagggttgaagagagaggatgacatgtgggccacatgttagtgggtttcataaatgggttccacatatgacctttttattctaatgctacatatgcattacgtaggatgaagatcaagttaacactgtcacgtcagtaaaaccgtcgagagagataaatcgcactgacttttataactagagggtcgagatatctgatattgtagataaagatacgaatccgatattgtgggccgccgccagttgcccctctcctacccatgaatcccgtcctcctgcgcctccccgtctttttctcgtccagtgaggctgcgcctgcgcatgccggcgtgagccaccagccgcccgccgcgaggaatcatggccatggagaacgaggacgaggaggaagcacctctctccccggcctccgtgatccgaatcaacgatcaaacacatgaggacgtccttgtcccggcctgctgccgtcggcggcacggagggcaccgtgaactagccatggccacggtcgatgatccgcaaggaccgcaaattgagaagagagttcttttgtatgcgaattcgaatgtactgaaaagtattcaatagatgtttgattaatactctgttcgattcatcttataagtcattagactttttttctagatatacttttttaagtttgactaagataataaaaaaatatagtagtatttttaacgcaaaacaaatatattattaaaactagctgggtggcccgcgcaaatgcgcggctagcacccaaacaaaatcatatatttttttaagtatgattttactttaaatttattaaatagctatctcattgtcttaaaactttgaaagaccaaatcttatcgtccccgtgtttctaattatatagtttttaaaagtcacaccagttgctaccctttttgtcatctcctcctttatttgcttgcacgatctattactatttctattcattctccttggaacatttaaaaattggatcttatagtttttagagtttattgtcacgttgggtttcgtttttataatttctagttgtcccgttaaatgttgccattatactcctctatggcatgttcactatctacggcctgtccactgtctcttctctttattatcattgacatttaaaaagtcgaacataattatcgtttgggttcatttttactttctagaagtcccgccaaaccgtcagcggctttgacattgtacttatctatggctcgcccgctgcctcccttctttattgtcattaagatttaaaatcgaacatgattatcattgtttttttttactttttagaagttccgaacctttaaaaaatggacattgtagtttatagagtttattgtcttgttgggtttcattttttataatttttagaagtcctgtaaaacgatgccactatgctcctatacagcccgtccgccacctactctttattactctttattgtcattgtgattctagaaatcgaacataactatcgttggaatttattttttattttctagaagtctcatcaaccgttggcggctctgcaactatactcctatacacctcgctcgctgcttctcctttttataatcattgagattttaaaaatcgaatatgataatcaatggggttttctttttttactttttagaagtcctggcaaccacctttctcatttgcttcacggcctaccggttatccctcctccttttaatcgtcattaggatctatttggtgttttattaataatttttatatgacgtatcaaccgccaccactctactcttttataggcatgttacttaatttatctcatcatgtgtcttagatagtcttttctttcgatagtctttatttttatcccaaattttagttatttataaattgtattcctaattgaaatcttatttttatttttttagtttcagaatttatttgttttctcaaattttaattaatatcgtattgtgttcttttttttttattttcgatttcagttgtttcaaaatgtattcctacttgaactctcttttaatttttctaattttggatattatattatttttttcttctgaattttaattaatcttgtattgggttcttatatggattcttctttcaatattgcttatttttaattctgaatttcagctaattttaaattgtattcctacttgaactcttcttttttttttctaattttggattttatttttatttttattcctaattttaatgaatctcatattgggttcttatatggactcttcttttaatatttcttatttttaattccgaatttcagctattttaaaattgtattcctacttggactatccttttcttttctaattttagattttattttatttttatttcgaattttgattaatctcgtattgggttcttatatagaaacttttttcaatattgcttatttttaattccgaatttcagctatttttagattgtatttctacttggattctccctttttttttctaattttggattttattttatttttatttcgaattttgattaatctcgtattggtttcttatgtggaaccttctttcaatattgattattttaattccgaatttcagctatttttaagattgtatttctacttggactcttcttttctttttttttctttttctccgtttaatgtggtaatttttagcccccacagtgaacgtggtgccttctttcaaagctgttttaataatataatagaatagataatagatatattcaatgttagatttattgaaactaatttgatattttagatattgccaattttttctataaatttaattaaacttagagaaaaaaaagtcaaacgacttataatataaaacgaagagagtattaatttttataaatataggttaaattaatagttcgtgcaaatccacgagtttttgactagtttagcataatcacatttaacttggcaggtttttcaacacttccaaacccgaggaccaattcttcattggccttcctgaagcaatcatcaaggctgacagaattgctgtacttgggcgcggaagctggcggaggtatagaagcgacgaagagaagcctgacgactacacaaaaatatttttggagttgttttcggccttcatcaatggtcgctcctgcttggcggtcctatatcagaccacccttggatatgcacagctggctgcagtgatcggtaccatggttatcagttcgttgcgcctgaaaaggcaagattatgtcgatccaatctatcaacaaaacgatgaccataagaacatcagatggtccctgaacatcttctatggattggcgctctcccagtgcattgtctatttcctggtttcgatcttggcaaacccgttgaaacggatgctacgagttggcctcacatataagctgggattttggggtgtgctatctcttgctcgctatgttgaggaatgtcttctgaaatgcgtcagtggtgatcttcgtggtgcggtcagcatggatttggttagcttttcaaacgagctgctaagttccgactcaatagagaaccagcttataggatttcgtattgtcgaccaccttctcagaagcaaaatgtacaaacagagggtgctgaagaagattcgagtttccattggcacaattcagatggcagtccacatgctgagcttgaagatagacatggatacagacacaagagggcatgctgcacgcgtattgctggagctcgcgcctgacctccaggtggagagctttcctggtatcctgcctgcaatctcctcactgctcagcacaaacaagggggccacaaacagtgaaagctccagcaacccaatcactgcagtggcggacgcagctttaaaatatagatgggacggagaacggagatgttcactcgataagagcaatcgaacacaacacatatcgtattaatagtttattcgtataagtgtctcaatctgttggatgtttataccttgttatacctaattttgatggtccatgactactataaaagaataaggtggtcttgaaagtgtggggcaacacgagtcgtagctgagtcggtcgacccaccccgcctaatgggtagatccgcccctgaatcactgtgatgaaagagttcaagctgcttggcgtgcagattcttgagaagcttgtggatgatcaggacaactgcacacaagtgaaagatgccaaggatctgattccaaatattattgaactcaccagagaaggcagattggactgtaaacttgactttgaaatagttcatagctcacttaaggccttgctcaagccagggtgtgaaaaaccgccggtaaccgcgcggttaccgcggttaccgtccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattgggaaaagaaaaaaaaatgggccggcccggtactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctggctcaagctggtgaagctggggaggagcttcggcgccaagtgtctggaaatttgcacatcatggaagtcatcaaaaagttgctaactgaccatactgaaagccaacaagctgatctgcttgttcaagtaacaggaatccttgcattcttagcagcggatgatactgcaagaaaggagatcagaaactctcgcctaattgttcggatgctcatctctttcctcgcaggagaaatgaatgttgttcaagatcccatccctagaaagatgatggaaactttagcaactgaagcgttagttttgcttactactcattttaaagaaaagattgtgctcagtattgtgagagaaagcaatgttcaggccatactggcagaaacaatggtggaagacatggaaaatattgttcatgtactctctgatgagtctgcagatcataggataggagtagggaaactcctgcagaatcttagggcctaccaaggagcagaatacactgagttgttcaagataattgataaagcactgccaaaggtatgtttgggtccaagattttatacattgagattgaaattatgatatagatgaagtaattataaatttcttcgatgtaaccagatctttgtactcctactgaaatgaaagccatattacttctgtttaacaaattgcattattgcataaactttatggttcttataaaagctacaatattgtcacaggtactagagacgatcgacctagcagagtcaaaaattgagtcagattcttctgatgatcattcttcacatgtaagaatactataaattctccatttttccatctttttctttttgacgggaaaaacagtaggagaggctcctactgcgctttattaaaagaaaataaatacatgaagagctatacaagaaagagactataagacagggggatagcgttacaacaaagagacaagaattaaactatgttttgaatccatgattgccaaattggtttgtcaacttcctttactctatgcttatgtagagtaaaatcctctttgaaatctgatttccatttgccaaagtttacttgaacaccattaaatatgagatcatttcttctactccagatgttccaacaacagattgcaagggcttccataaagaattttcccatctttatgtagggatctagcaaaaacttttcttcagttgttttaaattgaaagttcacctttaaaagtctcatcgtgctgtggaaacgagatgtatttaaactcgtgggtgcatgtgcaggcgcaagagctaatagattctgcagagggcaaaggcaaactactggagtcctttattgggctcaccgtgcaaatttgcaccaacggggatgaaatggttttcaccgatgcactcaggagtgccaatattacagttgacgagttcgtgctgaagcttaagatgatattaactgtgtacaagtctccaactgctgattttccaggggtaagaagggttgtaattcagcaaatgaattggatgatggaaaagaacccggcgtatattgtggtgtttaagaagcacgaaatggacatcatacttaaagaaacagcagagacggcaacaaagattgaaaattttttgttgttccattcgggtgttggtgcttttgagcatgaagagtccatttctagtattgtgagcaagtcactgggactgattacaggtagttttgcttaaggagccaatagtttggggcatcagcctaattaaagtaagtttgtgatgtgtgtgtgtgacggtgtgtgcgggtgagttatccatgtgattcgaacaaatttagggtattgtatgttatgttattctgcatttcgaataaatgtaaggattgtatatggtgctaatttctgcagacgtgggttcgattgctcgacaattttcttttgtcctctgctttttttttaataatagattttcattaatccgacctctatatccacgaagaatatacaaagccaaaatgatataacacttagactcacacatcaacaagtaggagaacacacaaccaaaaaagaaaaagaaaaccaaacaacgttggtcgacacatccctccttcccgccatattctcatgaaatgaccagatttgacgagtaaaagacatctagtcaccgtcacccctagtgctctgtcaatgcaaacctccataaatgccatctttatccgtttcaggtgagttgacgccacacgccgtcagttagcctactttcaatcatcgtcgttcatcatttagtcagaactagccaaccaaacacgaacagacgggatcgacttccactttgccggattcctaagcctcctctatccaaagtgctcaagccaccaccgtcctggggcgccgctgccccttgggccgccggtgccgacctgaaccgccgccatcctccgccacagcccctagatgtcgacgtctgatatcgcgactacggtatttggatggtatggggatcgttggtaccagggtatatgcgagattgaggtaaaagagatggagacagagatttttataaaggttcaggcccattatattacaggtaatagctctacatcctgttggccgaagccggtgttgctctttattcatctgaatcacacaaatacaatatttgggataacctagagagttgtcgtcgacttagcagttagataaccaactcatagtcaacaacacggtagtcttcctcctcgaatccgtactcgtcgagatcagagataacgctagatccctcttgccagctcccgtaggcaccggatggggtatggctaggctcatctctgatgtcgagatctggcagcatattggcttgtggcttcgtagattgtggtgggtgtctcccctctcctcctagggggcttgtatttatatccatagatgatctcttgtccaagtagaattagggagataaatatggatacgatccgagtagttcttgtcgtttccatatagaactctatttgtccttccttatccggaactccttctatatacgaggttttttccatataagacatggcatgtggtgggctttgccgagcttagtcaattactattaggtgtgtagtatccataaccctgacactagggttgctggcctcggcgggagccgctgccatcccggggctcgcggccccagggccaccggcgccaacgtgaaccgccgccgtttctccgccgcagcccctaggaacgccggtgccgacgggagccaccgccgtcccagggcattgcagctcctagggccgccggcgtcgacgtgagccgctgccgtcctccgccatagcccctagggccgtcagcaccgacgggagctgccgatgcccctagggctgcggccgccgacgggtgctgcagtcgttccgggccaccacctcaacttggtcgccgccgcccccaccacccccgaaggtcctccgtcgccgacgcaacgccactacccgccgttggccgtaggggcagcggttgtaatgacttaaaagtcagctttggcacatgcagcttaggcatatggagcttgatcggttgtgaacagatggacctcacctgctcaccataggcttctcccttcctcacctcaatatagccgcgttggtgaggagctaggagcggacaagatagagattgagagattagggaggtctaaactgaaacaaaagttacattccctagcccaaagtgaaaatattggttgcatcctagtccaaactgaaattttggtaataatacctagcccaagatgtaattcactcctatttttaggattaattggatctatgccattataaattttatgtttttgaaatatgccattactatttacctaattataaccatgccattacaatttcacaaatattggagacatgcactaaatatcatttcaccgtattttataaaaattttggaccaaaatagccatatcttctttcttctttctctgtcttctattccagccaacttaccctgacaagctcatgaagagctgcagcaggctgagggctgccgccgttgccagcagagctggcagggagcacgccgccgggggtctcgccgtttggccgccgccgccgccgcattggattcctccatacatgcgaagagggtggcacgggtacgacggtgctcgccggcggcgagaatatcctctctctctctctctctctcctcggcttccaactcgggtcaagcgcgtgtatcccctcctcctctgttcttgacgatgcctctgaactgtgctgctcgactacgtcttcctgctcgtgggtcttttcttcctccataacagcaccatctttgcttccttgccggttagagcagcaggttgagcttggcagtggaaaaggagatcgatgaacaggagagaagatatatatggagtgagatgggagatggaagaagaagaagaagaaggggtagtttggtcctaaaaaaattagaaaatgcagtgaaaatgtatgtagtggcatagctccaatatttgagaaattgtaatggtatggttacaattaggtaaatagtaatggcatatttcaaaaccataaaatttataatggcatggatccaattaaccctatttatataatgtcaaacgcttacatgatagttcatagctgggttatattcacaaatcttgaacatttgggatgtacattagggtccattgagtacaaatctcgctgcccgtggacctccgccaccgccgttgccaccctagacctttgctgccgtcgcccgtgggaggaccggatttggcctcacccccgcgggcctttgccgccgtcgccacatccgtcctcggcggcgcgcatccgtcgcctcctctggccgccgtcgctcagcccctggtcgcggggaggccagatccaccaccgggggaggcagatccacctccggcgtcgccggatccgccgcaccaaccccccggccgccgcctccggcgccgtgaaccgccgctaccgagcagccccggtgtcccagcgcgctggcttcctcgttggggagagagagggccccgccgccgcagtccttgcggccggctggctttgccgacgagccgcttaggcggcggcaaggcaaaggggaggaggagggagggtaagccggccggccgcaaggactgaggcggaggagaatgaggcgccgtccgtgtcgcccctgggatgggagcgatgcggacgggaaatagtttttaggggaactttcagtatggtgttctcgtaaaatgttcgtagtatagttagttagtcccatgtcatgtggttggtcatgttcctttaaagattgactacatgtaaagagtacaaggccttggttacatatatgaactttggggaataagactacaatggatcaaagatctttggataatataaaaccaattatttaaattttgatatctctactaatttcgtaatgacccaggagcattttatcatggtttatattagtgtccaattgatcattcacaattttattgcattttacgataaatttaactaaatgtgatggcactgattaatattaagtttagaggttcctgtggaagatatcatagttcagctggcctccaacccgtgactccctaacctgtttgcagtccacagaagtggtgttgttgatgctcatatatgctatggaaattgctgcaacaatcgattaaccattttacacgggatagaaatgtaagtggggtaatatgcacatgcatgtccaatcctaccgatttcggaaccagggtcttacacggtcttggtctagtttcctaaacgtaatattgtttgtaatgttgttcattctaaaattgaatcatgacgtggtaataatatacggtacctcattaaaggtttttgtccaaacatgacatgaaaaaaatatttaagtatgttttcatcaagtactactatagcaaaatttcgttaagtgcaactcatcattcgataattctattaaagaaaatctcagacaaattgttttgatacctactttctcacatagtacttcagaaaaaatagcatttaaaaaacacccaccttgtaaacctcttaaaacagttaagacaatatggtctctaaccattaatgtatagaaataattttttcttactctttttcccttttttcaccccatgaaacaaaatttcgtctaataaatgctaagagtcgattaagagccgttgtcatgggtagcaatcatgtttttcttttttcctctctttcttccatgttaccaaatttacttgcatggtaatagagagagtccactaataaagaccgttgtacataccctaagatggattaatcaaatgttttaatatatagcctctttaatacaaaggtttactatgtgatcaaattatcgcaaagctttgtatccaccttttctacttgttttcttgcaatgtgttcataataaattctaaaaatatgaatacatgaaagtagttttcatgatagatctaataatgttgttgtgacttatcacgatttcatattggagtgttttcttagaatagaactcataattaggtacattttatttatcatgacaatcatcgatataatttagttatcaatgtatgtgaagttatgtataatgacataatcaatatatgatgttagaaatggcatgtaaaaggttaggatttgacctaaattgttatattcataatatagatagattaaacttgtagttttcatttctaatataaaagtaaatttattataccataatgaaatttcatgatagtgggaatattttttaatattattggtggcaggctatgaggcccttcgtctggcctattgagtcgggttacaagagcggagcgtggcgaaaagcaacgaaatcaaatggtgcttggtgagataaggcaaagccaaacgaggcatggcaagacatgatgagagacggcgtagccaagcgggatatggcaaagcacgtcgaaacgaggtagagacattaagtaaaatggaattgaactaaaaaagtgaccctacaaacggaacaatacaacagtaatggagtgagatggatagggggtcgcggcaacgatgatttcccgtgacaacttcatcaacaagcctatgctataagtgtgcacaccgcttaacgcactgatgaccccttcgacagtcttcgtggaactgatacaattcgaggttcattgtttatagatttgttgtgagcatcaccggactcgaaaaaaatttaggcatgcaaatctgagtccggctttgcgctcgtggagcaaccttggacataatccaaccgtacaaatgcatgacagcttgtttgctacatcaactgtcaaaatgctttcatttttcacattttgatgtgcgaattttcccgatcaacacaagaatttccagcttttatatttttttctcctaaaattaaagcagggcctccaattagcgtaaagaaaagttgctgtaaagtcaatgctcgcaggtcttctcgtcctcgtcgttctttaagacgttgatcaggtctattagcgcaaccaacccaactgctaaccaacttcacagtacaatggtacctggtacactgctaacactggaaacgagcgtttacatccacccaccatataaaggaaacctttgctcgtattgtgctgcacactggaaaccatggcgattccaattcttcgtcgtatcatcccactgctgatgctcctcctcacactctggccggtgccttcttcctcacttcctgacgagtacagtgacagagaagcactactgcaattcagggcggcgctgtcagtgtcagaccagttgggctcactgagctcatggaatggcagtaccggctccgacttctgccggtggggtggcgtgacatgcagccgccggcatccgggcagggtaacctctttaaatctgagttcattaggtctcgcaggaagcatctctcctgtcattggcaacctcacttttcttcagagcctcgatctcttcaacaacacactctctggagatgtgtacttcaccagtcagctacatcgcctgcactatcttgagttagcatacaacgacttcagtggtgaccttcctgttgggctctgcaactgttccaaccttgtgttcctcagtgtggaggccaatgagctccatggggcgattccgagctgtctgggatcgttgttgcagctgaaagttctttaccttggtgagaataatctcacaggaactgtccctccatcgctcggcaaccttaccatgcttctacaaatagcactctatcagaatcagctggaaggaaccataccagagggcctttccggcttgagatatctgcaatatatccaagcctcgaggaacagcctctctggcacactaccacctctgttcttcaacatatcgtctcttcaataccttggtttcagttcaaacaagctgcacggcagattgccacccgatgcaggaacacgcctaccaaaccttcaagtgctccgtttgggcggcattggcaacaacttctctggaacaatccctgcctccctctctaatgccactgaaatccaagtactgggtcttgctaggaatagctttgaagggaggatacctcctgagataggaaaactgtgcccagtaagtgttcaaatggggagtaacaagctgcaagctaatgatgctggggattgggagttcctgagatatttcacaaactgcacccgacttcaggtgatagatcttagtgacaacacccttgggggaatacttccaagttttattgctaatttatcaaggtcaatccagtggctaagcatggcaaaaaaccaaatctctgggataattcctccaggtattgggagccttaaaggaattgaggacttagaattccaaggtaataatctgtttggtgatattcctggtgatattggcagacttcggaatctgaaggtattgtggctgaacatgaataacatgtcaggaggcattccattttccattggcaatctcacacaacttctgactcttgacttgtcaaacaatcagctaaatggctccattcctaaaagccttggaagcatggagaggttaacaaacctggatttatcctctaacaggctagttgagtctatccctgatgtaatcttcagcctcccttcactgactgattcactgttgctttctgataattatctctctggtgctcttcctccaaaagttggcaacctgaggcgcgcgacaacgctgtctctgtcaagaaacaacttatcaggtaaaataccaacaacacttggcgactgtgcaagtttagtatacttagctctagacagcaaccacttcacagggagcatccctccatcacttggtaatttgagaggcttgagcatcttgaatttgacgagaaacgcactgtccggtagcatcccacaacagctgagcaacattcatggtttgcagcagctatacctggctcataacaacctatcaggaaccattccacaatttcttgagaaatcaagtgccctgatagagctagacctctcctataatcatctcagtggtgaggtgccatcacatggtttgtttgccaacatgagtgggttctcagtactaggaaattatgcgctttgtgggggcattgcagaactgaatttgcctccatgcgaggtcaagccacataagttgcaaaaacagatgctgcttaggattctgcttcttgtctctggaattgttatatgctcatctcttctgtgcgtcgcactctttctgttcaaagggagaaaacaaacggacaggaagaatgctacaagtgaccttatgttgaatgaaaagtatcctagagtttcataccacgaactatttgaagctacagatggttttgcacctgcaaatctaataggagctggaaaatatggatcagtgtacagaggaaatctgtctcttccatctgctgtgaatgttgttgtggctgtcaaagtgttcactcttcagcatgctagttcttcccgaagtttcatggcagaatgtgaggctctgaggaatgtgaaacatcggaacttgatcaagattatcacctgctgctctagtatggattccagaggcaatgacttccgagctctagtgttcgagttcatgcccaagtacagcctggacaggtggctgcacccaagaatccatgagcagacacacaagttgagcattgcccaactgttaaacatcgctgttgatgttgccgatgcaatagaccatcttcacaacaacagttgcccgacagtgattcattgtgatttgaagcctagcaacatcctccttagtgctgactggactgcttatgttgctgactttggacttgcaaagctggttggcgaatccatagaaaaatctggtttgagtgctggggacagcagcactgttgggataagaggaaccataggatatgttgctccaggtagcaccactatttcagtaatcacatttcttgatcaactaatttgtcttgtattctggaccattattttatcatctctctgaaaataataacgacttgtcctcatgtttctattcttgcagaatatggagcaggtgggcaagcatctgttgttggtgatgcctacagctttgggattactctgcttgagatgttcacagggaaggccccaactgataatatgttcagagaaggcttgaccctgcacttacatgctgagatgaccttgcctgaaaaaatatcagaaatcattgacccagcactgttgcacgtggaacagtatgacaccgatgcagagatactaacttgcttatcttctgtaatagaagtcggtgtctcatgttcaaaggaaaacccatcagaaagaatggacatgaaacatgctgctgctaagctgaacaggatcagagaggtaatggaatcctctttgtagaattccttcgcttcctatcataattccagtgttgagaaattatgcagctttatccttgagaatatgtgaaacttggaaaaatgttaacatattgaatagagttatgatattagaggatatcttcagtcagttgttttgctcgcccggtgaccagatgtctctggtattatgtaataaagaaaactctgtatcaaagcactaaaatctttccatccttcagggaaaatacagagagtgtgaccagctatgtaataacaataataggagtataatttacaatacaaatataaattggtttcccattgcttccgacaaatgataaatgtcttaggaaatgcgttatgacacaatcgtaaggtaatgcacttatcaaggaagtttatctggatacacctgttgcagaaaagtttatggatcttaaaagtaaagtgggttatattaggtaaaggaaaatctgtcttagcataaacaaaaagcttgactgaatatcatatagggactagattttaaaatgggtggagggtaaattattgatttaatttaggttatatagccaacttataatagaacttgtatgtgttgttacttaaccgtgccacatgacttcgatgtttttgtgaaggatatataactagaccaacccaatgcttagaagcattgcatttaccatgtaagtgttaatacggtctggagtaacaagttgcaaggctatgtgaaacatgcatatagtgtcaattttggacatgaaatcaaacatggctcctaaagacaaccaaaatttggaacatttctgctcaataaatccttactatccctaggccgctacaggttccatgtagtcatccacgcaaacagccaaacaaggaacatattgcaccgaccaatatgcatggggaaaataatggaaagagcattaggatatgttcatctgataattcaaggggggtttcacccaaatgatatatactcccataaaagcatctgcatctccatgttcctaatctgagttgaaaaaaagaatcatgttgatgcatattgaataaccgaacaaaacaacttcttctcttgcaaaccaactatgaatttatattttagagtgctgatcccataccttgctattcctaagccttctggctcctcggtgcctcctcctcagcacagacaaaccacacaggctttcatccgcatctggatgcagtgaacggcgatgcgcgggcagagtaaaatacatcccggcagggcaagcagctgcatttgttcttcgaggaggaaaatccacaaacaggttgagtgcacaaggatgactagctagctgcagctggcgagaaagaagagaaaaaccagaagatgaagcaacggggacactggcggacgccgagaattccacggcgggctgaacaccgccgccgtggattaacaggggtacgcagcgaggtggtggtttgcggcgacgtcgcggcgaggtcttgctagcccgagtggctgggagaaaatcgcgagagggaatgggctgcgttgtgtcccaaaataacatatacgacatacgcacgggagtatttgtatttatggcgatatatttttcataaaaaattaataggtatttatattgtaatttttaaaaattaaatttataaatttagtgtatttacactgtaaattcaatctatttacattacattgtaagtcccaaaaaaattacgttctaaattaaaatattacattgaaaaaaaaaagcaaaagcatgcaagtgctagacatttgattgcactgtcattgatttcctgaggaaggtgccattaacaaagttaaaagctatcggcaaagatcagatggatacagcgtgcatgagaagaaatcaaacggacagagaaactgactgaggcctagtttagatcaaaattttttttgccaaaaacaacacattaaatatttggac

SEQ ID NO: 24941 - DNA, 8827 bp, Oryza sativa
  unsure (1)..(8827): unsure at all n locations
nnnnnnnnnnnnnnnnnnnnnnnnnnnnnnnnnnnnnnaagcaacggggacactggccggacgccgaggattccacggccggctgaacaccgccgccgtggattaacagggggacgcagcgaggtggtggtttgcggcgacgtcgcggcgaggtcttgctagcccgagtggctgggagaaaatcgcgagagggaatgggctgcgttgtgtcccaaaataacatatacgacatacgcacgggagtatttgtatttatggcgatatatttttcataaaaaattaataggtatttatattgtaatttttaaaaattaaatttataaatttagtgtatttacactgtaaattcaatctatttacattacattgtaagtcccaaaaaaattacgttctaaattaaaatattacattgaaaaaaaaaagcaaaagcatgcaagtgctagacatttgattgcactgtcattgatttcctgaggaaggtgccattaacaaagttaaaagctatcggcaaagatcagatggatacagcgtgcatgagaagaaatcaaacggacagagaaactgactgaggcctagtttagatcaaaattttttttgccaaaaacaacacattaaatatttggacatatgcataggataataaatgtgggaaaaaacaattacacagtttgcatgtaaattgtgagacgaatcgatcttttgagccaaattacgccatgatttgataatgtgatgctacaataaacatttgctaatggcggattaattaggcttaataaattcgtctcgcagtttacaggcggaatatgtaatttggtttattattagtctacgtttaatactttaaatgtgcgtccgtatactttaaaaattttacacccaaagaaaagtaatgctaatccagttgtacaacttttataaataactagagacatgcaacataaatcaatcaaggtgagcttgttcctaaggaatgcagccgttgattaaattcagtcatacgtaagtcggacaactgagtcatatgcatcacaattttcaaaagaaaatacggtccactactacgaaaaccatctttcgtggcggccattttgggtttccgctgacgaaaatcgcagccacaacaaagcaaaggccagtgaaaatgtcgatcttcgctagcggttatttaccgccagccaaaacgcatcttcgttggcgggcaagaaaggaacgcccgccagcaaagagaacccttcgctggcggtagccttaggacggccgccagcgaagacatgtcttttctggcggcggacataacgcagccaccagcaaagaagtatctccgctggcggtagctttaggtcggccgccagcgaagataattctttgctggtggctcacattattttaggccacgtggcacgctaggaaaaataaactaaggcttctgtggatggacaagtggccagacagcgaagatatggaccgtcctagttctgacacgtggcccgccagtgaagatgcaaattttttttaaaaaaaattaaaacattattatatatatattttttcttttgttcgtgtgcgtgtttcagagttcagagtcacacgtggttgatataactaatcgagctatcgatagagtatgttctctttcgcgtatgttagagccacgcattgagtatgaagcagaataatatacatataataatttggaagcacctatatatatatatatatatatatatatatatatatatatatatatatatatatatatatatatatatatatccatgcgaatgcacggaaaatagaggatcaaataacaggttcaataagtgggcttgtcctagccctccattacgatcctctctctcgaatgttatcagttccggtacgtagaccaaataatacaatgcaagcaaaagttcctagattcatggaggtatagaaaaacatataagttatcatgtttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggggatcatcgagaattcgacctgcaggcatgcaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttattaccttcctcgtgtatgtataagaccgaatccattctttttcgaaatcgatttcgaaaaagaactactaatccttaacttttcgaggaatccttcatcagtggttgtgaatgactgactttttcaatcctttcgaccttggttctgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacatcattagtccgattctttgtaggaactacccgtaaaaacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggttggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagactgtagatctctcttggtatatccagacaataggtaggaacataaactgaaacattctggagctacaaagatagttattaaatcgttagcaccacataaaaacattccccctagagtagctgttagtacaaataacagaaactctgttatagccatttctgtacattcaatgtactctacggatagaggaatacataaagttgaacataataaaataagtgtcacgcccggaaattcacaagtaatttccaaacttatttgtgtacaaaatcctcgtccaggaatcagccgaggtacacaaactgacaatttaatatacagattcatcaaattaactaaaacgataagtacttacttaagaggcacttagtcctcaccatgaagaaaactgcagcggaaaaataaaatctagcgaagctccggctccactcccacaggcagctcaactggggtataagccaatcgtcttctccttcgcaacttgtcttcaactgaggttgattgattattgcaagaatgagcatatgacatactcaacaagccacacagcaaatatgcaagtgcacgagaataccaaaggatggcataatataggctcatttgcaaaagcagcatttagcaaaacatttaagagaaataaaacagtggagtaattaatcagaaattttaatcaacactgaacaacacacccatgctgcacaggcccaaccattctgatcaaccatacccagctgtacagatctaatctccaaaccaggaatttaccattccaaaccaggagctaagcaaattattaccaggtataacatccataattattgtgagaggtgtgagactaatcacgaaaaacattgttcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaactggtccttaattgtcatgagcacgactctcaaaaccatgtgctcacaacccaccattatcaagttttagttggcaagtaattaattaaccaatcacgattgtccatcgtgaactatcattaagccatccttaaataatagtgaataataagttatcccaatagtgtgctaatgtttctaagcatggctaagcaattacatctagtatctagttgaaccaatatataaagctcaactagtcaaattataatatcccaaggtatcaaggaatagagtaatcaatgcaaacaggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaacgactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataacttttgcaacttgaaccacattaaactgagttcaaatgaattagttatgaatttttaaagattaaatcggattaaaacacttatatggatttttattgaattatgacgcaataatgaattatttttgaaaaggaaaagaggatttattgcgtcagcggctagggtttcggtagaccgggcgcacggcaacggctcacaagaacggacggccgagatcgatccatccaaaacggacggccgagatccatcggtccacgaccggctcacgggagagggcgacgatgacgtcggcgatgacgtcaccaccgacggcggctcgggcggcgcatgctcgccggcgaacggcggcgcttcggcacgaacggagggcaccaacgggtagagggcgacgcggcgaactcaccggtgaccaaagaagcggcggaggaacaacggacggcgccggcgacgaggtcgaagcggcggaggagatcgggtcgacggcggcgacggtgctccggcggtcttcggcggcggcgaaggggcggacgaggacggcgacgacttggcgatcccgacggtggccttcccgagtgacgacgacgaccggaacgacggcggcgcacggctggagcgacggcggcgacggcggctcgaggttacacggcgctagggcgctacactcgacggcgggcgaaggcgagagaggcggcgggtagaggagagctcgggggtccttttaaaggggctagcgagcggcgacggaggcccacggcgaccggcggcgaaaaggaaagattagggttcgggagggagagaggaatccgattcgacctcgaatccatcgatttccaaaccgaaatagatgatgattctaaaagagaaaaggaagaggagatcgagaggatcatttcccctctatcaattcggccggagatggaaaggagcgaccgaatttggaaggagacggcggcggcttgcgctagggtttcgggtggcggcagccgaaggaagacgacgaacctgacaagaggggcccacctgtcagcggctgagagagagaggagagcggcggctcggcggactgggccggactgggccgaggtagagagagaaaagggttttgggccgactttcggcccaaagccaaaagaagacttttaaaaacctttttcaatttaaattattcatgaaatgatattccattgattaaaaatacttccttagctcaaataaatcccagaaaaatctaggaattatagaattaagcaaagtatttaacaaaattttatctagcccaattttatattgagatttaacaaattaaaattagatcttctcttttaagcttttaaaatcatttctaataattccttttaaacaacaatttataatttaaggatttttaaacaagaaaagctcttaacaaatataattagatcattaatgatcaaataattactgaactgttctttgtatcatttaggaattgagctctgaaaaatccgagaaaatttcagagagttgacttaatcatggagaatttaataaaaattaaatccatccatgctttatatttagtaaattttatttcccacatttagcttcacttgtaaattaaagaacatttaatgtaacttctattattaatttattaaataatttataaatcctgaaacaaaaatcaggatgtgacaataagaaattgaaagatttcgttgaaattgttcgtttggaaatttcctgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctatacatgccaaatcatgaattagtaactgcatccaatctccgaaaagtcccgattatcagagacatttcattactgttctgaatatacaaggcaatgtttcaagactgacattcaatgggaaagaccaacatagttaagttggtaataggtcataggtaaccaaatacatagatagtacttctatatcgttcgtgcagaaaaaagagtatccttagggtactaattagataaaatatattatcccccatacttttagtagaaggttgcatttcatatccggtgagacaagaaaaggcccaatagactgatttagtcttaatagtattagtgttggaagagggcagtcccaaatgaaaaaagccatttctcgatcccaagaatcaagctttcatccttttccgctatcgtcaagacaaaccttaaaaacataccagtaaccataacttatcagtcatcctattgttgatgaatcaaagcgagatcagattgctcttgatgacgagggttgaagaggctttctattgatccacctactttcaactgaacagtagttagttaaggagtgccgggtttgcttgataagggattcttgttttgactgctacattaagggcaacacaactacctctcctgctttcaattgctaaggattcctccttccccattgtcctctcctacccgcctttcccacatccatcaaaaggatgctcgcttgtcaagctatgtgctttctttcctttcaaaactctatgtattcatttgctttcttaccaggcctacccaggaaaggggtatagatagaaggagggatcctccgaccataggtctattgaatcgaaaaaacactattttttatccagcagctgcttttattttctctacgaagagagtggctagctagcttctttgccaacttcgagtgactgtgactactcttactggccgtaactcacagaagaggcaggaagactttttactcaaaattgataagcgatcaaacccttagttgtaacctgcacaccaagaatagatatctatgttagctagcgggggcaggctttcccctggtagtcccgcagcgtcctctgacccgggttgggttaggggaagatccgagcgattgccttcgcggatccaaacgtgctcacaaggcgcacaataagaataagaccaatagagacttcataagggaccatttgagctgcagatcgtaatgctcctagaaaggcatatttcgaatatagaggacgttcccaacaatccacgagaatatcatacccaactatgaaccgtacgagcacatcctctgtcacccccaccgcgcttacggctctataccccaacccaacttgctctggcccttggtcctcccgcatctcttcctcggtaagcggaccgtggaagctggggggtatccgcttgggactgatagagaacagcatatcttttttgtccctcctgacccctaaaaaaaatatagttgaagtccggtcgacgttgttatccttatatattctgtcaaagaaagtccctcgcgtaaattgctttgaataggtaaatcaatcatttgtccttgaggatccgccattaatcctcgcatacctactaattggtgtacctgagatgcatttcctctagctcctgaaaaagacattagatagactggattagaaggatctgttatccgaaaattcga

SEQ ID NO: 24942 - DNA, 4469 bp, Oryza sativa
  unsure (1)..(4469): unsure at all n locations
ctgctaataagtccgcctttttcatcttccgtaggggcctttagtcttttgattagagtagaggtcgcgacagagcagagcgtaccgccctgccatagtcgcgaggatcttaatagtcggtcgcgactgttgtcatagtcaacgacggttgaaacttccaggaaaaaacttcgaattgggagggcgatcctcccggtgagctgaccgtannnnnnnnnnnnnnnnnnnnnnnnnnnnnnnnnnnnnnnnnnnnnnnnnnnnnccatgtcgaaggaactcggcgggctttgtgtaaatggcttcatgttggtatggggtattaccctattttactcaaaatactgtgtccaaaagcctgctgcttatggtactgctagtctgttatgtacaagtatcttaccgacgaaaaatgagagataacatgctttttttccaaattttttttctaatgtgcatagatcgtaaggggataacagaggagatgctgaggaaagtgttggggattggaatggagtttttcaagttgcctaggatttagagtccaacgcgcaaagctaaagaggatttcaagtcccccgcccgccagaacctaaagattgctttatttatatacgatttattgagttaactaaaaagctggttcattccatagagatcagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatcttgaggctattatgcgcaagcttggtttccaccaggtcgaaaaggtgatgaaatgtgtgacgtcggtctctttttcggtgcttttcaatggtggccaactggagaagttgaagccaacgagaggcatccgtcaaggtgaccctatctccccatagtaagccagccaatagtaccctaacttaagaagttctcttagctagcgcatgtccattaatgtgaccaccgcatgcacctgaaaacaatattcaactccatgccttcaagagcataaatgggtaacagccagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccacactttatcccgtcaacatgcttaaacttgaaaagcttcaatgcagaaaaagtttcaagcaatgtagattattgatctaatctgtaacaccttatttacttgtaatctcatacacatgttcatgtgcattttcaagggcagaaagaatatccttaaagggtcatctcgcaatctttttctaggggatagtcaccacagatgctcagcagatccaacatcgtattgcaacatataagacactcagtgtttacagtatgataataatggatattgtttcattccaatatgacataagaaaatgattcatacttactttaatggattagctaggaccctctgtcctattgtcacaaagctggtctcctggttcgacataaaccatgcaagtgacgacacactacaatccagcattctcagaaattagttgctgatttgggaactaaggtgaagaaaatgcaatgataactgcaaagttttcaacctaccttcccgccaagcgggagaaggggcgaagcgagaactcaggaatgaatgaaccaagaagggttcaagacaaaagaattctactcaggatgttgatcttctgaccacgaaactgagcaagaagtccatccgatagtgggggagatcaaaaagtacttttttatgggcttgccctggcgcacaaccactccaatccgcctgggtcttctcgaatgtgtagaacctactttaaaacccgcgtcctcgctgaggagtgcctacgtactttcttcatagaagaaagatcagggttgctttcgtagttctttcgaaatgatttacggtcattcttctttattttattgaatacattacagctagtacccgggaaaaggaatacaactgagcaagataattggattgaaccagatgccgtaaagagtcaaagtaaaatccattagcgcccagaggcagagcaaagagattcggagatagaagagagtgggaccacttcgaagtcaacgggttaaacatagtgcgagttagacagatcccacggagagtctatctcttcactctagattttaacatctaatgcaattcgttgcacacacgaagggaataatataatgaagaagagtgagaatagttgtgaatcaatgagttgatcactaaaaagaagaaaagggaataatataatgaagataactgtcactttaccgggccggaaaagtgacaccgtcacgtctcagagttgtatgcctggaacaagaagggtcgtcgtacaatttcggcgattcaaaaaaagaaggaggcgagctccctatccctctttggggtgcagacaggttcgtcgggggttatgcaagcttcagaggtggggggtacgattgtggaagatcgcgtggaggcaggggttggagatgtgatgcaaggatgcggggaattgggtggaaggacagtcgttaatgtggagtcaggtttgacgggcgtgaggcaagaagtggagggaagtgggatctagattagaagagataaatacgatattcctgatctgatacccgctgacgatccctagcctagcttggcaatcccttgaaaatgcaatgcataggcgtcctcggattggcccgggggatcgaattgattatagaaacatgagtttaattaatcgatttattagtaaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaattggaacttaagttccgattgttgatgttttattcgaaagggccaagttgcattggaatcgagaatgtttcattcataattgcataaaaggagtaaaaatagtggctggggcgcgtcgagggtcaaccttgatatcgaataacctttcgagcctgccccaatggatctctatcctcctttgaaaccaatagaagttcactgaccatccctgttaaacataacccaaggtaggatcgagaggagaagaataggactcttgctagtatcataaccgggagaatgaaaccattagattagtggaaagaagttcgaatgggaaggacatgaccccggatggcatacgtgggcgggcagggggccccactacttcttcattcaggggggctagcctcatgacttcccactgggcgaggggtgcgaaccaagtcatgagcgatagcgaagccgcctataggcgtcgaaggatgaaagtccgttagacctccaagccatagcaacctcttggggaaattacgagcaccgcattgcaaatgcgcgagatcaaagaaatcacaaaccaagcataagtggatagcaacttatactatggaggcagagtctcctcccctcatttctggctgcttattcgtcatcacaaagcaacccggtaccttttcttatgcgagcgactgagacgagagctttcaattatgccgttttggtcaaatcctagggctctttctgatttgattaaatacttctatcatttagatagagagtgaacaagaatagtagtcacagcgagggatgcacataaataagatctgcactggtataagtgataggttttgggtaagctcgctcatatcgaaagaagaattcaaaggaaatgaagcataagctgtcaccactaggagtaggacttggatgttccggaatcctcttgccgagctggaacgacccatctcctatttcagcttccaacgcctacacgttgagtctgagttactcgagaaagacttattcatagtggagatagtcaacctccacgggggctccccggccggggaggcaaaggggattgctatcgtcaccctttctcccggtgtatgtgaaagagaaaaagtgacgaactttttttcttttcggtctgcggggtccaaagaacgagagtcagcttccttaagtccgttcttcctcag

SEQ ID NO: 24943 - DNA, 5058 bp, Oryza sativa
acttggggagatttgattcatcagaattcgaattgatagttatagcttttctgactagcgacccctgttgtccttctctttttttttctaaagacgcagcagaatcgtcaaacgggaaatcaaaagtgggaagttgattgtaggatttctattcctcactctcgttagacggagagtaagcgacttctattagcaccggaccgtcgagtcgaattgatcgtgtcatgtgcaacgtccatcaatggtggttcattaatgtccatagatttagactccttccccctcccttatatgcaaaagatcgagaggggcccaaaccaaaccgagaacgtaaacagaattcgactcactctcgtatggctcgccctcgagccctgggccctatcgaacaaatagaggaaaggacagaaaggggaaaaagtaaagtctaagcgacatatggcacgaaaaggaaatccaatttcggtaagacttgatctgaattgtagttcagatccaagtcggtttagtgagggcgaccgcgaaagtcaccgaatgggttcgacgcctggtccagttagacagggattcgttctccggtagggctaagactccttcgttgtcgaaaaatcacccaagctgatgtgcgcactcacggtggatgaagtagcacatgtccgcctgaatgttgtgaatggaagtatcatcgagctgtttttcagacttggggaattttggaagctgcatcagatcatgacagaattaaggaaattaattattcacaacaatacaagttagcgactaatttaacaagtatttacttacctcgtcgtaattcgcacaatatttcccattaacccttaggaactcacaacattaatatccgcataatactattcccaccggttgcttgtgacactttcaacatcaaaataattataaggtatattaggttattaaatgggaacacacaagcatttatgaaaattaagtagtactgtttggcatccatatgtacttatcggccacttattgcagacgaatatgcgttctcttgagtttttgcgttgtccgcctcgctagtaataccttttaaatgcactgtttgcagatataattaatttacattcgtcagagattaaaacacgtcatgctaatatcttacttacagatcgtgaattcttagaaattcctgataggtgttgctatctttgtcgagggaatccaagacgatgacttcattgtactttagatagagaagaaagactatccaatggtcactgcaaacgaaattgttaatcgagccatgattatatgtatatactcttagtgcatatatattacaacttactcaaaggcatatggggcataaacacactacttgtcctgcgtagattcaagcgcaatagctacgtacgtagcgacatcgagcaccttttcatgatgcctttgtgctacgtaagctttcctctattcgggagtcatcgccttgatgtgttctggtagcttcttctcgtctagcgtgtatgtgtggttcggcttacttatcctgcacgggtttaggtaggcgacaggctttttcatcgcttcggcttccacgtaattcatcctgccaacaatggatatcaaatgagctacgcatataggtgtagtgatctattaacatgttcaagtgtagcacttacagacaccagatggcaatcaaattggcgtctagccttttcctatgatagagggaatgcatatcggagaaatggacttggagtagacaaggaccgctccagaagatgttctcccccacggcatctgtgaatgaatcgatgcctttcatggtgcttgccctaatgtaccaatcgtgccaccttgttagttgccacggtccttctcttagttgccagtcgtaaatgaatggtttgccattctcaaactagtgtggcacgtctggggaattgatatagttgagatagtcatcaaaggtctgcttgaacccttttaattttcagatatcaaattcggtatttacgatatctttgtcccttcctcggaatgctgttaccatataatgtttcttggacgcactttttgctttgtgcttgtgcgtccttaccatcactggcacatcggcacccttaggttcctctggttgcgatggctctggttgcgattgctctggttggtcgggcattggttgctcaggcaccgcttctatttcacccgccactagctttgtaggctctgcttgtacaggctgtgatggttgtgcgggagacatttcccgtattgctagctgtgattgtttctttgcaagcaccaattgttcttttgcatcctttttagtccgagctgatgcaacgggaggctctggtctaggaggtgatgcaactggtggctctggtcctagaggtgatgcaactggtggctctggtctagggggtgaagtaataggactatccctcggactggctacgactggtggacgcgactgtgacaccggtatccttggtggacgatcaattccatccgttgaccctagttcaatatcattcttgtgccatagtatgaattggtcgacggcatctccaaggtacacaatctgctcagtagttggaaagtcgagctcgtgtatccggtaagcctcaatgaccgtccggacctctaccttgacgtagtcatccggaatgtcttggcaatgaaacctgtggcctggtatgaacctcccagttgcaacgagtattttctttcccgccctgccgaccggaatcaagagcttgcatagagtatcctccgttacatcatcgaaaggatagctcagctcaggctctaaaacagcagcaccgtgcatcattttctaactccaatatatattgcattcgtcacaagctgctgccctagcctaagagtcaatctcttccttgtagcgatcacgcttcttgtaggtatgagcatcctgtttgaatccatccttccagctagtctttgaggaaactccccatacacggccagagtgctccggtttgccgaaggcataggttagctcgtcccgatctctatctggcacgaacgtcccggcctattgctgcgtgacgatgttcttcatcttgacagctacctcccggagcttctgatccttgaatactacatcccccttaggggtgaaggccggtgttcttgcacgcacccagttcctgcttcgtgggttgtgatttttcataggaaccggtttcccagccttctccatctcttcatcttgttttgcccatttcttcactgcttaccggtaaccggtcgatcccaaatgatgtggatattcattccttcttgctagctcagccatcttctggctcttctccttttcttccgccgatgtcttaagggcaacaaactcatcccactgggcctgtgttatccttccgtagtccttaaacggcgtgagtcccttctggacatatttcttattcaggtctgttttctagtttcaccacagcttccccattgtcttcaacgcataatccttggctttattgtcgtctgtcccctctggatattcaaacttgctttgcagcaacgtccaacagctgttctttctactctctggaactttctttcaatccttccatgtgatctccatgatatcccagaccaccgccccacattggttgctatacttcgaacatgagtcttccggtgacaggggttcccctgtctcactcatccgcgtcagcacgcttacttccttcaacaacatgttcttccctcgctcgcccctccttttcttaggtttgcttgaagctgttgtgtgcacgacagttgtagcttcagcttcaggttcagttgcggcttgggctttccttttggagcgacgtggagcattcaactattgtttgcaagtcaagtgactttaattaaaatccatagttcgcagttaatatgattggaactaaacaaatattatatgctacgtaccaccggttcggggggaacgtagtcggagtcaacttcattgtcgctactgccctttctcttctttgtaggagaaggatgggggtcactcggcgagtgatacgatccactgcttgattcacttgagctagacgacgaagattcctccgcgattacttgcgtgcaaatatcttcctccatgactagctgagtttccttgcccttgtcacccgtgggttgctcttgggtgggtttgtccattgatatcgcttgaaggtgaattcatgttagttgcgaaatgtaattattttcttattgtaaatccgaaaagaaggcaaaatttagatactaattttgtactacaactataaatattgttaccaatcaatgagattggtaacgacatcaatattacaatccaccaacgctgaccatttcaaactacctaattaagttccttaattatcaatgaatgacataatacaaaatgcatggagaattatggtgtctaggtcggttccgtccatggattacactgaccaatccaccataattccccatgcattttgtattctgtgatggtttgataacctaggaactacattaaatctgcggccaatctatcaattcttccatttgaactaaatttcaaaccctaaacctaattaagttccttaattatcaaagaatgatagaatacaaaatgcatggagaattttggtgtctaggttggttccatccatggactacactgaacaatccaccaaaattccccatgcattttgtattctgtgatggtttgataacctcggaactacattaaatctgcgaccaatctattaattattccatttgaactaaatttcaaaccctaaacctaattaagttccttaattatcaaagaatgacagaatacaaaatgcatggagaattttggtgtctaggtcagttccatccatggactacactgatcaatccaccaaaattccccatgcattttgtattctgtgatggtttgataacctcggaactacatttaatctgcggccaatctatcaattcttccaattgaactaaatttcaaaccctaaacctaattaagttccttaattatcaaagaattacagaatacaaaatgca

SEQ ID NO: 24944 - DNA, 993 bp, Oryza sativa
  unsure (1)..(993): unsure at all n locations
caaaattcnccatgcattttgtattctgtgatggtttgaaaccctcggaactacatttaatctgcggccaatctatcaattcttcaagttgaactaatttcaaaccctaaacctaattaagttccttattatcaaagaattacagaatacaaatgcatggagaattttggtgtctaggtcggttctgtccatggactacactgaccaatccaccaaaattccccatgcattttgtattctgtgatggtttgataacctcggaactacattaaatctgtggccaatctatcaattcttccatttgaactaaatttcaaaccctaaacctaattaagttccttaattatcaaagaatgatagaatacaaaatgcatggagaattttggtgtctaggtcggttccgtccatggactacactgaccaatccaccaaaattccctatgcattttgtattctgtaatggtttgataacctcggaactacattaaatctgtggccaatctatcaattcatccatttgaactaaatttcaaaccctaaaccatatatatagccatacatcatttcattgcaaaaccatatatatagccatacatcactggatttcagaatttaaatcacacttgcagcaatgtgaatttatatggaaaaaagagcacgattatatatatgcagttttagtgcatcagtcaaacaaaacagctaataaaatatatacaaattcatccatccatcattgtcacgcattataatacattaaaattcatcgatacgtccaacatgatatacatatataatgaattagcatataacacttttccctacaccttcatttctcatgtatggcttcggtgattcaccaattgattcttcgacgcgtaatatcttgtttcgaaaatctgtgaatagtgtcatgttctcgtattgattgtatgcctcgacatcttcgacatcatcaacttccaaaatcctttgttttcccgaaataactat

SEQ ID NO: 24945 - DNA, 812 bp, Oryza sativa
gattgcttctactcgaacgccactgttttggcatgcactcattttgtctttcgcttttgtgtaaaacgtgtatccatttagatcatatgcttgccacgaggtatacacacttgatggcccatcagccagcattttgattgttcttttttccatggtatggccatctggtagatcgaggttcttgaaccattcagtaaagtgatgcttgtgtttcttcatgatccatgcattagatcgccccacatttgttgcttgtaattcatgcaggtgttgctctatgtacggctccactattgcgagttgctgcagcacagtgaaatgagcatctttcacttttttgtagtcattgtcgtggattattttcttcccttttgttcctttcccagataatctaccttcatgtcgagataccggtaaaccaattgctttcccatctttttggtaatcaatgcaacactcaacgacctcctcggttgtgtatccctctatcatggatccctctgggtaggcgcggttccgtacgtaaccttttagaatggacatgtatcgttcgaaaggccacatctgatgcaggtacaggggcccaagtgcaattatctgaggcacgatatgaactatgaggtgttgcatcatatccaaaaatgatggagggaaacacatctcaagctcgcacactgtctgtatagtgaaagcctggagaggacataactctttaggatcaattactttctgagatatggaattgaagaaataacacagcttagtgatgaccagctttacgtgaactggttcgactgctctagttgcaatgg

SEQ ID NO: 24946 - DNA, 657 bp, Oryza sativa
ttcaaaatatttaaactaactaaagttgtattatttttccgcaattaattaattaatgcatagatggcggacagggcatggatgaataaagagagatatcgtgcgtcgtacattgaaggagttgacatattcatgaaagcagctaagaagaatgctgcatctaagaagaccaaagatattagatgtccatgcgtgcactgcaaaaatcagaaaagttggaacgatccatctgtaatcgagcaacacttggtgacgcatggatttgttgaacgctacacaaactggtcacatcatggagagatcccaagcaagcaggttacgaaccaggctacagtacgcgacgaagtgttgagctgggacgaggatgtcattgtagtagctgaagaagaagaggaagtgtatgcagtagaacccgttgatgatgatgatgttgttgatggtggcaatggtcagcacaatacagttgatgatgccgatgatggtaatgtcagcgtagataatggtaattttgcagatttggaagagatgttgcgtcatgctaaacctgaggttgttgctgggtccgctcgtgggttggataactttgatgcattgtaaaaggcagcgaatgatcttttgtacgatgaggcacagggctgtgagaaggatttcacattg

SEQ ID NO: 24947 - DNA, 1883 bp, Oryza sativa
  unsure (1)..(1883): unsure at all n locations
gcaatcagcgccgcatgctgctcctcctccgtctcccgcatgacggagtccagcgcctggatttcggctagttgggtctggcgcattttgcgccctaacctcaccatatcgtccacggcgcggcacccctcgtcaactcgcgcgtggttcgcagcgagttgtgcccactctgcgtccacagccgttcgctctttcgctagggcttggacttggacgttgagcccctcccgaacagtggagtcggcggcggcgagcacctgcagaagtggctccatactcgccggagtcggagaagaaaaagccacggtccgcccccgggacgacggggtactgctggatcccctgcgagactagggactgtctcggccccccttctgcgagaccagccccgagggcgccccaagcgcaagggggagcggctgtccctctcgccccctgcttcgggtcctcgagtagattcagcctcggccttgggctcgggaccgcccctagcctcggcctcgacctcgggcccggtatgtgtcctgtgggtcccaccgcgaggctgcgaagaccccgcggccttggattggccgggcccggaccactccgatcgttcggatttcgtcccccgcgaagggtccgaccctgagactccatgagaaagaatctcgctacaagagaacccagatcgcgttaacaaagaaaaaaaaaaggagggaacaagaggccgagctgggaaagagcaccgaagtgggtgccagcaatcgtacctgtggggagggcggttgaaagtccacttcgggggctcgatgaagctccctcggcacggctctgtttgccctatcttccggagccgtttcttcttccgtccgacctcgggcccggcaggtcgcttgtggcccgctggcggacgatctatcgcgcgctcggcgccccctccacgcgggggagagggcggccgagattcgggcaccttccgcttcccctttgggtcgccggccgagtcgtctccgggcccgcggctcgggccgggcgcccttgagccgccaccaccgcctagaccacttgtccggcttctgcccggggtcgcgccggcaccacccgcgccgacggtgctaccactggcgctgcctcggctgggctggctcctaccggcaccgacaaccgacatcacagccaagatgctctcccagtcgcggtcgcagcagagggggaggatcccatctgggattagcgtttgctcggcggagtccaggcccagcacccgccggatcaccatcttcgcgtcctcctcccccctgtcccagcgctcgcccacatgcatgcgcatggggtcgttgggaccagtgtattcccacgcgccacgggatcgttcctggagaggtgcgatgcggcggcgaaagtaaacgccaaagaccattgcccccgtgaggcccaggcttcgtaggcccctgaggcgatcccacaccgtgtcgtattcctcgcccagctccgaaaccgccagccatgcggcggatctttcaggaggaccagcaggaactcgaagtcgcgggtggtctggcaatgcggtgtagaaccagtctgtaacataccaaaaattaaccattttctaattctgtatcatgctgagtcttatgttcttaataacttcctaaacctaggaaaatataattagagggaccttttaaaactatcttgcataaaatatctttctggtatttaacttcttttgtgtttttcatttaaaatacatgtggttgaattgaggtatttcttgctttggtttaaaaccttcttttgactaaaatttctttattcaaaattagtttgaaaannnnnnnnnnnnnnnnnnnnnnnnnnnnnnnnnnnnnnnnnnnnnnnnnnnnnnnnnnnnnnnnnnn

SEQ ID NO: 24948 - DNA, 10757 bp, Oryza sativa
tcccacgcgccacgggatcgtttcctggagaggtgcgatgcggcggcgaaagtaaacgccaaagaccattgcccccgtgaggcccaggcttcgtaggcccctgaggcgatcccacaccgtgtcgtattcctcgccaagctccgaaaccgccagccatgcggcggatctttcaggaggaccagcaggaactcgaagtcgcgggtggtctggcaatgcggtgtagaaccagtctgtaacataccaaaaattaaccattttctaattctgtatcatgctgagtcttatgttcttaataacttcctaaacctaggaaaatataattagagggaccttttaaaactatcttgcataaaatatctttctggtatttaacttcttttgtgtttttcatttaaaatacatgtggttgaattgaggtatttcttgctttggtttaaaaccttcttttgactaaaatttctttattcaaaattagtttgaaaaccctttctattttttttatggattatggtccaagaaatcctccaattttgcccttgaacctaaaccaaagtaattccaatctcattggaattaattgttagcccatcctttgatcttaaacccatcctttgattctcgatccaaatatccaaattcctccttttgatttagccaccaatttaatttctgtggcttgattttctcttcggcacaagaatagtattatttcaaaaattgtgaatatttactcttgtgctaagaaaagtccaatttatattcttcactcaacttccccttttagccacaaatatacatcacaccaattttagagttcaaatcctatttattatcttcaactaattcccttctatattcccaaaaatatttgaggaatattattaatttcccttcctatttgagtgcttccaaataaattccctcaaactccacctctaaatattgcactcaaataaattaggaaatctcttttgtgaattctttccgaattcgaatcctttgcaaaacctagttatccaaatcaagtattcaaattagacttcctttctttttgtcatcgggccgaaactccattctttcttccttttggtccaatcccttttcttttctattttcctcctatttcttgggctgccggcccagctaagccgagccggcccaaaccagcccacccacccagccgagccgcctcctcctcccgtgcgcgtgccgtgcacagcgcacgccgccgccaacgccttccctcgctgcgaagtaatcggccgccgtcattcttttcttcacgctaccgtcgtcgtgcactccttgacctcctcctccacaaccgcctctctccaccgacgtccgccgcctataaatagccggccatccctcctctttttcatacaactctctctctctctctctctctctctctctcttgccatgcccggccgtcgccgtcgtcggtcgatctcctcccctatagcttccctcctagtttccttgcaacatcggcttcgcctcgctccggcgagcccatttttcctgtttcccccttctcccccaccccatagcaaccaccactgccacctctctttgccgccgaagacaagctcttgactgcgccgttccggccaactccttcactctctccaacagccaccgccctccccgggtgtgtcttgctcgggaacatgtgtggccgctgacgtcgccgccttccaaccgccggaaaaccggcgcccactctctccctctcctctgtaaccggcaggaagaaggagaagaagagaggaagaagaagacgagagaaggagagagaaaaagaaaagaaaaaggaaaagcattgacaggtgggcccctatacagtgtcttttcgtattttctagatttaattcaaatcccaatctttagaagcccatatctcctaaaccatatatccgattccagtgaaacttggacctaaattcatctaaattcaaactcttcattttgataccaaattttctattttaagattttatttgaatttccttaatttattcaaatactatttgaataaatatttgattaaatcttataattgaatttacaacttaaatttatatttgcttttcaaatattttcttttattccaaattacccctttagccactaaaaagccgccggttggaactttacgccttccatggggacgttcgcggtttactatccccgacgtcggaccgttggttgtaaagcccggcaaaaaccaaacctaaggtcgaagtgctgctcctggcaccctacgccttgatgcgtatagcggtcggagcttcactattccctcgacctccacagcacgccgcacagttagctcttgggctctgtgtgatcctagccgctccgccgccactcacggttgtaagagtaacacttccgccccactaaacccacacaaacttcctatccctctagccgttatgctatctgttgacaccggctagagaagataccaattctagtcgttatactgcccaactctagcaacgactagcaaacacccaaatcccagccgatattcatcctacctcgatatcggctgcttaatcaaatgaaaccccagccagcctgctatccaaactccataccaaccatttacccttctactacccatagcctatgcatgaaatacgagccgatatgctatcctatttcagcatcgactcgagaacaactaaatcctagccattcttctaccaaagcccaacctcgaccaatgctagccacatatccacttaaccagttagattattcggtatatcccctattctccaagaaaccaaaaaccacacataaaatataagtgacaattgttacttaatcccctctagcctccaacccttcagaacctacacatattagcccagtaatccctacaccttataaaggagataggttataccctaaaccctagcccttttagttgtttatcgttttcttgttattttatggattttattgaaattggttcttcctctttcttagtagagtctattttggatggcagcctgtgatatttcgagaatcggataatcaggttgcctatctcggatttatttgcgttggagcaaggcaagttattattcctccccttgaacataattaccctatattctatatttctattctatgcattagccattcatgattttgaatgcataacctaaacatatagcaaaccagatatgctaacttttgctcagccctgcctagttagactgcataaaaatataatgaatttagattgggacagtacgtaagatttggttgatttccgggtggctagtactgtctcagtagatataagtttaccaaatacttatgtcaaacgaacgagtacgaccgcagcttctagaatggggacagacctagatattatgttaattaacaatgtggtacctctgtacagtggttccttttgtaagtcctcgcgcaggaggcaatcttatgccgagcagggcatcttatgatatttaccgaggcgcaggtaaatatactaattttcgctcatgagctgtgtgtgattttatggaaacctggttgagatgacatggggtctctcatccagttctctctaaaaaccccgggaacgccagaactcctctcgccgctgataacattacgttcagagcgcatggggagtagagttcatggaataggtgccactattgttaataacctaatactgggccatgactaagctaatgaatattggcaagtcgtggactgtgggtaaagcgtacatctactgcagtagaatatttatgaaactattcgaatagccgtgctcacgaatttgagcatcgggactcatatggtatttggttagaaacttaattccagattttattaaatactgttgcatcaaacacattgcaggatttctccttctatattctctgctttctgcaagtaatcatagctctactcaaatactactaattcatacattcatattgaatataatagcttgctgagtacattgtactcacccttgcttcaacccccttttcatagtcattttggagttcttatcgaagccgggaattcaatcacataagttagttccctttaaacctagtcttgaaatctagtattgttagatggtttaactctatagcaaaacattagagttgatttattctatagcttatgctatattagttagccacaagtttgtaaatacccatgtatcttataataatatctcctctagagccttgttcaaatgtatgcaatgaagatccagattgttgaacctgtatcaatctactggtccagggcttgatacagtctaaacatgtcggtttccgaatcattaattttgggacccgacacagtccttcttccaatcctcccatttcttgcggagatgactctcgatgtactgccccgccgtgcctggtcgcggctggaagtagcatccccccaccaccgcaccttgcagcagctgcgggatgaagaaggcttggaacagctgcatcgtcggccgtaccccgatgaacatctcgcacagatgcgcaaagatggccagcgtcatcactgcgttgggtgcgagatgcaaggcatggatttcgtagaaatccagaacctcatggaagaatctggagaacggcggaatcaagccgccatggcgaaggacaacaggtgcacggatcgctccggatatcgcggccacgattcccccgccctcacaacggcgccatccggcatgatcttgcgggggaggctaaggtgcctatctaccgtaatgcgggaagaagggagcactgtgtcgccagcatcttgagccatggtggccggcggagcagtggcggagagcgcaccgcgcggaacagtgtgaagtggcgagaatgttagggttcgaggagcgagaggacgagtgggcggttggcgaaaggaaggaggcgaagtccctgcctccgcccccttttatcctcgtctcatccgcgctcacctcctcgtttcacgccctcatcattgcccccacgatcctcgcgcccgcagttgtctcttcgtttgccgcgcccactcatcacgttgcccgttgtatccgtgtcccgcctttagtgcgcctgtcagtggcacactcgaggtggaatacgcaacggccatgagcgcgagctgagcgaaccgtcaccactaccgccgcgggagtagcgggcgagggaatcgaggtgtggtctggccgaccccccggttatcgcgcctcaagcatcctcatcattagcgcggtcagtggtggtcaaaccgctgctatggttggcacgccaacccggctgctaggcaactttcctttcgattccccgacgggcccacaaccccagcttgagaagtcgtgaggcaccatgtcagaccgatctcaggaagccaatgtctgatatggtgccgggggctactatcggagatatgggcccgggggtatgtgaagtaaaggggagttaccttcccgtccagccacgtggcccggcaagctggccccacttacgcacctcgcgagtcgcgaaagcggcggggggggggggggggcctcggggcgcaacgtcgccccctcgggctctcccgttgcttcccccgagaggcccttgcccggctgccacgtggcagggggagagagtgagagggggacgcaggttgaacagccataaatgtgcggcgccccaactgtccctcactgcatttaatgcggtaagggcagacgtgtggtgcgcctaaccgacccctgtcaatcggatgtgaccagtctgtgaccggcctgttgccggtcatgtccggttgaacgggcggccgtgcccccacgtcgcctctgtctccggcggagtgggggtaggtatgacccgtcacgtcatagcgtcactcgaaggagggctgccacaagtcttcactcttttatgagggaatgacagggctgtcccctgtgtcaggcgggggacggcgctgggacccactcaaggaccggttgctgcttagcttccgggggaaggcacggattgaggcccggtcaaagtggagcggggtccccctcccatggaggggtaggtataggcggtgcatgtggtatccccttgagctataaaaggaggaccttgcccaccgagacaagaggacgactatcagaaaacttgaactctaggagaaggaaagcgagagcgctctccagagtaaaggatcctttgtaaaactcatccataatcccaaacataggagtagggtgttacgctccatagcagcccgaacctgtataatccgattgtgtgcaagctagccggtagtcttaggggcgaacacgtgttttccaagaggcgagcctcagcccccggccgaactcacgaaaggggggtcttgcgactccccgccatcgaggatcttccctcgacaagactctattccaagcagcaaaatgtttccttttgtaagaaatatcataccctctccaaagacagtttcttcttgcagagtcaatggccaaaataactgtttttggcagttgcaaagagcacataaagtatgtgggtattgcagataagacagaattgatgagaattagccttctctcataatgtaaaaaagtagcactagaagttaatcttcttttaattctatccgccaaaggtgcaaaatctatcactttgggcctagtagttcccataagaagacctaagtatgtgaaagggagagttccaactttatagtctaaaaggctagacaacagctcaatcttatcttcagcaacattaagaggataaacattagacttatggaaattaattttaagtctagtagattgagcaaaggtattcaacaaagctttaacacaaaagaattccttctgatctgccttcagcaagataatggtatcatctgcatactgaataactggaaaatcactttcatcatcaggcctaataggtttagttataacccccaatctgcaggcctcattcaaaatagcctgaagaagctcagctcctaaaacaaaaattaaaggagacaatggatcaccttgccttactcccagtttacacttgaatccattgctaggtactccattgagtaacacaactgaactggcagaactaaagatcatttcaacccaatttaaccatttagcgggaaagcccatatgtctcataatatcaaggattgcaccatgctcaatggaattaaaggctttttcaaaatcaatttttatgataacaatctttcttttagattgttgacactgatgaatatattcgaaggcccaagctaaatagtcctgaattgtcctacccttgataaaaccatattgattctcatggaccaatttagttataactccctgcaacctattagccaatgccttagtcagaagtttgagacttatattcatcagagaaatcagtctaaaatcattcacaacctctggattattcttctttggaaccaaagtaatgaaggaagaatctatggactgaatatcaacacagccttcataaaaatgtgccataagcctgtagaaatcttctgcaactataggccagcatcttttcataaagaagctattaaaaccatctggtccaggggccttacaaacaggcatccttttaaccaaatcatcaatttcctgagtgaaaaaaaggatgaactagagagtctaggtttgttatcctctgaaatagactaggaagattgaaagccattttggcatcagtggtagtacccatttcgtctttaaaagacatgtaaaacttgctttttctttatgagaagtgactatattacccataccatctgaaatactagaaattgagttcattctatatctctcagtagccatggcatcgaaaaatttagtattctcctcccccaaaaccatccatttatttgtacatctctttttccagtacttcctcctgtgagccaataacttaagaatgtgcctttgaattatttctctcaaattccattctgacaagatcaaaactctatattcttcaatcaggtccatgaagtgaatcactctacagctgttttctatcaacttattgaggagcaaaagatttttactccatttggaaagggccttatacgagatgcattttgcaagatctttaaaaccaggatcaatcgaccaaatagaagccactctttcaaagaaaccatcaacatcaacccaataattctcaaaacggaaaatattacacttcgggatttttgttttgatcttaacaacacaagggacatggtcataaattactcttggcaaaggaatgactgttgtattaggataagaagagtccaatttggagaggtaaagaatcaatccagttgttccaaaaggggatattgttgcatattactccaagtaaaggctcttcctttaatagggagttctaaaactttaatagggagttctaaaagacccagagtgtttatgatatcatttaaaataaaaatatcattcatatcagctcccattttatttctattttcaattgatctatagaaattaaattaaagtcaccaaggaaaagctagacatcatcctgatccatctggaagtttcttaaccaagatacaaaattatccctctcctgtccactacaaggaccataaacacaagcaagaaaccaagtttccttgttctgggtggagacaaattttaccaaaagagcatgatcagtgcttgaatgaatatcacccttaaaaaacttactaatccaagcaacaagaatgcctccaaaagcccctctggaagggacaaaaagaaaactatctaacttactaatccaagcaacaagaatgcctccagaagcccctctggaagggacaaaaagaaaactatcaaaaatttttggcaaaactttcttcagaaactccttatctataacctctcttttcgtttcctgtaaacacacaacctggctattactgtcagacacaggctgtctaagagcatcccatttttcaacagcatttcaacctctaatattctagcagagcacattccaatcacgacagctgctgtcagccataacatactgcatataacgaataaaaagttataaacggagtttgcctgataaagattgggccacagaacttcattacaaataaaataactgagtgaatatatcaagttcagactgcaagcaagcaaaagataaggacttgtcctacaaaggtttaaccaaaacaactaacatgaccaaactagacaagaattaaaattattctgcatcttcagaaggtcttgcgagttccttcagcttttctccttcaagctttgacttagccacatcctcaagatgaaggccgcacatctctgttcccatcttttgcaataaagaaacagaacattcagcgcataccagtgatagcttagagaccgagagctaagttgacaagggaagaaatgggctcgctgtgcttaacaattccaacaccatagtagaatatcttaaacatttcaagcctttcttctgttccagctacttctttcagcgccttatccatttcacactgaaagaaaacttcattgcagtggctactgcattgcttcatccaaatgattagttctactgcgactcgccttatccctgggaactcgatggctggtgacttgtataaatctaggatctttctaagcttctgcatgaccatgtacactgtaacattggcactccggagagcttcattgaaatcgcttgcgtgaatggatgtgcagatctgaacactgagcccaacaaagctctctagtagtgcaccctgcttggtcctccattcttggaaattctgtgtttatatacaccaccaagaatatatttagagagagaattaataactgataaaagatatatgattttggagaaatgtgtgatttggaggataactttcttacattagcatgttctccagcatacagtacaggatcctctagcttctccacttctgactttattgctttcagcagctgtagatgatgacagcacaagcattagaattatagaatttaacactgtaaggacactataaaacttttagaaaataataaccggacattaccgttggtagtgcagtgttgattattgtcttctgaagatgagcatgctctgctctggagttggcgtgtaaaatgcccgaaagttttgcaacgttcgttttgaacccagtagagtcagcagagagcatctcgacaagtttctgcatgtcttgaggcttcagttcttcttggatcttccagacaatgctttgattatccattgcaagcataactagtgcttcagcattaggttttgctagctgtcttctatcagctgaaatttcagaaatcatctgtgaccttggaacaaggaaagagacaagcttcctaataatttgtggagaggatgcaatctcttccctcccggtctcatccaatgctaaacaagcaagaactccaatggcttcaacaagtagctttacttggcttctagggtgttgtagtatcttgctaatgttcctgagtacatagacattgtcagagactttgcacctaagcactctcccagaatcaccagcagcgctaactagcttgtgcaacacttgaactgcctccaaaatgatctcttcgtctctgactgcagatgatgagactatgctcaagctgcgatcatcaccagtaacagctgtgaggttcacaatgcttgcaatcacctggccatcagcatccgcgaccttgttgcagttgtccggattgtccatgatcttgt

SEQ ID NO: 24949 - DNA, 3133 bp, Oryza sativa
  unsure (1)..(3133): unsure at all n locations
gctgtagatgatgcagcacaagcattagattatagantttacnctgtaggacactataaacttttagaaaataataaccggacattaccgttggtagtgcagtgttgattattgtcttctgaagatgagcatgctctgctctggagttggcgtgtaaaatgcccgaaagttttgcaacgttcgttttgaacccagtagagtcagcagagagcatctcgacaagtttctgcatgtcttgaggcttcagttcttcttggatcttccagacaatgctttgattatccattgcaagcataactagtgcttcagcattaggttttgctagctgtcttctatcagctgaaatttcagaaatcatctgtgaccttggaacaaggaaagagacaagcttcctaataatttgtggagaggatgcaatctcttccctcccggtctcatccaatgctaaacaagcaagaactccaatggcttcaacaagtagctttacttggcttctagggtgttgtagtatcttgctaatgttcctgagtacatagacattgtcagagactttgcacctaagcactctcccagaatcaccagcagcgctaactagcttgtgcaacacctgaactgctccaaaatgatctcttcgtctctgactgcagatgatgagactatgctcaagctgcgatcatcaccagtaacagctgtgaggttcacaatgcttgcaatcacctggccatcagcatccgcgaccttgttgcagttgtccggattgtccatgatcttgttgaggattttcacaccgaaccaggtgaactccatgctcacagtcacatcgttgccagagttgtcagcagcaacgatcaacgatgacacgatcggcagcattgctgggaagctctcaaggagaaggtcccgagagagctccaagatgacgcctgcagcatgccctctggtattcacttccttccgggtgttgttcgtcagtcctagcatgctgaccacgccgccgaccgtgtcggcagaagctcggagcctcatgagcgccagcgctctgtacttgggcactctaaggatgctgtcaagaacaccgaccccgacgaggcgatccgcgatggagttggatcgcaccagctccatggcgaagctaaccaggtccatgttcatggcttcgcggacgttaccaccggagcatctcaggtaggtgacaagcatgtaatggctcaccatctgcttccccaagggcccgagctggtacgcctccgtgatcttgagcaccagctgaatgtcggcgacggtgaacatggcttgggctagcaagtcggaggcgccctgtacgagcaccaggccgtagaagaggttgagtgaacccttgatgctcttgtggtcgctgctgccctggtccgccggatcaacatagtcttgcttgctcaggcgcagcgcggcgaggacgacggaggcgacggcggcggagtacagcacgagcgcgaagcccatcagcaggagcttggcgaggaagaagccgcagctgcagcgcttggcgtagtatgacgcgaccttggctctcaagccttgtgctgtcacagacgacgacgacacctgccggttgatgcttatgtgtctttgccagcttccattctccatagcctcaaatctttcggtctctgccgccaccacttcaggagcattgaggatgaactgatcccttggatccacggcactgctgaaaagcctgccatttgaaagtgggattgcaaagttgggggcccccaaaaaggtntagntgaggatccgtttaattcaccccggccttcttgttttgtacaaggcactatatgcgagagttgaagaaaggaagggacatgtgttgagttaatctcgttgtttatgttttcatcatgttcagtcaagtcctgtatggcggtctgagttcaaattggttagtgttttgtatggtgaggtgagctgatcagccgttagtgaaagcacaaaataagcacaaagtggaattttttttgaaattatactgttgaagtttttttttctcaaaaatatatgagattcaaacggttttacatgaatagaccgtcgtcgcagttcagcagtacgaactattaggaaaccgccggcccatgaaggcccggcccggttacccactaattaggcccatcactaaatatggaaagtgctcatggctatgcctatatatagaggggaggaggtgctattgtattggacaagtgaatgaatgaaagaaaagagtcctacccctacatctctatgtctccaattcttgtaaacattacgggaccctcttgaactacttcgtgtagcaggagggttgcgtaatacgttatcagcatgacgttttaccgaagaccaaggaagaaaaagggtaagaactcgcagatccgttttgcatctcgccgatctaatcgcgaaaacgaattcctctctttctctttgttcttgttccgtttttgccgttctcgacgaaatccaccacagccgacttggagtcgccggtgtatgccgattggtggaaaccgcgattgacaatacacggcgtttgcatgctgacgaagcgccatggcggcgaacccgcgccatggccgctagcctgcgcatgcaacaccacggccgcaccctgcaagggcagcgtgcctgcgtgccatggaggcactggccggagaggacttcaaggatgaagaaagaaccaagaaaagaaggaaaaattgaaaaaaaaaagagaaaaggccacgccggccgcaccgctgaggcttgcgacggcgacagcggtgcccgtagaggtcgcgactgcgccgtctatacaaaaacggcggcacccgcgccgccctcgccgtcgacgcacgggcgagcatccccggcccacgactgcactgcgccgcgcctcgccatcgaacggcggcgcgcgcacaatcttggcatggccgcatcttgtgccaagcccgcgccctgcaaacgcatcgttaggccaccactgccgaccggcttgcgcctcgccgagccggccgagcccgcaccaagtaccgtcggtgccacaccgcttgcggctcgccctgaggacgagccgcatggcctcaccccaccgtcgcacggttgcaccgcgccggtttcacccgcgccg

SEQ ID NO: 24950 - DNA, 3846 bp, Oryza sativa
cctgcgcgacgccgccgccgacccagcgcgccgcgcccgcgcgaggctcgctggacagccgccgcgccgcccactgcccgcttgccatgcatggcaagggagcaatcaaaggaagaagaaaggaaagagaaaaaaaaaacaaggaagcagcaaacagctatggccgccggcgcagcctggccgcctcgccgccgcgcatggccgcctcggcgccggcaccgcctagaagccgcgcttggcagcctggacgctgcgcatggccgcctcgccgtcgtgctgccttgacgcctggccgccccgccgagcaggaaagattcccctgtgattttgcaaaaaggcccttgctgtttttggaaattaagcgcatgatcctctgcattggaatctttgcgtcttaaaccctgaactttctagaaagcacgcaaataaccctctgcatttgggatatttgtttcaatggcatcaagaatttgcaaatatcaccgaaatcatattctcgcataaaccccttgggcctgtttggtatagctccaactcttaaatataactccaggagttgagtctggagtggagttgtggagctgcctaaacccaactccacaactctagtacattttgtgagagagctccacccaactccactcctagttttggtggagctgaaactgtttggctgagctccagctccaggaggggtggagctggagctggagctgtgccaaacaggccctctgaatttttgacctcgacctcgcatttcaggtacctttattgctgatatatatgattatgaaatttaattatcgcatttacgattattgattatttgtgatgcttttattacttttaattaataccgttgtgataaaatgtatagaattgcatagaatatattggaattatttgcgggaatcttgtgaaccattatattgcaacagttgtgcatttttacctgaatctaattttgcgcatatatagaaaaatgacgtgcatcgcgaattagaaaatttgccgaatcttgaatatctctgatatatttattcaatgccgaaattacaatagagcaagacgctctatggtaccattaatccaatcacgctataggcattgactcgatgagtttgatctagcatttcaaactctcgccagtgcctccaagctactctcatgaatgagtacgctaaacgcatgagcgcgttagcatttagaggattatggtatataccttatctttcgtagagcaagaactataagcaagaatgggtatttttcgactatgattcaccaagcagatgacccagagagagtatggtaatatgatgcatcgcatttgcattgaataccgctgaaactcttaatgttctacccgaacgtgacgaaagttgcatgcaagtatcactagtacacatacaagaagtatgcctaactagttgataattgaattgcgtaatgttcaggatagtgttcactagaaaaaattgtcttccaaaaccaactagcacagttgatggcgagttcaacacgagtagctagcttggtgcacttacctcaacgaaagaggaggaaaatgggggagtagaacacaggtcaaggtgaaacaatctagaactatgaacattaaaggaaaaggacaatcctaatagcacgctcatcatgaattgagggggaaagctcctagcctatttgcatggctatggacgaagaatctcctatgctatatcggatcagccctaaaattgatgtcaggataataaataattgccatagctgtcgagcaagaagctcgctacgaagttaattgaatccgaagtaccggaatacctcgttgaatcaatatacttcgtcatcacttgttgcaattgtgaaatagaatattggattgaataaatgatctttgcccatgtagagcacacattttccccgcaataaagaattatttccagtataaaatagcatatttaaggcatttactattttgttgctctcttatagcacatagttacaatgctttgaattttgtgtaccacccaaacataaaagaaaaaaatgaattgtggtccgcgtaaccacaaataacactttaagagaaggaggtatttccagaccctatagaactggaaatattatgaccgttgctagcagcaacaactgaatttgtcggcttagaatgtaccacagtcatattacctgtggaacaattgtgcactttatagaagcatctattgtccgtcaaccccattgaactctctaaaaagtgtgatgatttgggctacaccctcttagcaatggattttcagccatttttggtcttagaattataggcataaatattacaactcgtatggtcatagcacatatatgcataattttcctaaatcatgaagatttgtgtgccagtatgcaccgacaggagatcaatgcataaaccgcatattgttctagcatccctaaactggattgcgaagaatatatgtggcttccatttggtactgtatggataaacgcgcttccgaagcagcaaacatcaagtgtctcttagacaccgtgtctgccaagactgatctagcaagatcatgtgaactccaatagaactcactaaatgatcttcagaagtccgcgaggacaatgcttgcattgcatttgatgattggtgaattggccgcacgaagtaccaaatatccgcataagcggactaagtataagctatgaattgcaatttttgctatatcattgttgtagtactcgcagtagaaaaggacatgtagtcctgaaagcagcagactctggaagcaaattcagaccatcggcatgaacatccatcctgcaactagtgctattgcatctgtttggtttatgtgcatatcccactatcataatacgttgcaaaaggctctctccgaaagtcggaaaccttttacggagatagttgtgaagcctaaattccttgacaaataagaattatttccaatcatttagggggaaagaatgtacccttagataggaaatgtcaggaaatgtgatagtccgggactaatgcatgttacaccacactagtgaatgcagtttgcataaagaattaaaactgccaaatcactttgtaaatacttttgtgatttcgaagattttgactaagttgcatgaacgaaatgcaccggaggagggtgataccaaagaaagtaaaggtacccctcgtcttatctagaggcctcgaacaaaaagaattggacaagaaactccggctcctcatgcccctaaagtaagcggagacgtctggtgaaatcagggcaagagggactatcatactcaaagtcacgaaaggtacctcaccgaatagaaggggagctagttgagatctggcaaacagtatggaacctcagaataggcgtaccgcaccttcccatgaaggaagaaaactagctgttggagtgcacattaacgctggtacatacccacatcaagaaatattaagcaaagaagaagaagcatatgaaaatgcatctccttgtatatgcatggatattcgcatacagtctcatgcaaccaatagaagttggcaatgagatcgattatgggcaatgtctcctttagacaacaaaactcaatggcagtcaaccaggagttgaataaatgaattagaagttgaaaagaagaactcaacctgaatattaacaagcattgaagatagaatcaatgaatgcatttcaggagtttggatcggacacttgcataatagtacatgaagaagtactaggtcccgaaccaacatagaaagaataaaccagaaaagaatcgaagaagcaaactcgttcgtgtgaatttgagtttaattttgaaatatttggctga

SEQ ID NO: 24951 - DNA, 9358 bp, Oryza sativa
  unsure (1)..(9358): unsure at all n locations
nnnnnnnnnnnnnnnnnnnnnnnnnnnnnnnnnnnnnnnnnnnnnnnnnnnnnnnnnnnnnnnnnnnagaaataaaatgttatggttggatttattttttttattaaattttctatattaattacactctttgaaattttgttagaatttacatagcttaattgctaattttgataattagaaacatcatttcagcatttatttaaatggaaatcaaaataaaaatcattttatctctatgggccattttcagcccattttcttcttcagcccgcaagcgaccaaagttcaattattatccccatactcctctcacttttagcctgcaagcgaccaaagtttaattgttatccccatactcctctcacttgctgaactgccggcccacgtgtggctcaagtggtgcggcccatcgctcgatcgatttgagccgttcattttgatagacggctcagatctgttccaaattgatgaaaaccctaaccctaaccctcccctccccctccccgtccccctagccggtcacctcctccgcccccgacgccgcctctcctcctccccctcaccccactggcaccgctccttctcttcccctctctcgcctgtctcaccggcacggcgctgcgacgacggggtgcggcgaagacggccgttcctccccctctccctctccccatcggcctcgacagccgtcccttcctccctctcggcgaaggcgccctcccaaaggcggcatcttcggcaacgatggcatcggcggcgtccgcgctccctcggcgacaaccgtccctatgatggcgtcgacggcgacgacagcgtttgcggtgtctgcgggtggatccatcagcggtggcggcgaccgcgggcggatccagcggcggcggctccctccgccgcctctcttctccctccagtggcagtggtggcgttggcggccaccatttttttttcaatttttccatcgctattactaaccaattcggattgtgaacggacgaaaacacggaggaaaattggatgtgacgaaaggaaaaatacgaatatttatattagttaagattaatttttgaattcacaggtacaaagtttgtatgaacaaaaatatctacttataaagtatgtatgcataaactattttatgtataattttttggggttgggcaaacacgccattgaatttatccaacagttatatgtaaaatttttatgtgcaaaatttatatgtacaaaatgtctatttatcaagtttatatgtataaagtgttgtgtattactaactttctatacgtataaatcatgtgtgtattttttttggacgccagattttttttttgccaaaaatcgggcgttgtttcactaagtaggtcgaaaatgtttcactaaatagataaaaaaatgtctcaatcttttaaaaagctgaaacacaaccaaatcaccccatgaaacatttgatacaacgtatgaaacaacggtttccacaaaatcggacggtttttcaccctatataaaaagaatgtttcagtaaatagcgaaagaatgtttcaattcttaaaaaaaagtaaaacacgatcagatcgctagatgaaataatttggttcaacgtatgtaacaaacgatttaaagccattgcaacacttaaaccccgtgtacattaacaaaccacgtattcatcatgatgaaataattaaacaatatcaaaaatccactacatcatttgcccatatatagtgaaacatcacgagtacactagctgaaacattgttggtggaacaaaaaaaataaaacggatcccccataatagggcgtttccgttatatccgggcggttgttgcaatggggcgcacgtggtggggacacatggtgggcgcgggcgcacgtgttgggggtacgtgggtggcgggcggtgcgggcgcccgattttttttccccatcagacgccgacgcgtaggatttgcgattttgtttggctaggcctatgttgcttgagaaaacgctccccaactcaatccccccgcaccccctaccatccttggccccgggcatatggtaatttttttttacttccgatctcaccccaacattaataaattataagaaacttatagtcgtaaaatattaaactgtatttgaattatattcgaaatgacaaacctggcagcttccatgaaggagatgatggtgacgaaccagaaatccttctgttttatgagggtggagaatccaccgagcaggacgatggtggcccaagcgagtgccaacgccccgaagctgctgatcaacttgtcgatgaacacccagcgcagtatcatccagttcagcttcgcctctggcagcccaagtacttctgcagctacattggtagtggtgctagcagcagttgcatgatccatggccttccctagctgctgcttcaaccacacccgccttaactaattcttgcctgtgtgtgtgtttgtttgtgccgatgtttctctccctgcatgcctacgtgtgtcctgattaaaaccatgccatccatccatgactttataacaagaattattccacaagaccggcaacactcaaagacgatcacttttactttgagtcttactactagctagtgttcccctaaaacggatgatactgttatcttggcaaaatgggcatgcaacatgtaattacgtgcagagaagatacttaaaaattataaggaagaatgtggacatgaaagtctgaaaaattcatgacctgatttgcaggtgaggaatgataaagtaagaggatgcccaacagatatcctatcctattcccaatcccataattttagatttatggggcgaaaatacggagaatgcttgtaatcgaccgtccgaacaagacaggaaaatcggacaccatgccgatgcttcccacgttggagtatctgcaatcaactaactgctaatttcaaccatgcatatgcatgtgtcaattttcaaaatattttttctcctagactacttatccgatctaaaatccgattgcaccattatattcattggaattaaatctttatagcaagatattacatgattatattccgattaaagaaaaacatatgttttaaaccattaatactttatgtttcatacgttatagcaacatgtttcagcatctatttttattgtgtttcataaaattcacggaaatacttgccactaccctcctatctctctccacctcatacatgcatgcatgtatgcatttttgcgagctttaaaatattttttctcatgaactaattatccaaactatgatctgatcacaccgttgtattcgttgtaattaaatttttacaacaagatatcacatgattatattttgataaaagaaaaacatatgtttcaatccgttaatactagttgtttcatatgtggtagcgacatgtttcaacgtgtatcttcattatgtttcataaaatttttaaatgtttcaattgctgattttttgtttcaccatatataatttgatgtttcacttaatggtcaactaggaacatttgaccaaccttttttttaggacatgagacgtcaaatgggaagattcctcatgattgtggagtaaaaaatgaagtgcagcaacatgcacatgcacacacgctcagggtttggatgggcgtccggtatttggtgggatatcggacgtccgagccgtagcgctctccggaaaatactgttcgcaatccctagtgggtccaacactagagagtcctcattcctaatccatggatgagtgcgagggatcgtctgtagggacgggtgatcgggagtattggaaaatcatatttcttttttatagggcccattttttagttttaggaaatccatttaagcatctattggaaagctgaatattcagacctcaaattttgtctaggacttaaaaacaaaattttaaggatatattttttggatatctcttagtgatgctttaaatcagttcagagatgagaaacagatactttcttattaaattttgtttcattgtgtgatatattccacaactatttaccacaaaattgaatgtggcacggtgcttaaaaatcaaattgcatggaacctttcggtgtactaagatgtagaatatctatggaaatcaatagttttacaagaaatttcatagcagtttaaggggaaaaaaataatccaagcgttgagaaaaatttctaatttttttattagccctacaatattcttgttagtacacatctagctgccttaaaatcttaacatcacaacatctgaacattgaacaagtgtatttatcagcctaggtgatttccaaaaaagaaaaataaattagaaatttttaatcatttcaaaggaagtattagaatgtattttatagtgtaaattttggtactcgatacaaatgaggtactataggaggtataacaaattagccctagaagctacagtgcatattatatcttaagaggaagcataaaattaatttagagacaatcttacatgacaaaaaagaactaaaggtgtactgcatgtttggccttttgcaaaagactggattaagggccaagccacatttaattcagttactgcgaagatacttgaaaagaaagcaggtgaccattaaaaatctgaaattcacgcaccactaaaaaaatcgttttctcaggcagccaaaaatcagcccagtcacccgcctgcgaaaattttctcgacgaaaaaaaaatcgccgccaccccaactcgcgcccctacccacctccgaccggatctagggttagggttctaagagggagagggtaatgaaggggaggtgaggggagccgcacggctgctgcaggggcgccgccgccgtcgggggtgggtgccgccgcttccaccgccctccccctccctccggctggatctgggagggaggggaaccgctgccaccaccaccgccctccccctcccccttcggccggatctgggagcgaggggaggggagccgtgcttggggtggatgccgccacccccgcgtgtcgccatcgtcggatctcgccacccccgctaccgaactgcccacgaccgcggagcgccgccgcctcccttccctagcacgaccgctgaggtggataggtgagctaaagaagaggggaggagacttagaaaaaaatctgatctctcccgcgtctatttatatgccacgccaatttttgcaggcagacaacgatctcgtcccacggttgtcattttctcatgcggtcatttagcttcaagatgcctatccatctagaaaaaaaactgctttcgtgcaggggagtgtacaactccacgatcgtgaaatagccaatcagccatgaacagaacggagaaatgatagaacattttgctatccgatacgcgtgtgctctgaagtaacgaatatacgtagctgtaaaatgattaaattgcattatggatataaaagaccgaaatatccgcatttactcacatgtgcacagtccacccggaggacatgattcagaaataatgcagggggttatttgacatgtaacattatcattatttactgatattgtagttacatcagataaaaggaaaacgatacaggtatcaacacaaaactaaaaaaaaatatcatcactttatcaagtcccaatgtaattaattttcacttgatctacttccgatatatttattctctatttttataaacccggatgcaataattacttgaaaataaatttattttatgacaatcaggagaaaacaaatgaactcccaaaagattaagggaagtatctttgaaaattcacggagatcgaagtttcatgcgactgatgtggtagtcttgccaatgtgatcaacaatgtgataaaaatttcacaagcgacacctcaattgataaaaaacgtaccatacgtataaggtggtgtttggttcggatgtggtaacgtaaacgctaatggtattgcctccagccgtaacggataccaatttatccgattacatgattagtttggttgcaggcggtaacgtcatttatttacattactgcgtttggttgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaatttcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatgtagattgtcatggttcaagcaaataaagctgaagtactgaaactaaacatccttaggacataggtagtctccaatccccaaggcctatgcttatatggaattctaataattcaaaaacagataatgaacatcttgtagatcatgcttgacagccagcacatcagtacatcaatttttctttgcctcatctgataacaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttccagttgcatttgcaacactacaagattgatcaagtgaattaccagcaagtattttcagtacgtactccctcctgagagactccggaagagcgagaagcatactcatttgagccggcacttttacaaaagcagctgcagcattgacaacttcagtaccagtcaatccaagcttttgacactcaagaatagcttcgttctgaattttttgtagtgggtcctcctcagccattgccttctcttggatctcagcttcacgttgcatagatgccaccattgctcccacatgctttgtaacatccctcagatcaccttgaacattggcaaagacatccataaaagggtcacttgacaaggtatttttcagtttgttgctgtctttcttcctcttcttagagcttgaagcagttgaatcgatgctctgtcgaggtgtggctgaatcgatgctccgtcgagctgcagctgaatcgatgctccgccgaggcatttctctagacactctctcttcatcctcctcatcttcttcatcttgaatatcttgaacaatttctttctccatattagcaacagcctcaccaagaccctctgcaccttctccagtagcaatgtgtttaccataaattgcagctagtgtatcatagtgagggaatgctacaccatatagaccctttgcctcattgtttttctgtaaaatacaaagaatgacacaaaattaaggtcatggttcagcaagcaaaagagagacctatgcagctacaattgcatgaaaaacacaagagaacatatgtatgagaaagcatactactagaaaaccataatgttgtctttgcaaacatttcagaggaattttacatagccgcttatttggaacaaaatttcataaaatatcttacagtagtttcacatatttcaattcaatgcactcatgaatcaataaataaattttctactccatagttagtttgatgacttaccctgcaatgatcatcgttttgttgtttctcacattgtatcatctttctattgtcatcccaagaaaagccacttttggttagcatcacttcaattgcgccaaacttggtcctaaagtgtcttactctcgactctatgtgcggaacagcagtaaggccagaacttggcaacttcttagcaagcacgttctctagaacttggcagtatccatttttgaaacccccttctgattttcagcttggatccaaagcaatctcgaacaatgccttgatcagctcctcatcctcaaagtacatccaaatcctcttgttcttgcctctcccacgcacaatgcttgagcttccaagatgctccataactgcaatattagaaattcaacagaaaactaacatcagtaagcatccataattgtaccaacatttttttatttctgatttgcaaacaattagaaattccatttaaaacacaaacctcaatgagccctatagctattatacatcccatgagcaagagtgttgcgaaaatttgtccaatcatcagatgtcgaaatagctgagataaactcaggttcggcgagttctccctcaagtatatccaatggtatctcgtcctcatcctcatcctcgtcctcatcctcaaatggatcactagacatcttttgcaaaattaagttgtgcaataaagcacatgccattataattcgacactgagttttgataggaaaatatgatggggacctcaaaatcgcccaacgaccctttagtcttccaaaagacctctctacaatatttctagcacttgcatgcctcatgttaaagtactcctctgcactacgtggtgggttacgtgctgtgaaacggcctaaatgatatctttggcctcggtaaggggctaaaaaaccatctgcgtttgtataaccagcatccacaaggtaatagcaacctttaaaattttaaaaaagaaatgtcagtacaattcaggctgtggagtgtcaaacttcaaaataaattgattggaaaaagactcgccttgagggacacgaagcccgtccggcctgtgaattgcatcacgaaggacacgaccatcatgtgcagaaccctaccaaccaggtagtaagtaaatgaactgcatatcgggtgcacaaacacctaatacatttgtaacaatgtctccttttcttgacctatatcttccttttatcctagttgggacagttacttttatgtgtgtaccatccaatgcacttaggcaattctacaatccagaacaccacatcaataaaatatgg

SEQ ID NO: 24952 - DNA, 1620 bp, Oryza sativa
aacacctaatacatttgtaacaatgtctccctttcttgacctatatcttccttttatcctagttgggacagttacttttatgtgtgtaccatccaatgcacctaggcaattctacaatccagaacaccacatcaataaaatatggtacaattaatagtgctgagatgtgattttttttaaaggaaatgtgatttattttttagaatgggttaccttgaaatatttccatctatcgtcggtggtgtcctcaggtataggttctggcttcttaagtagaagttgatgaagcctcagaacagcaagtaggcataaattgaaatgcctactcacagtctctccacttcggtaaaaaaactttcctattgttctattctttaaatggtgagatagtatatataagaatgaagctactgattcctccaacggcatatttcttgtatcctcaatacctccgacgtctctaagcatgtcacatagaatgtgaaatgtcctcctgtccattcggagctcgcttatacaagcaatatcactctcacgaataagctggaatagtctttcactcctaagttctctagttctgatcctcctctctattttccaacattttctcttatatgaaattaaaaacagtacaacaacatgataatacataagtatgacagcaatcatcatatttctaagccctaaatttcttctctgcgttttggtacttaagggaaggcgagccatagcactctacaaatatataaaacaaaagcattaaccatgtccagaatatatcctgctagcacgcataatacatcaagctaccactaaaataaacacagtacatattttttttattgctaaacctaagtgatttgctagaacacaatatcaagcatccattcagggatatttacatgtatctgttgttttacacaaaactttttttccaatcttacattgtggaaaatgatatatcacctggcagtaaaagaaatcaaaattctaaaaatctagatagtaaaaatgagttggtcaaacttccctacactcaaaaaaaatattcactaatattcaactttcctgcaatctgggaaaatatattctacataaccatgtgaacttatgaagaaaacatgtatgaggcaggatgaatacatgagattcactagtataagctacttcatgatttgttaatgaaaagattatcacaggatcatcactcatcagcattcacaatttataaagagaggtggtttcagtagggggagggttctcaccggcgaggtgattgatagatgacagcaacgacggaagtccgatgtggttgatggcaccagccccctgcttcacagcctcgcccttgttcccggagttcttccggtcaagatccacatcggaagacggcggtggtggaggagcgcaagacggcggcgtcggcgatgcgcggggggtgaggggacggcgccggcgacacgcgggacgatggggaggcgcggggacacgcgcggggcgagggggctgcgccggcgatgcgaacagggtgaggaggaggcgccggcgatgcgcacagggagagggggcagcgatggcgacgcgcgcgatgtggaggagaagctgcggcggcgctcgatc

SEQ ID NO: 24953 - DNA, 850 bp, Oryza sativa
tacggctctataccccaacccaacttgctctggcccttggtcctcccgcatctcttcctcggtaagcggaccgtggaagctggggggtatccgcttgggactgatagagaacagcatatcttttttgtccctcctgacccctaaaaaaaatatagttgaagtccggtcgacgttgttatccttatatattctgtcaaagaaagtccctcgcgtaaattgctttgaataggtaaatcaatcatttgtccttgaggatccgccattaatcctcgcatacctactaattggtgtacctgagatgcatttcctctagctcctgaaaaagacattagatagactggattagaaggatctgttatccgaaaattcgaattcatttcttgtttcaaatattcacttgtagcataccagatttcaacggattggcgtaatttttctaccgcgtgtacagccccataataatagtgtttttccaaaataaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtccgcctttttcatcttccgtaggggcctttagtcttttgattagagtagaggtcgcgacagagcagagcgtaccgccctgccatagtcgcgaggatcttaatagtcggtcgcgactgttgtcatagtcaacgacggttgaaacttccaggaaaaaacttcgaattgggagggcgatcctcccggtgagctgac

SEQ ID NO: 24954 - DNA, 1413 bp, Oryza sativa
  unsure (1)..(1413): unsure at all n locations
nnnnnnnnnnnnnnnnnnnnnnnnnnnnnnnnnntgcaggtacaggggcccaagtgcaattatctgaggcacgatatgaactatgaggtgttgcatcatatccaaaaatgatggagggaaacacatctcaagctcgcacactgtctgtatagtgaaagcctggagaggacataactctttaggatcaattactttctgagatatggaattgaagaaataacacagcttagtgatgaccagctttacgtgaactggttcgactgctctagttgcaatggcaaggaatactgtgagcattacatgacagttatgagaattgtagcctgaaagcgacagatccttcatcgacactagtcgcttaatgtttgaggagaaggcagtaggcactctcaccccatgtagggatttgcacaatgcaattttgtcctctcttgtcaaggtgtagcaagcaggcggaaggtactctttccttatttgcatatccacgaggtccttacgtgatttcagcctatccttggtcttagttggtatgtccagtatagtcccaatggtgctatcgaagacatttttctctaggtgcatgacatcgatagaatggcgtatgtctaaatctttccagtacggaaggtacttaaagaaaatggagtgcttcttgaatggcacgctagggcttgttggcacttcggcattatttctcttccgcttatttgtttccttcttttttaccttcccaaaaacaaccttcaggtttttggtcattctgaacactttatcacccttccatggttctggtgcatcaccttcctcaacagtaccatcgaaatattctgcttaggagcggtacgagtgattctttctcaagaaatgctagtgccgcatgtacactagcttcttcgatcccttaagatacctgtacatggtaccatccacacaaataacgcaacccgtctttcccttgatttgtcccaatagggaaaacagtgtaggcaagtcgttgacggtgacaatgataattacatgtagcgtgaagtactcccacaggaattcgtcccaaactcggatcccgtgttcccacaaatcgcgcatatcctccaacaaaggctccagaaacacatccatgtcattgccaggttgtcgtggtccctgtacaaggatggtcaacaagatatacttccttttcggacacagccacgttgggaggttgttgttgagattatagacatataatgatttaatctattccataaataaatcatgacattacagatgaaaactagcatgaacgcatcattagatctatacatgtaaactacacagtataacatgaacagatcaaatatgcgcaacatattgaacacgtaccgaggtgacggaaagatcggttgcttggtcgaaacttttcgcaggtgtcta

SEQ ID NO: 24955 - DNA, 1968 bp, Oryza sativa
aaataaatcatgacattacagatgaaaactagcatgaacgcatcattagatctatacatgtaaactacacagtataacatgaacagatcaaatatgcgcaacatattgaacacgtaccgaggtgacggaaagatcggttgcttggtcgaaacttttcgcaggtgtctacgaagacacgaaacacgcgagcgaagaggaaggcgagccgtcgtgaacaaaacagggagcagtcgcgcgaagcgcttcccaaaaaccttattgccgccttctcccggtgcaggacgtcgaaggcagaggttccggagacatgctctcccgatcgtcggtgcacgccggcgagcgggatggagtagtctacgagcgacggcgcagtacagagtaggaggcaaaccctagattgatttcgccagtgttgcgtgaagacggcgggtcggtttatatagagaagggtcgcttgatcagggcgcccgcacgatctctactgcgcataaccgaaccagataagtcgcgcgtaacttatccggactccacgccgtttgcacgcaccggatttttcggaacgtttccaaaacaaaaacgaatccgatttgcagcaaaacaaaactgcaaaaggaggctgcatctgcgcaagggtgaggagccaatttttcggaccattcgacgcgtacgtcgtgcacgcgcgccgcctgcccggcccggccaggcgaggcgagcgagcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagttgtacatggttaggagtactggccacgtgctgtgtgagctgctcaagtcaccgaatggattcattccatcggtgctcaatgcaaaccttacgtttcttgggtcctctgcaaacttatgatactttctgtcaaattccttccactgtcttgcatctgcaggatgtcgaatcatcccatccttttttcgcttttcgtgatgccagcgcatcaattcggcatccctcgggtttgagaacaaacgcttcaaacgatctttcaccggaaggtactgtatgacaagctggggaatcttctttttgttactgtctttgcatggatcagactcttctacatcgtcaagggcaacatccagaccctcggactggctacggcttgttttgtatcgactactcttgcatgttgggcatctgtccaaatcctcgtactctttacggaataggatacagtggttaacacacgcgtgtatctttcgcacacccagtgacaaagggcatataagcttcttcgcttcataggtgcttgttggcagggagttgggttgcggaaaaagtttcttcaacagaaccaacaagtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtggggtaaaattt

SEQ ID NO: 24956 - DNA, 678 bp, Oryza sativa
attaccccattcatgatagctcgaggcagacagtagaatttgcatatgatcgatcaatagatagcacagcagttgagcagtgtcgtttgcaactctatcgatcgaggaaccagcctgccggcccaaaaggagaccgaaaaggaaattaaatcgtgatttaattgtggccagtaaatcgcaggagaaaaactgatcgatctgagcatgcatgcacatacgcacatatttaatttttttcaacaaaatagtacaaaccagatagctacatatagaaaaataatccaataggatttaaatgtataaaataataaaattttgttgttccaaccgagattttctttcctcatcatgagaaaatgaaaatcatgcgaagtgagcgtaggtgctcatattcacagctaattattctttcaatgataagtgatatacctgtcgagcaagacatccgtggtgaattcatcaatcccaaaatatgtcggtgtgcgcgtgtgtataagttcatagtatgtgtgtctgcgtaatggacacttgcaattgaactttggttctaaggaaaatgaaaatgaaaaccatctaccataggcatattgtgaacgccttcgatcgaggcagacagagtaccatttgcatatgatcgatcggcagacaacagtcgagccctgtcgctatactacttac

SEQ ID NO: 24957 - DNA, 862 bp, Oryza sativa
  unsure (1)..(862): unsure at all n locations
nnnnnnnnnnnnnnnnnnnnnnnnnnnnnnnnnnnnnnnnnnnnnnnnnnnnnnnnnnnnnnnnnnnagaatttatagtattcttacatgtgaagaatgatcatcagaagaatctgactcaatttttgactctgctaggtcgatcgtctctagtacctgtgacaatattgtagcttttataagaaccataaagtttatgcaataatgcaatttgttaaacagaagtaatatggctttcatttcagtaggagtacaaagatctggttacatcgaagaaatttataattacttcatctatatcataatttcaatctcaatgtataaaatcttggacccaaacatacctttggcagtgctttatcaattatcttgaacaactcagtgtattctgctccttggtaggccctaagattctgcaggagtttccctactcctatcctatgatctgcagactcatcagagagtacatgaacaatattttccatgtcttccaccattgtttctgccagtatggcctgaacattgctttctctcacaatactgagcacaatcttttctttaaaatgagtagtaagcaaaactaacgcttcagttgctaaagtttccatcatctttctagggatgggatcttgaacaacattcatttctcctgcgaggaaagagatgagcatccgaacaattaggcgagagtttctgatctcctttcttgcagtatcatccgctgctaagaatgcaaggattcctgttacttgaacaagcagatcagcttgttggctttcagtatggtcagttagcaactttttgatgacttccatgatgtgcaaatttccagacacttggcgccgaagcttctccccagctt

SEQ ID NO: 24958 - DNA, 545 bp, Oryza sativa
  unsure (1)..(545): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatgcttgccaacaccagaaccactgcagaatagctcgaagctctcgagctcagttgctgtctctgccacttccttcagcgccttgtccatttcatacctcttgaacgccccaacgtaatcttcgttattttttatcagccatttcatctgactgagtgttactcttcttatccccgggaaatcggtggtaggagatttgcacacgctcagtaccatcttgagcatacgtatccattgtaaggttggcactctgtagagccttatcaaaatcaannnnnnnnnnnnnnnnnnnnnnnnnnnnnnnnnnnnnnnnnnnnnnnnnnnnnnnnnnnnnnnnnn

SEQ ID NO: 24959 - DNA, 1039 bp, Oryza sativa
ctatagggcgaattcgagctcggtacccaagcaccaccaccaccaccacccgggcggcgcgccgccgcccatgcccatgtacagcgccgcgcccatgggccaccccgtcgccggccacatggtgcccgccgccgtcggcacgccggtggtgttcccgccgggccacgcgccgtacgtcgtgcccgtcggctacccggcgccaccggccaagatgcaccaatgacgcgccatggacggacatgagcagcatttcttcctcctcctttcttgatgtgaatcttgatttgttctttgtgtagtcgccggctcatcgtccctgatcatcttgttcttctcacaatctcactaatgtaaacatacatagatcagatgccaagagtgcagggattggggattaaaggcgaataagtaaagtattttgctgactgtttgcaagtgatcatcacgtacacccggtgaaagcttagctccaaatgtggatgtaattagcagcggccttccgtacgtggtggcgccgatcgatgatcttgcaggggttgcaattagggattgatttccattttgctgatgtaaatttgcctactgtctcattggaccaaaacatatctctctctctctctctctctctctctctctctgccatatatatatcagtgttgatgaatggattggtgttttcctcatgttcatcctctcctcttctatcattggattaacgttttgtgttctggagcatctcatactttcagagaggcgacgtgggttcaatctaaattgtaatattatgtattctcgtgtttccatttaaattcctttgtgtctcattttggagctgatgacattacagtgtgtgcttgcttgcttcttgagtatatgtttcagcttcagtttttcaaagaactgaaatgaggaggctcccaatgcagacattgggtggtgcataaggacgaaccagaggcgttccaaatggtctgaaactctagaataccaggtgatccctcgcgttttgatgcaggatttataaatgagtatatgttaa

SEQ ID NO: 24960 - DNA, 1262 bp, Oryza sativa
  unsure (1)..(1262): unsure at all n locations
atacattcgaccccctttgattcaaaggggcccatataagaaaaaaatcatatcccctttaaatcaaaggattttatataggaatttataggattaggatcctatagaaaattttcctatgtggctatttgattcaaaagagtaaaactttacaaatcctatgaaatttttatgagaatgggtcattgcatatagattttggagaaaacatacggatatgaagctttcctatgaaaaatttcctctgagtctatctctttcatccgattcctgtgttttttctgcgatccaatcaaacggacattcatgtgtttttcctatgttttacacttgcattcctgtttgaatcctatgtttttcctattcctccgttttttcaatcctgcgattcaaagtggtcctaatcaaaggaatgaatcctatggaatcctatgaaattcctatggaatgtctctttctttgtaagttttgaagaaaatttaacatgaggtagaatctcatggaaagaatcttttgagtctttatctctactcaaatttctaagtttttttctgcgacccaatcaaacggtcatccctatatttttcttatgttttggatttctctgtttcacacttgtattcatatcagaattctatggttttcatattcctcctttttttattcctgtgattcaaaggtgcccttactataaacctggactgaggtttgacttgattcatagcactgagatatatcatatccgatactaagttagtttttatgggacagatggagcaaatatatagctcggcattcacgagatagatagcgacgacatccttcggggacacttatcaccgacaataggcataacatccttgaacatggatgaccagttctacacgtgtcttcattatattgggggagcttgaaggcttccactaaacaaataagcaacttcacctcaaaagaggctacaggcgtattcagtcattttaaaccataatattgtttgataaaattgataaatgttaacatttagtttgttattaaatatttgtcatgcctagagaattgataacatcatagttagcctatcctattaaaacttggtaatgttacgaacttaccaaaattttggcaatcccaaattttggaaatgctgaaaatagctataaagggaacaagtcctacatttcccaacatgtcacgttnnnnnnnnnnnnnnnnnnnnnnnnnnnnnnnnnnnnnnnnnnnnnnnnnnnnnnnnnnnnnnnnnn

SEQ ID NO: 24961 - DNA, 1292 bp, Oryza sativa
caatcgagtcacgtcgccgccatggattcgcaatcgagctgttccgaggaagaagacgaacaacaacagctgctcgtcttgatttccggaatcgcgcgtacctgtgctcttcctccgtccatgggatgcccttgcgcctctcctgctccgccttggagcagctcttgccgccgtcgtacccgccgccgccgcccttgcgctcgtcgcgccggtgtccgccgtccttggacgcggcggcggcggctccggctccgtcgggcggcgccgcggactcctccccggcgtagcgcgggagcgggacgcggcccgcgtcgatggccgcgacgtcctccaccagcgcctcgtagtgcctccgcacctcctccgccgacctcgccccgggcacgctcgcggcgagcgcggcgaaccagtcgtcgtcgggcgcgcctccgtccgcgggcggcggcgccgcgcacgccgcgagcgcgttctcgaacgccttgtcgtcctccctggtccacgccgccgccgccgccgccgtggtcgtcgtcgtcgccgcctgggaggtcatcgggtggtggatctcgcactctcgcctcctcctccctgggccggcgcgcggcggtgagacgtgcggcggccggcgacggcggcggcgtacgataagtatagtaattaagaatggcgggagggagccttatccacaagagtggtagggcgcaaacgaaacgatatatgtactggtggttagtattggttttgcggctggatttagtcgtaatcctgtaaattttgaggccatcattttgtttttctctctacctcctcggttttgctgcacagggaatggtacttctaatttttaaaatatttggacaatttttttttaaaaaagttgacttggtaatttaggcgctatttttcgtgcgtgaacgaggtcccaacctgggaagtgacacatcttactgtgatcaagaggtgacttgattaaccaattcgtcaatgcgctagtgaaactacaaaagcagatgcgatattaattgaaaaaaaaatgtctcgaaatgtccaaaaaaaatgtcaacatttgaaatttatagtttttgaggtgttacgaaacaactccatttgaagatataaaatgctctggttcgtagctagaataattatattttagttttttttaaagatttttagtcaggaatcgacgtcatatttactacttataaaaaataatcagatagtttttacaccataaattacttatacttacattgtaattatacattggattatattggaaggtttagtattca

SEQ ID NO: 24962 - DNA, 12432 bp, Oryza sativa
  unsure (1)..(12432): unsure at all n locations
acaatttttttttaaaaaagttgacttggtaatttaggcgctatttttcgtgcgtgaacgaggtcccaacctgggaagtgacacatcttactgtgatcaagaggtgacttgattaaccaattcgtcaatgcgctagtgaaactacaaaagcagatgcgatattaattgaaaaaaaaatgtctcgaaatgtccaaaaaaaatgtcaacatttgaaatttatagtttttgaggtgttacgaaacaactccatttgaagatataaaatgctctggttcgtagctagaataattatattttagttttttttaaagatttttagtcaggaatcgacgtcatatttactacttataaaaaataatcagatagtttttacaccataaattacttatacttacattgtaattatacattgaattatattgtaagttttagtattcatattatatttttttaagtacgcaatgtataaaaaattgtgatcaaaagtaacatattatataattgaaagaggacatgagagggatattatccggaacaagtagcggaagagcacccattctaatcagcatggacggcttccaaagcttcaatcggcatgtttaggtcaggatgaaaacggtcggaaatgatcggaaacgatattattattttattatttttttgaaacaagtagaaacaataggaaatttttcatatttatgaattgaactatttagtgtcaacttcaatgacactgagggcctgttcactttgatgccattttcaaccttatcaagttttggtaaaattgctaaaaaagtggctacatttagggtatgtttggtttgaaaccctaccaaaatattggtagtaccaaaccttgggcaaattttggtactaccaaatttttgatagtatagatttggctccactctattgatttggcaaaaattggttccaatccaaaatgctaacatgcactattcaaaactaacaaagaattggtagggcaagaattggcaccaaaccaaaatggcccttagtttcctgccaaattttggtaactataaaagaaatcctgccaaaattttggtaagttaccaaaattttggtaactactttggctatgccaaaatttggtaaggttttttttggcatcaaagtgaacaggctctgacagtaatccgaaaaactaaattttgaaaatggtaccggtcggtaaaaatattattattatgacttataatcaaccatatgagaaccttaaactaaatggttaacatcattgttaataccaagagcttagtaataaaaatttagttcttgtagcagatcttttaaaaacgtcaccaacattatgaaatagctaacacaaatgttgtactgtagtaacttcttactactccgtaggcgtacaccggtgagagagacatgcacagtgaaacattgtgaaatggacgtacgagtggaacaaccgatggcaaaatcggttcgacgcagagacagcgccaggcatcaacaacgtaccacaaaaacacctcgaaatttactctgcagaagagaaacaaaaatcaaaacttcgaggaagaaaataatttacaaaaccagcagcagcatcacaaaagttactttgataaggatagggacgcaaggttccaatctaccatccttgtcatgggcaatggacacacgagaaagaggaaaaaaaaaggaaggaaaaaaaataaagaagaggaatcaaatgattaaatctgaagccaacgattgcaagctgcggactactagcccctttgggatcatccgtgaggtgacatgattttgcagccgatacggcgatagcgtcaccttcgtcccgtattctctcattctctacttagctagctgcagcagtgtccactggcttcagatacttgagaaatggtgaaatttcagtgatttggacactccttaggatggtgtgtctggacaaatgtgacacaatcgtagtagtggattatagatatttgttacaagtgtttctcttgctgcaatggtgcttcctttttaggttcagttacatgctctgaacattttacagaaaatatgggtcagtaggttattctgttatgagtggctaatctctcctgtgcggattgcttatggaatgctttcttaattaactgtatcttgcgatctttcggaatgctttctgacctgtatatatatttcgtgctccttgtgtgaggaatgcgaggcaagtaccaaaggaagcaagaagacaagatcaggatcagaaacagagatggggatcgaatatcatggcagttgtacactgaagaaatgaatgcacgatcttccagacagcatggatggaacaagctaaaaggcctaagaacactgcaaagtgcacactataagattcagataagcttacagcctcactgtttcgcttattcgtgaaataaaccaaacagcatatttacaaatgaaaagtaatttatgaatataacttttgtatacatgttcttagcgatctaaaagtaaaggctgaaaaataaatttcgatgccaaaaatctcaaaatcaactccaaatttaaagttgaaaattgaaattttgactgataagtataagcataaacgaaaaaaatgagtcccttatatttcagacttcaaagacaccaacatggtgggcttaccaggcaaagtgccttggggcatcaaacacggtcttcgattcgctcatttggaaagtttgggtgccaggaaaaatgcaaattccacgtatagccagtcatccaaaatagggtctggatctccgaccagttggcgactagagcatgacaaaataatgggatctgccccatctactgtagagaaggcgaaacagttatacatctcgttgtcagctgcagatacacgaaaagaatttgaaacctagtagctgcctgggtggcttaccaatagcttgatcctggacaatgggaggcgacacaggcgacaaaagattggtgggaggctctagcaatcatggtaggagttctaaaaagggattgtgcaccctcattctccttgtcgtctgggagatctagaaggagaggaaccaatgaatctttgagcataatgagaccacgtcattattccttttcaccaaaatcaaggatggagtgcggactgtaggatcgaataaaaagaactaagccaaccagagggggggtgaatgattggtgtacccaaaaacccaaacttttagcggaattaaaagttatcctcaaatcgatgtagatcggtctgactgaggttgatccgccggtctgaccgcgcctgtgccgtcggtagcccggtctgactgccctggaatcgcctctgcctcctgtcgctgtcgccggtctgaccaccgctgacccgccggtctgaccaccgctgacccgccgatctgaccgccgcagtgccgccggtctgaccgccgatgtctcgccagttagaccgctgaacccgagcaaacacaaatcgaagaactcttgatgtagatgacaactttattacttctctctgtgtttacaaagtgcaacaacagcactcctcacgaaaatttcgactacactcgaaaccctaactcaactctcaactctatgctctcaaaagcgatactgggaggcctcaccctccctctctatttatacatgaggtaggcagcctaaagccacaaaccaaactcatacaagaagtcctaatccacctaggaaaccttcctatacaagaaaccaactttacaaactcaaattgtaccaaatttggactcattccaaattcgacttcacatcctatacacacccaatatctctatcgtatgtcatatggaatcttcaccaaccatgtgcattgatctttagcctgaatatcccgcatgatatctgaccatccggacgttgccttatctccaagtcgactcccgatccatcaccggcaatactctcctgaggcatcaagacacctacacataaatcaaacaaagaaatcatattccgagactaagctatctccaacttgactcattgttagcaaacaacagtattacatacgcatagtatccatctagaagccataaacacatattaatcacggatatccaatgaaacaacccgaaaccaaaaccaacacagagtcagccggtcaaactgtgagctggccggtctgaccgctcgcatagcgtcggtctgaccggcaacacctgatcggtctgactggaccagacaaaacagcagcacctgtatatcacctgaaaatccaatcatctccaaaaccactcgccaataatctccaaatatcaaaaccaataatctcatatgccaattgttcatcacagaataagaatcaaacacactttgattttacacggacatgggcgatggtaggagcaaaacgcttacgtgatttttttgccctactctgtatagtgtatagagcttttcttcttttcttacccctagggttatatttttctcatgctatattcaatgaaaagacgcaatctcataccgttttgccttaaaaaaaagaagattttagagacgtcaaagctaggttaggtgccccatgaatattcgtgcaagctatggggcccgtacccctagcccaaaaaattagcccaaagacactcaccctacagtgcaagcaccaatatatgtgtggcttagttggatggagacactgatgaaggaaacgaagcccacagtgggcgtgaccctatgcttttggacacgggtagcggagcaaaatttatttctcacctacccttctctccaacccagcgcgcaggcggatgcctagccctcgaccgcttcgctctctccaacccctcgcggcggcggctggcacggcagccggaggcgtcccaagcggcagtggctggcacggcggtgggatgtgtccccggtggcggtggctggtgaggccgagggaggcatccccggggggagcggctggcgcggcggtgggagacatgaagtccgcggcggtgggctttcgggggtggcgacgcggtctcccgtcaactccggtcgtcaggaggggacacatgcctnncgctccttttccccccacctcctcccgaggcgatagcgagctcgccgccgccccgtcgccgggtgctactttttggggttcttggttcttgaatccacatggaggggcgaacttttcgctgggtgtgttcttgggtttctggggttcttgcttcttgttttctccttggttctcgagttcgtcaaccaaggattgaccggagttgacggggagttcttgcgtacggttcggattggtttgtagattattttcttgatgattgcgtgaatgtagttttgggctacaaattcttgagcttgcaatggatttgtttgattcttgaacaatgaatgcagcaagcatgggaggcgatggagaggccgccatggattgggacttcagggtggcgatggtgaggccggagagagacctacctacgaatccgagggagaaatcgagcgtggcaacgacggaatagggcaagcgtcgaccaaatagttgtggcgggagggcgattttggagggcgaatccgggattccaccttccgtccgccgcgagggcatgcgcgcgtctaggacacgcgctcctcagtgcgcggaacttcacctcgtgacggcgcgcgcggactcgccgagaggaggaagtgcggcgctctgcgtgggggcgaggtgctttgcaggggcgccgcgacaccctccacgtctgcgttttattgagctggcaccgtggagcaccgatccaactcaccgcactgttgaatggccttgctgcacaggcatggagccatggacaacaaggagagagtaggcaggcaggaagagaggagtacggagtgacgtacagtagaaggcaaacgtgggcgattctccatttctcattgcccgggggaacgcaatccgcgggcgcggccgttgattggctccactggctttccctttttggacggtagcactcgctggctggcatgtgggagtgggacggtgggtcggccgcgccaaccatccatccatccaccatcgtccatcgatcgacggcgacaccgcaccccatcgctgtccgccgtgacgccgacgcctcctctccttaaccctgctgcacagacgatccagtgtgactgcacccctcgataggtttactccgatttaaatcaacttctagtacatgcaattctggacgagatttcataaaaaaaaatcaatttttgatcacgaattgattttcgtagttagaaattgattttaatagtgcggagggagcactgcatatgtgcatgctcagatcgatcggtttttccccaccgattttactggccgcaattaaatcgcggttcgatttccttttcggtctgcttgggcacctcgatcagatcaagtaagtagttatagcgacagggctcgactgttgtctgccgatcgatcatatgcaaatggtactctgtctgcctcgatcgaaggcgttcacaatatgcctatggtagatggttttcattttcattttccttagaaacaaagttcaattgcaagtgtccattacgcagacacacatactatgaacttatacacacgcgcacaccgacatattttgggattgatgaattcaccacggatgtcttgctcgacaggtatatcacttatcattgaaagaataattagctgtgaatatgagcacctacgctcacttcgcatgattttcattttctcatgatgagggaagaaaatctcggttggaacaacaaaattttattattttatacatttaaatcctattggattatttttctatatgtagctatctggtttgtactattttgttgaaaaaaattaaatatgtgcgtatgtgcatgcatgctcagatcgatcagtttttctcctgcgatttactggccacaattaaatcacgatttaatttccttttcggtctccttttgggccggcaggctggttcctcgatcgatagagttgcaaacgacactgctcaactgctgtgctatctattgatcgatcatatgcaaattctactgtctgcctcgagctatcatgaatggggtaattttatcattttaaaaagatacaaaagatacatgaaggtatcatatattttagtattttagtgtaaaaatttgataaatatatcaagataaaaaattttaacgtaaaatttaggcacctctatatttttttcttgaaccttaaaattgcccatcatgaattttactggccaatggtaaatgattttctcattactagcctagaacccgtgcgttgcaacggaaaacaaatatattaagtttctagctaattaaatcaattaagaagcacttatttagtctaagtaatactatgattttttttattgaacaaatagatgattttgaattttgggaagccaataatgaagtaggagatgacttgttaaaatatggtgtagtagtatagattgtgagatccggatgttagcgataggggtggtgcgtgaatggataccaccactactaatattttaagtagtatagatggggagaaaaatctcgattggaagaaaagattttattattttaaaccatttacaccctatagtattattttctatacgtagcccttttgtttgtcctactttgttggaaaaattaaatacgaatccttcctatctttcacttcttttttgagaattataagcatgagttctaacctcatagtttagaatccgttcgaacagcccaatacacaatctttctttctctctcctagaataatatgagctcctttggaacagaagaaaagcatacgataaatgaatagtataaatgaaggatttaaattcatatggacacagtcactgtacgtagtagcctttacatggtactggtcgctggaaaaagcaaaggaaataatttccccacatttctgtatttttccaagtcatccaaacacatgttcctctaaattttcaacgttttcaatcttttcgcatggatttctatcctgtttttgtgttttctctggtttcaatatctactagcttataaagtcacacatttgtgtgatttctaaccatcctgttacgtgttttatatactagttgataccccgcgctttgctgcgagatatatggatgaatgtattttatacattatagaaaatgatatatgtatatgtttaaataatgtaaaaataatgcgaagataatgatttgacattgcttgcatattgagttctaaaaatacaacaaaaatgtaaataatatgtcatgtttgcatcatatttaaaatactctagataaatatttgctggtgggtgtgatgatatgatacacttgaatgttgagctttagaagttagtggatattaattttatagtaagatatgatatgaagatatgtagtcaataatagttatgtatgtgaaattttagtattcaaaagacgtgccagctgtatttgtttaattttattgagtgaaattttgaatgtttgttttcattactttgaaatatacgctgggaataattctaatccacgtcatgtatgtatgtgtgtggagatacatcaacaaatctgtcaatcatgtcttatacaacaaagttgatgattatatgggatggtattgagatattggagatggagataagggggaacaggagctgcgagggactgagagtgcggtggagacgtcgctgccggcgaaatcaggacgaaggggattgcggaggcatgttggagagcggacgggagagaagtcggcagacatgtgcacaaatgggagttgtgatgtgatgggactatgggaggcgtcgctggatgcgaaggaggctaattgtgcagatatggagagaagcgcatgtctgcccgttgatcgaaaccgttggatttgatgatcaaacgatccatattccacatgtctgtcaggttggagtcgccgccatcattacgattttttaagtattattatagatatagatatagattaaggagttgctagagagaacttcattagatctaccggtgcctcctctcttcccctatccactcatccagccgatagaggggcggtggtaagaggcggctatcgatatgacaaggccgaagcatggtggctatggtggtgaggtggagcctgaggctaggaagcaccgctgtgatggctgtcattgacggacccagaagaaaggggagatgtgggtgctgatgatttggccctataactttttatgtggagttacctgcacacagatcccatcataaaatatgcttgttctatcccatgcctaagcataaaaaatcatcttgctttgttcttagccttggcatgtgtcaatcctgtattttccatatccatactatcaaatccttaggtttccgaaatattgtaatggaaaaagaattgattcgaattatcactatttgactctgacctgttctaaaaaagtcaaggtacttcgaatgacatggacaaagtaagggagtacaaacaagctgaagcaaagtgggtaacagatcccagtaggccccatatccattttgttttcctgactgtcttgtggacaccatatcagtgaaaaccgtctaagatagtcattttgcaccggtttcatgatatctggtattatgggtgaggtatacaagttagattgatttgatcatgtttttacctttgatgggctatagataaatgggctgacttgctattacttccggcccattgggagtattttgggtctttgacatctctcttctcacaccccgctcaatccccaatccggttgaccatgtccgccattgatttgccgacgggaggcggcgctgggttcccccctccgggttgccacccaaaccggtcgtctaggccgcgtggccatgcgcgcaactttgaggtccacaaacttactatcatttcatttgagcttgtctttcgtgtcccatcgtagttcatatgttttttttatcttagctagaattcactagattgattgtgaatgtgttgtgcaatgtacttatcgcgtggagaaaagtgttttcgtaatctttgagaggtacggtacgaataggtattgctaagctagacttttgtttattgattctacaaatatttcggtatctccaaaggtataccatagataactcctaggaattaattggaagacagttatcaccaacgtaactcactaggtatgcattataacagttggtgagcttaagagaaaccaagatagcaatctaattaatttactagaacattatgtttccctgtagtaaaacatcaacagagagtgcactattgtgaatttagataatctgaatgactacatataatgttgtaatagcatgagaagaaatggttgtaacactacatggtagattacattggattgataatccccacaaccgaaaactgcatgaactttgtcgacgtttgatgtcgcgattccggtatttgcatggtatggggatcgttggtactagggtctacgcgagactgagataaaagagatggagacagggatttttatacaggttcgggcccctgaattatcaggtaataaccctacatcctgttggccgaagccgttgttactctttattcatctggatcacacaagtacaatatgtgggctagcctatctaactgttgtcgacatggcggtctgaaggtctgactcgtagtcgataacagggtagtcttcctcctcgagtatgtgcctggcgagatcagagataacgctttcgtctctcctaacagtatctggagacaccgtaggggactagccgtgcttatccctgaagtcgatatccggcgtcttgtcttggcgtatgttggcttgtatgttgtggcttctatgttgttctgtgtatgttgattcttcccctttcctcctagggggccttgtatttatacccataggtgtccccttgtctaagtagaactagggaaaccaatatggatacaatccgagtagtccttgtcgtttccatgtagaactctggttgtctttccttatccagaactcctcctatatccgcaggttgtttccgtataggacatggtaagtggtgggtcctgccgagatttagtcgactactattatgtatgtggtatccataaccctgacaaacttgttctgcattgttacataattgttttttagtagaaatactaccaggcgccgcccagtagtttaaaaaattaaaataaaagaaaaattacaatctgtataggaaaaaagtccaaaaaaaattacaaagtttgtaaccaggaagaaacaaaatctaacgaagaaccattcatcctacagaaatgtaggagaatatcctgattaaagaatctaaaccaggcttgaacatctgggataatattcctgaaaattagtgcattcctctgtttccaaatatgccaacaagcaatggaaaagatttccataaaacctttccttccgaaactaattttagctaagccaatcatttgctgaaattccaaattataattccactggaaaccattttttctccaacacgcctcagtgaaagggcaactgaaaaacatatgttctctcgtttatcttaaactcaacatacacaaagcacatgataagtcatcattttctttcacacactttcttcaatcaagcatatcccttgtattcagtcgatcacacgaaagcagccacatgaaaacttttattttattgatacacaatgacttccaaacccaggaaaaggatctagaaggagagagactcacaaagttcagggcataaatcttcttcgatgagtagactgaattattacagatgaaagaccaattatctccaatcacatcattcagagagagattatctagttcatcttttagctgtaaaaaatcatcataagcctgtgctgaaagagacaaacgaaaacaatcctcaaattccttgagcattatggccttgacagaatcagatttattaagtgcatgagaataaagaccgccaaactgctgacatctaatttttctattccaaagatcctccccaaaaaaaaaaactgaattcccatagtttacagaacactgagcaatagctctataaacatctgataaacaaattatgtctctgcaccaaaaagagcctttattaaagacatgacgaggaaccttatgccgatagtaagactccctaatcaaccttacccatggtaaattggctgatgtgtaaaatttatgaagatgtttaagaaggagagccgcattctggatatgtaaattgatgacaccaaggcccccttttttctttagagaacagacttgttggagatatgggcccgggggtatgtgaagtaaggggagttaccttcccgtccagccacgtggcccgtcaagctggccccacttacgcacctcgtgagtcgcgaaacccgcgcggggggggggggggggggg

SEQ ID NO: 24963 - DNA, 1494 bp, Oryza sativa
  unsure (1)..(1494): unsure at all n locations
ccggtcacgtccggttgaacgggcggccgtgcccccacgccgcctttgtctccggcggagtgggggtaggtatgacccatcacgtcagagcgtcactcgaaggagggctaccacaagtcttcacttatttatgagggaatgacagggctgtcccccgtgtcaggcgggggacggcgctgggacccactcaaggaccggttgctgcttagcttccgggggaaggcacggattgaggccctgtcaaagtggagcggggtccccctcccatggaggggtaggtacaggcggtgcatgtggtatccccttgagctataaaaggaggaccttgcccaccgagacaagaggacgactctcagaaaacctgaactctaggagaaggaaagcgagagtgctctccagagtaaaggatcctttgtaaaactcatccataatcccaaacacaggagtagggtgttacactccatagtggcccgaacctgtataatccgattgtgtgcaagctagccggtagtcttaggggcgaacacgtgttttccaagaggcgagcctcagcccccggccgaactcacgaaaggggggtcttgcgactccccgccatcgaggatcttccctcgacagctggcgcgccaggtagggggagttgcgcgcttcgagaaaaagtcgttttcttccgccccaagtttctctgggccctagacgatcatggtcgaggtcctggaggtggaggaggaggcggtggcgtttatccccaccccgtccgggagtggggattccggcgaaagccgtggccctcgtcaccaccgccgagattctccaactccttcccgccgcgaaccttcgcggtgggaggatcccacccgttcgggtggttcggccctctccccgccccctggcggagggaggccgcgatgcgtcggggaacgccgccgtctcgtctacggagacggcggttcgccccgaggcgcgcttcaggcggcaggcgcccttctgcggcatcccccggtaaacccggtgccggagactcccgttcagcgctggctggacgacgtggccaacttagtcaccactgcccagcggcagttggccacgggtggccgatccgccgccacttatacgtcgcgtaccccggttactctctcctcgtcggcaaggaggagggcccgtcggtcggccacgatctcaaggcggtccacagctccaacatcgtcgggggcctcaggaagccggaggcgttatgacggtctctacgggaagcaggacgctcggatcaacatcaagcgacgctggaacgagtgccgagctgcccgcatgggggaaggcgcctcatcatctggagtgccacgctcctgttcacgaggcggccctccccccacgctcacccttggggggacaggttgtagggccttcgtggcgagtctccggaatgtccggtggccnnnnnnnnnnnnnnnnnnnnnnnnnnnnnnnnnnnnnnnnnnnnnnnnnnnnnnnnnn

SEQ ID NO: 24964 - DNA, 1609 bp, Oryza sativa
  unsure (1)..(1609): unsure at all n locations
nnnnnnnnnnnnnnnnnnnnnnnnnnnnnnnnnnnnnnnnnncggcggttcgccccgaggcgcgcttcaggcggtaggcgcccttctgcggcatcccccggtaaacccggtgccggagactcccgttcagcgctggctggacgacgtggccaacttagtcaccactgcccagcggcagttggccacgggtggccgatccgccgccacttatacgtcgcgtaccccggttactctctcctcgtcggcaaggaggagggcccgtcggtcggccacgatctcaaggcggtccacagctccaacatcgtcgggggcctcaggaagccggaggcgttatgacggtctctacgggaagcaggacgctcggatcaacatcaagcgacgctggaacgagtgccgagctgcccgcatgggggaaggcgcctcatcatctggagtgccacgctcctgttcacgaggcggccctccccccacgctcacccttggggggacaggttgtagggccttcgtggcgagtctccggaatgtccggtggcccccgaagttttgccccaacctcacggagaagtatgatggtagcatcaatccctccgagttcctccagatctataccacgattatcgtggcagcggggggagacgaccgggtcatggcgaattactttcccatggccctcaagggtcaggcgcgtggctggttgatgacccagccccccgactccattcactcctgggaggatctatgccagcagttcattacgaacttccagggcacatatccccgcccgggggaagaggcggacctacacgctgtacggcggaaggacgacgagtccctccgctcgtacatacagcgcttctgttgggtccgtaacactattctgtgcattccggcccatgcggttgtgtatgcattccggaacggcgtgcgacacaatcgcatgctggagaagatcgcctccaaggagcccaagaccaccgccgagctcttcgagctggcggacaaggtggcccggaaggaggaggcatgggcctggaactctcctggcgccggtgcggcggccgcggctacccccgagtctgccccccgctctaagcggcgagatagtagaggcaaaaggaaaccggcccgctccgatgacgagggccatgtccttgcggtagatgggcccgtacgggccccacgcaaagggaaggccaccggcgacaagccgagctccaccgctccctccggcgagggccggtcagcagacaagtggtgctcggtgcacaacacttaccgccacagtctcgccgactgtcgctcggtcaagaatttagccgagcgattccgaaaggccgatgaggagaagcggcagggtcgacgggagggcaaagctcccatgacctcaaccggtgaccggcgatcggaggccaagaacaagcccccgctgatgatggcgtgacagtgaggatctggatttccagataccttaggggaccgtcgccacgctcgacgggggggcttgcgctcacacctctcgtcgaggcttcaaggccatgaggcgagagcttctggctgccgttcccacgcacgaggcggtccggaaggcgcgctggtcagaggtgaagct

SEQ ID NO: 24965 - DNA, 1648 bp, Oryza sativa
ggccacgtcgagctcctggtaaccttcggcgactccaccaacttccgcaccgagcggatcgacttcgatgtggcggatctcaatctgccctacaacgcggtcttgggcagacccgcgttggtgaagttcatggccgccacccactatgcctacctccagatgaagatgccgggtcctgctggccccatcaccgtctttggtgatgtcaaagtcgccctcgcctgcgcagagcagcgcgccgacaacctggcggtggccacggagccgcaggccccaggggctttcgcgtcccgcgtctccaagaagcaccttacctcggctgacgaggtgcccgtcaaggagatcccccttggcgatgatccgtccaagaccgccaagattggcggaaccttggacgccaaataggaaagcgcgctcgtctccttcttgtgggcgaattctgacgtcttcgcgtggaagccgtcggatatgcctggggtccccagggaggtgatcgagcaccgccttgccgtacgaccggatgcgcgacccgtccggcaaaaagtgcggcgtcaagccccggagcgacatgccttcatcagggaggaagtggcgcggctcctggaggctgatttcatccgcgaggtgatcaatccggagtggctggcgaacccagtggtcgtcccgaaggccaacggaaagctacggatgtgcatcgactacacagacctcaacaaggcatgccctaaagatcccttccctctaccacgcatagataagatagtcgactccactacggggtgtgaccttttgtgttttctagatgcatactctgggtaccatcagattcgcatggctagggaagatgaggaaaaaactgctttcattactcctgtgggcaccttttgttatacaactatgccttttgggttgaaaaatgcaggccctacttttcagcgcatgacttgcattactttgagtaatcagatagggcacaatgtagaggcgtatgtcgatgacctggtggtaaagacacgccaccaggacacgttgcagcaggacttggccgaaactttcgatagtcttaggtccacgcgcgtaaagctgaaccccgataagtgtgtgttcggtgtgccggcgggcaagcttctcggctttctagtctcttcccgaggcatagaaacaaatcccgagaaaatacgcgcgatagagagcttagggatgtgcagtgcgtcactggatgcatggccgccctgagtcggtttatatcaaggctgggcgagagggcgctgcccctattcaagctcctcaagcgctccgggccgtttgtatggatggaggaagcggagcaagctctcaatcagctgaaagcttacctcacttcccccctgtcttggtagccctggggccggagaaaccattgctactctacttggctgcgaccccccatgtggtgtgtgccaccctagtagttgagcgcgaagaaagtgaacgggaggcccctctggctcgcgatggtccctcgtcctccgaaggcctagtgcccaaagcccctagcccccgggagggccccgaggcccccgagggaggaggggaggctttggcaagtggccccgagcccgaggtgacccgggatccccccggggcccccgagcaggggcgccccggg

SEQ ID NO: 24966 - DNA, 3953 bp, Oryza sativa
  unsure (1)..(3953): unsure at all n locations
nnnnnnnnnnnnnnnnnnnnnnnnnnnnnnnnnnnnnnnnnnnnnnnnnnnnnnnnnnnnnnnnntgaaagcttacctcacttcccccctgtcttggtagccctggggccggagaaaccattgctactctacttggctgcgaccccccatgtggtgtgtgccaccctagtagttgagcgcgaagaaagtgaacgggaggcccctctggctcgcgatggtccctcgtcctccgaaggcctagtgcccaaagcccctagcccccgggagggcctcgaggcccccgagggaggaggggaggctttggcaagtggccccgagcccgaggtgacccgggatccccccggggcccccgagcaggggcgccccgggtcacctgcccctgacaacacgaaccggccccgccgaaaggtgcagcggcccgtctactttgtcagcgaggcacttcgagatgcgaaaacccagtacccgcaggcccagaaaatgctttatgccgttttgatggcctcaaggaagttgtgtcactacttccaagcgcatcgggtttccgtagtgacatcgtaccccctcggccaaattttgcacaaccgagagtgcactggacgggtggtaaaatgggccattgagctggctgagttcgatttgcacttcgaaccgcggcacatgatcaaaagtcaagtcctggctgacttcatcgcggaatggaccccagtggacgaacctgttccatccagtgtcccttttccccccggagaggaagaggatccaaacgccgacattcgtggcgggcactggattatgcatttcgacggctccctcaaccttcaaggtgcaggtgccggagtcacgctgacttcgccaagcggagacgtcctcaaatacgtcgttcgactcgacttccgagccacgaacaatatggcagaatatgaagggctcctcgcgggattgaggacggcagccggaatgggcatccgccgtctcctagtcctaggtgactcccagctggtcgtaaatcaaatatcgaaagaataccagtgcaccgacccacaaatggatgtatatgtccgcgaagtacggcgcatggaacgccacttcgacggactcgagcttcggcacgtgccccaacgcgacaacatagtcgctgatgagttgtcgcatgttgcgtcggcacgagccccactccccccggggacctttgaagaaagactcgcacaaccatcggcgtgaccgaaccccttaagggaccccaacgacacgccctccgccctgacccctggcgacccgcgcccctcggggcccgagggggttgaccccgacccccctcgtcaggtcgtgtggatgaccgatatctgggcgtatcttgacggcaatactcttcctgaggatcgcgcagaagctgaaaagctcgcgcgcatctccaagcggtacgtcctcgtagaagggaccctctaccggcgtgccgccaacgggatactcttgaagtgtgtttctcgagagcagggcatcgagctcatagccgacacccatcagggtgagtgcggggcccattcagcctcacgaactttggtcggaaaagccttccggcaaggcttttattggccgactgcattacaagatgcccaagaatgggtccggcggtgcaaggcatgctagttccacgccaagcagacccaccagccggcccaagccttgcaggtcatcccactctcttggccttttgtgatctgggggctagacatccttggaccattcaaggcggctcgaggcgggtatcagcacttgtacgtcgccatcgacaagttcaccaagtggcccgaagcctacccggtcgtcaaaatcgacaagcattctgccctcaagttcatcaggggcatcacgtctcgattcggagtgcccaaccgcatcattacagacaacggcacccagttcaccagtgagctgtttggcgattactgtgacgacatgggcatcaaattgtgcttcgcctcgtccgcccaccccaagagcaacggccaagtcaagcgagccaacgctgaaattcttaaagggctcaagaccaagacgtacaacgtcctaaagaagcacggggattcatggctcgaggagttgcccaccgtgttatgggcaaatcggaccaccccaagccacgccaccggggaaacgccgtttttcctggtgtacggcgccgaagcggtcttatcctccgagctttccctggggtcgcctcgcatcgcgctgtacaatgaggccacccaggatgaccttcgccacgacaatctcgattatctcgaagaacggagaaggcgtgcggccctacgtgccgcgcgctaccagcaaagcctgcgacgctaccatcagcgccacgtccgggcccgatcactgcaaattggcgacctcgtcctacgccgcgtccaatcgcgcctggagctgagcaagctctcgccaatgtgggaagggccatacaaagtgatcggcgtgccccggcaggctccgttcagttaaccacggaggacagcacagagttgcctaacccctggaatatcgaacacctccgtcgtttctatccgtggcatcgagagtttttgctttccaggagctcgggccaacccccgcacaacccctcagtttgtgcaggcttggctgggggctaccactgtgtatcctttttccttttacaagcaatgaatttttctacttttttgtgaagaccgttcattcccttcctctggcttgtcctggtttaagggataatctgtgtttactctgaaccctaagtgccgtagggcggcctgaaaaccgccaaaagggagcactaaagcgggccacgccccgggttgcgccgaaccccaggggatcggaagggcctacacacggccgtccccgacccccggtcgtcgcagccttggtctggccagtcccgctgggcggctccctcggggcgacggtcttgcctatcaccacttaggtaccatggaccgagcgtggatttaccttcttgctagaacaagcccgagggggggggatggggtcaaaacggcatttcgatcacaggcagattaattatacccttttgctctggtttcttcttctctctatgtcacagacatccgatggaaaaggcaaaagagtaaaggggactaaggaagttttagttgcagaacaagacaggacgacacgatggcctaaatacaagtgcccgctacgggcacacaacaaaaggggaattgaaagcgcgagtagtcacggagtgtctgggcccccgaggccggcgccgctgacgacgtcgtcccagtcttcgtcgcccacgtcgtcgttgtcacccccgcttctgctctcctcgtccgaggcgagcccgaaggcgaaccggggggccgacccatcgaagttcgagacaatcgcgtcggccgcctcccggacttgctcccgggcccttgcctcggtccccgggggaaaatcttcgagcgcgcgccatgggacgaagtcaggctcgcgcgcttgatggctcgcgaggaccagctccactgcagcccgtgccaaagaagctgacgacaactttatggtctcgccgacctcctcctctagcctctccagatctgccgccagctcgtccagccggagcatgagtgctggctgtgtgggcggaagtttgctatcccggcgcacagaaatgccgactcggcgccccgcgcgctccagccggtcgacggcgtcggagagctgcccgggtccgatctcgttggtgaggcggagggccgcgatctccccagcctgatcttgcaccaggcgctccaggtcggcgagggtattttgagccatggcgagctggctcgccaaccccacgccgccgagcggcccgcccgctgccaagtccttctcccgggcctccagctcggaagccttcgccgctattgccgcacgctcggcgggggatcctctagagtccgggccacgcgccc

SEQ ID NO: 24967 - DNA, 789 bp, Oryza sativa
  unsure (1)..(789): unsure at all n locations
acggccaagtcaagcgagcaacgcttgaatttcttaaaaggctcaagaccaagacgtacaacgtcctaaagaagcacgggaattcatggctcgagaagttgcccaccgtgttatggccaaatcggaccaccccaagccacgccaccgggggaaacgccgtttttcctggtgtacggcgccgaagcggtcttatcctcgagctttccttggggtcgcctcgcatcgcgctgtacaatgaggccacccagaatgaccttcgccacgacaatctcgattatctcgaagaacggagaaggcgtgcggccctacgtgccgcgcgctaccagcaaagcttgcgacgctaccatcagcgccacgtccgggcccgatcactgcaaattggcgacctcgtcttacgccgcgtccaatcgcgcctggagctgagcaagctctcgccaatgtgggaagggccatacaaagtgatcggcgtgccccggccaggctccgttcagttaaccacggaggacagcacagagttgcctaacccctggaatatcgaacacctccgtcgtttctatccgtggcatcgagagtttttgctttccaggagctcgggccaacccccgcacaacccctcagtttgtgcaggcttggctgggggctaccactgtgtatcctttttccttttacaagcaatgaatttttctacttttttgtgaagaccgttcattcccttcctctggcttgtcctggnnnnnnnnnnnnnnnnnnnnnnnnnnnnnnnnnnnnnnnnnnnnnnnnnnnnnnnnn

SEQ ID NO: 24968 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnnnnagatcgaagtttcatgcgactgatgtggtagtcttgccaatgtgatcaacaatgtgataaaaatttcacaagcgacacctcaattgataaaaaacgtaccatacgtataaggtggtgtttggttcggatgtggtaacgtaaacgctaatggtattgcctccagccgtaacggataccaatttatccgattacatgattagtttggttgcaggcggtaacgtcatttatttacattactgcgtttggttgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaatttcctatacatgcaacgagcagagttttggcagatagttcataatattccaaacactgtcacctcatgtttggatacaaattttgacagtgagaactcaagacaaaaagacattttgcagattagtaaacaataagcta

SEQ ID NO: 24969 - DNA, 1248 bp, Oryza sativa
aatccatgtccatgaatccaacaaaaatttcttatattttgggacaggggtccgcgtgggagcgctcggaagccgccgccgccgtctctgtcctcgatcgcatcttcgatgggaggtcttgggtgccgccgccaccgccatccttgacgccatccgcaatatcgtgaatagtagtggtatttttctaaaatgacatatttgtagtggcacaaaatataaatgattttggttgaatgggatatcatagtactacgaatctaaatctatgtccatgcatccaacaaaaatttcttatattttgggacgggggaatatgtattttctaattaacttcttattattttaatgttattaattagttttatgtgttttatattgtctagtgtaaactaaatgttgttaatcacatggtttaaaaatctatgtgtttttccattaaaaatgtaaaaatgtgtgttgagtggccaatagctggtccaaagcaatgtatttcttttacttgttaaatacagttaatttgggacgtgaattataaatatttgttataaatgatctaatagtgtacatggataaaaaattagctatatatatgatgtaagatgttatagttgttcaaaaaaatttttactacaaaatatgttcaatctaatagggcatggaaataaaaaagaggagatgcaccggccggttataggcatgcgtatgtgcagtttgcagcacacgtacatgtgtacaggccccatgggccttttcttttattattaaagtaaatgcaatgaaggaaaatagggggtcctttgttaaataaaagaaattggtgggtccaccttatttaaaagtgccacgtgtcgaattaagagcatttgtaggaagacatgtggcgacttaggaatgtttataggaagtttaatggatttttagtatataataactaggaaggtggcccacacgatgcgcggacatctatactatcggaacgtaatattataatttctttagaaactatattttataagggcaaactataggtcgggtatatctaaaaaccattcattgacttagaagatagatcaaggtcatatggcatttgaatttacttttggactgagtgagtaatatcatgtataccattgaacacataccatacaatattgctacaagtaaaaattgcgatagcaaggtggtaatgaccaaaattggtaatatcagcattcgagatgaagataggatccgagcggaatcgaagat

SEQ ID NO: 24970 - DNA, 383 bp, Oryza sativa
  unsure (1)..(383): unsure at all n locations
nnnnnnnnnnnnnnnnnnnnnnnnnnnnnnnnnnnnnnnnnnnnnnnnntggccttagtgggcatttaactatttgccacttttagatttggcaattaactatttgcacccctatctcaatgacatgtgggtccaaatgtgtcaatgacatgtgggtccattaggaaatagttaattgccacatctaaaagtggtaaatagttaaatatctcacacagggggccacggggatgtgggggaaatgaggcgggaacgtggagacagttcgacgctgtttagatgcgagctcgtgaccgggggggcgccggatttggcaagatgtgagcggcggtgtggtccggccggtcaaccaaccggaggttgaaggaggggtaccgagctcg

SEQ ID NO: 24971 - DNA, 691 bp, Oryza sativa
aatctgcatatatatatatatatatatatatatatatacacatgtagacataccaggttgcttccatgaagacgatgatggtcacgaaccagaaatccttctgtttgatgagggtagcgtatccacctagcaacaccaccgtggcccatgcgaaagccagtgcaccacaaccgttcatcaccctgtagaagaacgcaatgcgtacggccatggtgttgagcttctcttccggcagcctctcatcatttggatcaggctgatcaaatgcctctgcatcattttttggtggcactgccatggcgtcgcaatcttggtgcgtcgcacatttttgatcgggtttgtgagacattgatcgggagtgttggtaatttatttcttagatctgtcttctcgttgcatcaacactggggtggcatcacccccattttatactggtcggacgagcatagtagaaaataaggtgtggtacgtagtagatcgaatacaacctgtaacatatgttagtttaggtatatatggagatggacgccgtcagctttataaaaaaaattagtaataataatagtgactcttgggaggtagatcgatctgcgagtccgtctatagttatgccaagtggcaaaagtcttcttttgccctggaaactaaataattagccaatgagcagggcgtacatggacatgatataaat

SEQ ID NO: 24972 - DNA, 900 bp, Oryza sativa
  unsure (1)..(900): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacgtaccaaagtaccgacaaaaacatctttaatgtttacaatagtagacatttatgctcgcaaattaggaaccaaattgaaacttgcaagccaactcgctgttcttgacagtattaatgttgttccattgtgatagatgatggtcatgagccaggtgcctttttgacgaattttgatgagtctgctgacgattttacggacaaggattttgagtctgatgaagccataggggccatgtatgagcgctggtgcaaggcttacgataagaagcgtgaccttgctgagatgactcaccggttcaagatattcaagaaaaatgcagaggctcttcacagatccaacgagggtgcttcaaaatatgagaaaatatattgtggcccatactgcgatgggttcgatgagcaagagaaggctgaagctctgcttaagtttcgccattttcccagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24973 - DNA, 953 bp, Oryza sativa
  unsure (1)..(953): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcgcatctccagtatgtgaccttctgtagtcttcaggagaaagctgaaaatccgtttctgtgcaatggatgttgcagtggctctaacctttaatatctattcatttctgagtcatatataataataatccctgcaccagtcactattcactaatcagtacccaccataactaactagtaacctgtataagaaaattcagaaggccatatgttctttcttagataatagacccctgggatcttctggatgtattttttgcaaccctttggcgtgattggcaaatgagattgggaaataatatccacccataaaaaatgcaacactgcatcctagccatccattctaaccactccatttcattgtagcccttcactcatttccctttcccgatcccacctctcataacccatttgccgaacaagaactaaagatttactcccaccccggaattcgtctcttgttgcatcccttttctgttttgttcattatatcccatctgtttttcatgtatcaggtcagccaaaattgccaacaaactttgaggaggatacatgggctattttgaaagatgctattacagctatatttctaaaacagaaactttcgtgcgatgttgaaaaactttaccaggtaatttttatattgcttctattctatttgatgatcccactttagttatttagaacttgttttcttcactataggctgcaggtgacctttgtctacacaagctaggcgcaaatctatacgaacgcataaagaaagaatgtgaagtacacatatcggcaaaaatatcagcattagtgggtcaaagtc

SEQ ID NO: 24974 - DNA, 20184 bp, Oryza sativa
  unsure (1)..(20184): unsure at all n locations
nnnnnnnnnnnnnnnnnnnnnnnnnnnnnnnnnnnnnnnnnnnnnnnnnnnnnnnccttatcaggcttggtgaagcaatagacaggacattacttagtcatcttctgaagatgtttactgctcttggaatgtattctgagagttttgaaaagccctttctggagtgtacatctgaattttatgctactgaaggtgttaaatatttgcagcagtctgatattccagactatctcaagcatgtggaggtattgataaacctcttgtatttccccttgcattttgttcacacaaaattcaggtatacttatgcaattggtggtatttcacatgaattattcagacaaggttgcaagaagaacatgaaaggtgtattctatatttggaagctaacactaggaagccgcttataacagctacagaaaagcaattattgcagcggcacacatctgcaattcttgagaaggtgattatctgctcttacaactgtaggatttgttatctggccagaataagaatgtgatggtgcattttctagttgacccattagatcaatatatagaaaagaggtgtttactttatcaatatattatatttgttggccactaatttagtttagccactgtctcattcatgacctggcatatgatgttttactgttcagggattcacaatgcttatggaagcaaatcgtgtaaaagacctctcgaggatgtacacactcttccagagggttgatgccattgagttgctaaagcaagcacttagttcatatattcggggcacaggccagggcattatcatggatgaagaaaaggacaaagaactggtgccctttcttctggaatttaaggcatcgcttgatagaatattggaggaaagttttgccaaaaatgaggctttctccaatacaataaaagagtcattcgaacatcttatcaatttacgccaggtaggccatatttatgattctgcttgacaatattttttttcctttcttgtgtactgagttcatatcttatatcacaatattttgtaatttgctttcctactacagtcagtcttcccttttatagcctgctaaactgtttgattctttgatttttgacttgctgggacatgttgatattggccatttgtttaagaactgtgctgtccttgtacatattgctttatgttggtttcctatcgcagtccagtttggctgtgatacttgataaacagaaagctcaattcttagatttgagatatgctggtaccaatacattttgtttctgatgttcattgttatctagttgcttttttgtacttaagtagatgtgtaatttatcctgcattttctttctttgtactatgttttattttatgaaagatcagctcaagcccttttttccaacagaatcgacctgctgaattgattgcgaagtttcttgatgagaaacttcgagctggaaataaaggtacctccgaagaagagctggagggaatattggataaagttttggttctgttccgatttatacaagtaagtcactaggttattttatatcactaagtttcttctttgtcagcatcttgttctttcaatttcagttatacatgtgggacacctcctttttcaactagtcaactgtataaaatagtaaaactccctatatggtgatcatattaaagaaaaacaatttccatgagcatgtgggcggatggtttaagcattgcattgaagatgatgctataggtctggtccttcacaaacatggttataatatgtcattcttatagagtcctatagacctatagtcctctgtatgaagcttctgggagaagctaatgcacataaaatttactagtacgtagtaacaaataaaagattgaagaaggttaatattcttaattatgttcagggaaaagatgtatttgaggcattctacaagaaggatctggctaagaggttgctgctggggaagagtgcatcgatagatgctgaaaaatcaatgataacaaaggtaattatttatttgctgatggtttaaaataatattttacatgccatccaacttgctgacatacttgagtttttttttttctgtttgcagctcaaaactgagtgtggaagtcaatttaccaacaagctggagggaatgttcaaggtagcaatttgctatagaagaaatgacttttgctagtatactagcctttttgcgaactcttgccctatgtatatttagctcaaatgttgctaacttatatatgctctatgcctctatccattggtggcgtacacgatatcatcaatttcttttatttggatttaatactcttgtaaaataaaatgactttggtgctgttctcaggacattgaattatccaaagaaataaatgagtctttcaagcaatcatctcaagcaaggacaaagcttccatctggcattgaaatgagtgttcacgtgcttacaacagggtaggtaacatgtgccttgccatttttacatgtgtgctggtttactgagtagcatgttctgtttacacaacacttgtctaaacctaatactgatagataggcttcttagtccatgacatgtagctggaatatgggcaatggattatataactttataataggcgtttgctgagcatgttaacatgcaacttgatattttctatcataaatgtgcatttctgattaaatatgttgcattgcagctattggccaacatatccaccaatggatgtgaaactcccccatgaacttaatgtctatcaggtcaggccatgttctcaaaactatgtttgttggcagtaaatatttatattaactgcctggaaattaatttagttttctatttttctgataggatatatttaaagaattctatttgagcaagtatagtggaaggcgtttgatgtggcaaaactcattgggtcactgtgtattaaaagcagagttcccaaaaggtaaaaaggaacttgcggtgtcactatttcaggtagggttatttttcccaatttctttggtggtttattgtagctgtaactgtctgatcaataattagaaaatcactgatttattctgtttttcagagtgtggttttgatgttgttcaatgatgcacaaaaactaagcttcctcgatatcaaggaatcgactggtattgaggataaagaattgcgaagaacgctgcaatcacttgcatgcggtaaagttcgggttctccaaaaggtgtggctctttattttatccaaatgtctaactaattttcagtagcagcttgttcagttgtcacttttattttcagatgccaaaagggcgagacgtagaagataaggacgaatttgtatttaatgaagaatttagtgcccctctctatcgcataaaggtaatattcgtcatctaatttgtgtggggtggggtgggtacgtcgagtttgggtgtgtcatcaggcttaactaaggtaatgctgtgtgtttccaggtgaatgctattcagatgaaggagacggttgaagaaaacacaagcacaactgagagagtattccaggacagacagtatcaggtgcattaaccatctaaacttgcaaacaagaacatcctttgaggacttctagttacacttgtccccgtttagttatcctcgatttttggtataagatgttagctaaactagtatgctgtgcttatgcttcctctggttcttatgtgacgccgtagaagttttaccctctatttgcactcagcacatggtagctagtttctaatctcacatgctttttattcattgaagcaacacattattgttagttcatattgttatcttacatgctatttttcttgcttaattaatgtctgcatcttttaggtttaacgtcaccattccaaacaaatttattctggaatgtttttggtgcaaatctaatgatgaattcaatcacgggagagtaatgccacaagttccttttcttgttccgtgcaggtggatgctgccatagttcgaataatgaagacacgtaaaaccctcagccacacgcttctaataactgagctttttcagcaggttagacatgttttcaacgcatgcattccattttgcgcactccacaattttgatatcttaaaatatatcgttttcttttctttcagctcaagttcccaatcaagccatcggatatcaagaaaagaatagagagcctaatcgacagggagtacctggagagagacaggagtaacccccagatctacaattacctggcttgacagcgcttgccatcataacatgaaagctcgtcgtcttcatttcattgtcagagacattgtaaagtagtaattgaatatgtctacctcttgtttttccgacctttttctccttggaagctgtagcaatcgcaacatttctgtatacaaggggaaaatgaattttcgataatatcaggcatgcatcatgcatacatgtgttcctgatgagtgatgaacagccaatattttatgccagggtctgttttggggccctgccagaaaaaaaaacatcgttgaaacgaggaatttttcttgaaccctgtgaaagttgaatcgaatttcgggaaaatctgataaagtttatgtaaggacctgttcactttgatgttattttcaatcttaccaaattttggtaatgttgctaaaaaagtggctacatttagtttgttatcaaattttgatagctatataagaaatcttgccaaaatttggtaacaaagtgaacatgccttaaaattccaacaatttaaagctatatggctcggccttacgaattttccacccaatatacatgcccagatatagcccagcccatccccatgtttaagcctacccaaactaggcttaattgggcttcatactttgggcttcaagtttgcagcccattaaacgggcccacccaagcccagtctcccctccccctccacacagtcgagcagacgcagtcgagccagctacacggtacgcctctagtcgccgtctcctcccctgtctctgggcgccctcctcctcccagatcagatcaccaccggcgcccgcttccaccgccgcctcgccccgtcgccgggggacccctctccggcgacccccttcgccgcaggcaccggcgaaggtgggggaatacctctatacccgccctagatcgcgctcctgcgattacgcttcgcctgcgcgcgcgcctgccacaccggcttgggtttttggcgcgatggatccgctcaggagctacctcgggaggctcctcctcgaggagatcaccccggtggtgatggtgctcaccaccccgctcgccgaggccgcctgccgcaagagcggcctcagcgtcgtcgacatgctctcgccgttctccctcttcaaaaaaatcgacggtgattcacctccccgatgctctccgcttccgataattgtgtgtatgacgcttgtcgcatttcattcgattgggttctgtgacctcatggggaatcccctgtatgcagtgcccgtgcggacggcgagtgaccagccttacaggctgcagatgtttaagattcggatggtctacgcttccgacgtccggaagcaggactacgaggtgattctcgaactttctggaagcttctgggttgtgctgtgggcttgttcagtatggatgcctatggtttatgaatctcttgatggacattggctgttttggagcaggtggcggatcagaggatcaagccagtagtttctgaggccaatgagagtgctcttccagatctgctttcagacccaccacagctagaagatgtacttagcagtgagatcccttactgcttcattttgttatgttctcacctgtgggcatatttactttgagcaaaattatggagccgtagttggaattctatggatcacttaaagtagcgtaatccgatcaccttgacattagaagcaaactgtgacttactatgagcagcaataatcttctattcagattgtttaatttgcagaataattttaggttataattttgcgctggtagtggaagtatctttacaaagtgatcataccaaacgagcgtgtgcattatattttggatagctcaaagttcctgtaaatggtgtgaatatgcgatgtgtttctcagtggctgtgagtgtaaataacaagggatatttgggtggttacaaacatagtgtttctttgccttcgtcatgtcttagagttgatatgaaactgaaataatagtattattgtttgctgtttgttcggtgcatcttacatatggttctttctttgctcttgattccagagcctgaagctgaactgtgccctttgtggattaagaaattcaacagagctctgatgcgtacactctcattttcagagcatgaaacattcgaccaccctgtggcatgtgagatttggaactttcgtcttatttggtgttttttttaaggatatgttcttgctcatgctttgactattgttaacaggtctgttagttgtatcatcaaaggacaatgaaccaatcagcaagtttgttgatctcttcaacacaaatcagttaccttctcttttaaatgaaggcataatggatccccagattcttaagcactatcttatacttcatgatcaacaagatggaccacaagagatgtatattcttcactcagttattatgtttacattagttcttgcatagcctagcaacctgttactaatgaacatgttctctcagttttatagtgttctctagccaaacaatgatataatgtcatatgccaaatgccaacattttacagtgtcatgtatgcaattttccccttcttttttgctgaccttcttttttcttttggtgaagagctatgaacattttagcggaaatgaagagcactcttggtttgaatgattgtaaattgttgtgtattaattcttctacagaagcagatggtgcagatgctgagaattcatggttaccttatgtaagtacagagaactacttcagattaaattgcattagtgtttacgtagtgcagccgatatgcaatctagttacagtattttcttgactaaactacagaaatctcatggtttgcacaaccaagacggagcttgttggcttaacacggatgatttgaatgaggtattgccccatttgatgaatatcatgtcatctgcttatccgtcttcttgggcatattgaatgtcatgaaaccattgtccaacattttgtagcacctaatgattcatctgttccctggtaggtattgttgggaagattagtagcctacttggtagtttttactcagtgtatgcaaggttttcatgggtatcgatgctaagaatacaaaatgaatatttctcgcagatgtatggtattagatcaatgaactttagttattcctctgtagtatccagtgtcacatgcaattattgatttctgagagccaacccatacaagatacttactagataagccgttttttttcagataaaggacttcatgcaagatttggcttctaatcatataattccctacatggagcaaaagatccgtgtcctcaatcagcaggtattttctttattccattactttttttttacctctctcaacaagattaaccattctgtttttgaaaataataataataataataataatattaagcatttttctaggtagccacaacaaggaagggctttaggaatcaaataaagaacttgtggtggagaaaaagagatgatgttccagaagctgcaaatggcccaatgcaagtggttacttacatcttgcccttttccctatataaaaattctgtagtttgctgtaacacttttttttttcttcaacaggtatacgttcacctccatagagtcacagattagagttctaggtgactatgctttcatgttacgggactatgagcttgctttgtccaattatagattactctcaacagattataagcttgacaaagcttggaagcgctttgctggtgtgcaggtgctttatacttgttttaacttcttgccttgatttacatatgacattacttatgtagtgttgttgagtttgaaataaagtagcaatcaaggtggcgattcttaaggaatatcctgggaccagctacgttaacagcctaacatacttttcacctcaaacacgagtttagaccttcttacttgtacaccatatcagaatcatactgtatgcttccaaatttaaagcacatggttcctgaatttgttttgatgattgattgagtactgaatcaagcttgagtgcagtggccaaatattcaagtaggtagtcacttcatgataatgtctgtgtcttttgcaggaaatgagtggactgtgctatttcatgttggaccagtcaaggaaggatgctgaatattgcctggacagtgcctttagtacatatctggtattcatctctatgtccacttctagtttctcagactaaattaaatggttctctttctaaattgtaacctaacatgctagctccatcgatataaatttgtgttctgtgtactgtccaatatgtcatacacaaagagaaaaggagttcctatttagttttgtatgaagcagttttccatgtctattaaatacagttgcatctgattttcaggactattgatattaacattgacttagcaaggagtgatcatatgtcattgatcttactgcgcaaatgctagtctgttgcattgttttatagtcattcatatgatatcaacagtagactcagttaattttatggagttccccagtcattaaattcctgtgtgctctgttcttacccgaattagtgccatgcttcacctagcactgttctaatccaagttgtcattggtggcatctctaggatagatgacttcctttattcccattatttttgggagctgatagttgggtgtgctttgtggcatataataaagaatgcgtgaaactagatatcaagaattgaagaattcataatttgcgattaagggctataaaggggcaggatgattccaaataattaatgctactcttatgtgtaatttcaacttttgaagttaattaaatttggaatgattgatatccttcgtgcttctctgttctttcttgatattgctctcgtttattctattcatatttgtagagaattggatcttctgggaagagaaatgctactagatgtggcatttggtgggcagaaatgcttaaaacaagaggacagtatagggaggcatcaagtgtatactaccgcgtttctaatgaggtagatctagcatcaagcatacattgataaaattttactcatattttttgcaggaagaatttttagtttattacacaacattgatggaattttctaatgttcaggaaccttcattgcattctgctgtactgcttgagcaagccgcttgttgctatgtgttatctaaaccacctatgcttcggaagtatggatttcacctagtgttagctggaaatagttattacatatccgatcaggtgtactataattatatttactgctgtgatatttaattaatgctttagaagtatattatatctttgttgagtctgaaaattcaatctttgagtgcagaagcaacatgctgttcgggcatacagaaatgctctgtttgtttacaaacaacatccttggagttatatcaatgatcatgtacattttaatgttggaaggtagttgtgtgttttagctcctatccatatatttttcttgtctataaactattattaactctggtgactgtaaactaggtggtatggagtccttgggatatttgatgtagccataaagcacttgctggaggtcattgcttgcagccatcagtccctgacaacgcaaagcatgttcctcaatgattttttccattttgttcaggttcttgaccagctccatttgtgctctcattttggtgaaccaaacttctattgcaatgttcatcttgtgttttgtaccaacagagtatggggaagaaatttgatgtctacaagcttcaacttcctgttatcaacatgccatcactcagagttatatatgaagatcatcgtacttatgcatcagatgcagatgtaagtactttccactgctgtaggactatatctagtttatttaccattcagttttccagagtaatcagacattttatttaccattgagttttccggagtaatcagacattgaatttatgatatttcctctaatactcccttcgtcccaaaatatatcaagtttttagtctttggcacgggtattaaagcgagggggaataagacttggttgtctccttgggattggtgaggtataggtccggacaagttggactataataaagccaaggggtactgtgggtagtttagcggtaaaatttacattttacaagtactgttgctatatttgggacaaaatttggactcggttgttatattttgggacggagggtgtagaatatatcttatttcttgtggggctactgaaactgaaataaaagaacaccaaaatgaatcgatgtattgagcatttctgatgatagacaattaaataataactatgagattcaaccactccttttgtttctctaacaataaatgtatctgtctttgtgatctagaaattaaagcagtctaattctaacttgtataagttgccttcaataacaggttaatgttagtgaaagcatttggcaggagctggaggaagaaatgatcccatcatcatctattgttagaactaactggcttgaaaaatctcctgacttgagaaaatacaaggattcctgtgtttgtgttgtgggaggtaatacatcttcaatatccataaatctgctcctaagtggatcaacttaacttcatctgaattttcctggagttaagctgctttcagctggaaaccagcaaaatggcaaagtaaatccaacattattagcaatggactcatggggcatatctagcgcagcttgagtgtaattgtggaagctttccacgtggaccactcgatgagatgaacagactagtttgggtgactcgtatcccctttgtcggttggaaatattaattccaagcatccatgcccatgcatttcgactttcgagagatacaaatatatatgctatatgatgtagagttaaaacaagcaataatattgattaaaactaaaaattagatacactatttcataaggcacaatcaattacatatgcacatgtgcaaagaatgtaatgtttcctaagaaatggatattgcaaagaacacttatgtctacatttatgcagccccaaatgatcttgagttgagtggtaggtgtagagagtgccatcatccagcttctccttttaaaagagtataaagattaggcctaccttctcatgacccagaagaatctgatccatccatatcacatccaacagtccaaatggaggtttgtgtgattgcagccaaatatgagttcaaactcgatctgccccaagtcactttaaaggattaaggaaaataatttatttatcaaaatagaaacgtcaacggacaatagagggaaatatggatgcatctcttatatagtgtttcaattattgcttttttgtcaattgcagaagcagtaaaagtgaggattgagcttaggaatcctctacaaattcctgttgttgtttcttgcatctctctaatatgtcagctttccaccagtttggatgcttcaagtgctggtacttcttttttctctgatctaaaattttatcttaagaaccccatatccagaaaattatgttgatcattgatttctttaatggatcacattactgtgcagtcaatagtgtgctgaccacaggtgctggggaagatatagctaacacaaagcctgcgatatcaacgtaatatttcttttttgctaattattgaggctttatttatgtatgtctttggatcccaaccttaattctcatgggtaccgatgatgtttctggtttaacactacagatttgaggatgatggaaataatttcacagtttcaaagctggacattgtgttaggaggaagtgaaactaaaagtgtatgccttctttgtcattccactttactcagtattatcgccttacaaaagttctgttaggttgcttcccattttcctagtaaatctaatttctacccttggtaaaatgatttggcgctagcaaatactgtttcaactatttctatttgtaaccatattgatcaatggtatattaggcgatcaaacaaaaaggaggaaagctttatgtgtcactttgtcatttgtcttctttgctgtttcaattactccttaccgagtggttattgtatccaaaaaagatataatagaagttctcttgtaaagccaatagtatttccattcaggacgatctgcattttatcttttggcctgatattgcttcaaactattcatacttgtggctttcctcaatttaattttcatttgcttcaattattaagtctgatgttataaattataataatacctgtaatgacaagaggcgatacttaattgactaatgtgtagttatacataatttagctgataatgttttggtaggcattataataaccagtttcctttccaattctattaggtacaacttgaagttactccaaaagttgaaggtattctgaagttacatgggataaggtggacgctctcagatttattagttggctatcaatactttgaatttgacacaaaaaggaaaactaagaaagggaaaaagggacctcgtcgtactttgagcaacaccctgattgtaatcaaggttcggacttgtccagtgctctctttcacataatttgttctgagataagtgagtaactttaatttatttccagggtttacctaaacttacggggtgtattgatcacttgccaacaaatgcgtttgctggagatttacggctactcaagctgaatctgaggaaccagtcagaatatgctgtgaaggtccaaactatatatttttgcaactctcttcccttctttttcagtaatttgaaatgatttaacgaggtttgctcaaatgagcataacttttggagcaaatttaatggtactacacaatttgaaccaactaccacaaaccacactttcaaagaaggctttcagaaaactacacgttcttcagaaccacaaaactactttttttatgaatttacactagtcagacttctgactgagaccattagtaaggtatacgtggtaatctgtgtgccatatggaccacacacacgttcatggtccatggatgaccttctggttaatgtggcaaaggtacagtggatgagtggagtagcccaaagcctatagtccccttggtgctatgccatcaggatgacaattcacaaggcagtacttggcctgcatagaaactgtcttagtcaccgtatagttggaataatatcagatgttaccatatgttactttcatatgggcctaattggtcataatttgttgagagttctatgatggtcttaaaggacgtcaagtttttgtgagaactttttaatgaaaagtgtggattttatgatggtctaagtttagttgaagttctatgacatttacactaattttgtcctttatgtaatttttcagcagcttgttttgtagtaataattcccaatcttgttgtgcagaatattaagatgaagcttagccatccaagatttgtaattcctggtgatttatcagaagttgatttcgagtttccccaatgcttaagaaagcatgtacaatcagaaattagtactgtatcgacaaaacgtactcagggagatgccaagggtttgctctttacattttctcaagtgagttggttcaagcatgcccccttgtatgctgcaaaaatcatgcatggtctctgtttctttgcaaatattcaccgtactctcttgccaggatattaaaattcaagaaggagccacgttctcctggcctatttggttccatgctgcaactcctgggaacttttctctttatatatctctgtattatgaaatggagagcccaagtgagataacttatagaacattgcgcatgcactacaatattgaggtaatgacttgtgcttgtatttaaataatacatgatttgttgcaaatttggtggattaaacacctaaatttgttgttaagggttgtaagtgggttcttagcaaagttcaaggtggtagagggggtggtaaatgaacatattccttaaaactggaaatatttttaattgcatgaaactaactgtaaaacagggttgtcatgctccacaacggagtggaccaattaaaatactcgaaaggaggtgatgggtttattcctttttagcttttgagtgtctttttttgtttaatcagcatctgtgtttttatagtcagcatttcctactctggtgtgagtttttatctctaaacaattctctgcaggtttttccatcacttaatgtgtcctttgctataagaatgtgctcatcaagattgaaagagtatattgtgcgcatggacatcctgaacaggactccctcagagtcatttattcttcatcagttgtcatgcaatgacagtaaatgggcaatttcatcgttgcctttgtgcgattctatccgctctattgaaacagtatcagcaaatcagtctgtgtcgtgcttcttcaagataaaggtaatacttgtagcataccatgtcttccaaatctatatattctttttttgcccattacattgtagagtttaaaactgtattatattttttaaaatgcatctctttttttcaggatttaggtacaaattcttgtaaagaagctgaaaacagttcttgtagaagtgatatgctttttttatctcgtgagggcaacagcaatactgaggagtttgatgtttcccaatctcctattaccaatttccactatcaagagagataccaacagggaaggttggctaaggtgagttctgttaaagactataaaggcatttgcacccacttggtggtactttttccagctgtcaaggatttgttaccctaatcttcaagttggaatcaacaaaatttggctcgaaaaatgatgagaaattggatgcatatgtttttgttttcatacagtttaccatcacttagtcaaatgatgacatatatattggtgccatcactgtccagggaccacgggaccttcttgattttattctgatctcgaaagcagtaggtggtaactattccaagtcagatccagacgttcaactactctctcatcatgtgtgccattgcaggtaagtgctagattgtagaacctttgttacgacaaattctgttgggctctggactttaatgtgctgataccatctgctgtttctcagtgctatcgaccagagtcctatatggtggtttatggaagggcctagaacagttactcatgatttctcaaagtcttactgtgaagcaaacatccagttggtaattcataatactgtgcaacataatatttcagcgagagtagttacctatgacagcgtgccagataaaagccaaactgtcaatttgcaagattctaatagtaatcagggtggatggtatgatgtatcgctggaaaatgacattaaagctatctctactgccaaggggacacattatcagaaacagccatcagagagcatttcaccttttgtttggtgttcattgagttctgctcaagttgacctgaaacctgacacttccactaaagttcctctaaaagtgtgcatatttatgcctggaacatacaatctttcgaattatcagctacaatggaaagtgcattcatccgaggtaggacaggtggatgaaaatcaaagatccggtggtggccaagggcatcctttttatgtcactgttcttcaggatgcttgatgaactgcaaggaaggatggtgtgagacagtgagacaaccttctcatgaagaaactcgttccttggatgctgggtaaagatatacaatctgaccaacccaaaccagtggagtggtgactggtgaagatgtgtacctgtaagttcacggttgagtatagaatgaatatacatggattccagtttcaatactagcacagttatacaagttcttttcaagggtaattctggcgattagatgtataccattgtcggtgaaattttggtgctaggaaggatgcagacaacaaaagctttggtttgccgattgttgctgtagcctataggttcttacattgttcttgtaaatccttgtcaactttgagacaactcgcagatgcagtatctgtccatagttttcagtcatattgtacttttgaggaaattagatacttgagacgctccaagggcggcagttttgcctggctaattgtgatgttcatcatatagtgttgctttgaatcccagatcatacgaagttattttatttccattggcttagtttgtttgccggattatcttgtgatgtttttataagattctatataatagaaaatgatttgcggttgtcttgtttgatactttcatctactaacagtctccaagctgaaaccggaaaatgcaagttcgtgactcttgcacgttccagaagtagttcagctaatcgtgactgtacctttgacaaaatagcatcttgttttatttgtgtatttatgaatcgacagcctcttgtagccttgcctctagaagtccagcttttttgcagccaagtacttgtaccaacaaaatgtatcctcgtgttcagctgatgcagtggaagtcctaccaaatgcagagattttttgtcttgtgctgtgttttcgtgtgccaaaattttttgtaagtatatagacacatatttaaagtattaaactgtatactaataataaaataaattatagattccgtatgttaactgtgagatgaatctgttaagcctaattaatctgtcattagcaaatgtttactgtagcaccacattgttaaatcatggcataattaggctcaaaaaattcgtctcgtgatttacatgcaaactgtgcaattgattttttttcgtccatatttaatatttcatgcatgtatctaaacatttgatgtgacggaaaagttgaaagtttgaagaaaaaagtttaaatctaaacatagccatgaatgcaaaatccacccgtacctccattatgcttcacctctgcttgaacaggtaagactccgtgcatttacatcggccatgttgtttttattattactccctccgtttcaaaatatttaacaccgttgattttttaacacatatttgaccgttcgtcttattcaaaaaatttaagtaattatttattttttttcatatcatttgattcattgttaaatatactttcatgtacacatatagttttacatatttcagaaattttttttgaataagacgaatggtcaaacatgtgttaaaaagtcaacggtgttaaacattttgaaacggagggagtattatttagattttagatttttgtttgcatgtttccctactaaacggagtatttgatgccaaaagaaattctatataaaattttcttgaaatacttttctaaaacaaaatttcaactctgtagtagtagttaattttcattcgtttatatcgcaaaaatcatattatccgtcaattttctatatattgttgtgtctgtgcaattcagtgctgccccctgaagtgttccttgcaactctgtacaatctatgagggttggataagagcacccgcaatggtaaagtaaggtgctctctataaaacatgtacatctcagcaatagactagattaatagtaaaccacctcaatagtatgtctacatgggtatctatagctctctcatgtattgtctcgtttttctctatagactatctctagtttagtagatagttttgctctatctcttcatttaatatcttgcaaatagaaaaatatactgacgtggatctcttatagagagtctatagataaccattgcgggtgctttaagtgaaatttgcgcatgcacatgtgcgtcagttgctagaatcctcaacagcatgcaaagctcgtaaagcaaaacaaggagaggtcaacggagagagcacatcaacgcatcactatggtaatcccagagtgagtagtactagcaataataatagtgtcattagtactccctctgctgaagaaagcaacgccttataaaaaattaaaagaagttagtagtacgaaacaaataagacgtcaacgccgtcgacatccaaatgtgttactttctctgttataatatgtaacagcttttaaatttattatatcttagtattataaatctgaacatgtcgtttatattcataattcttatattgaaatggaaaaataaaaggagtattatagtacatgtgaggtggggcaatcaatcaaaaggcgtcacgttcacgtccttgtgatcgattgagacggtcagcgttgccgccttgggttggcctgacccggtttggtttgtagcgtggtaacatagcatagcaagcagaattgcgagggttcatccatgattggcagtttggcatgtgataactgagacatccaacggtggatgacgaccagtaccaactaccaacccagcaagttgtataaacgaagggcccctttaaatcacgggaataaaaaaatgaaggaataaaaaaatataggattctaatagaaatgtaatgtaagtgtaaataaaaaaaatataggattctaacagaaatgtaatgtaagtgtaaaacagaggattgcaaaacacaagaaaaacatagaaatgaccgtttaattggaccacaggaaaaacacaggaatttgaggagagataaagactcgaaggattttttccataaggttctacctcttgttaaaattcctccaaaacttatatgggaagaggcattccataggaattttataggatttcatagggttcattcctttgattcaaagggctttgtaggaaaaattcctataggaatgaaatcctctaaaagaaaattcctatgaatttcctttgaatcaaagggaccgaactctgcaactgatggaattattatgtatataggccgagtttacttccaaactttttcttcaaacttttaactttttcatcacatcaaaacttttctgcacacataaactttcaacttttccatcacatcgtttcaatttcaaccaaacttctaattttagcgtgaactaaacacacccatacttggttttattttcggtcttttgttctctgtcctttttatattgtcgtggtcaagtcaagctgcacacttgcatgcacaggtgcccttgctcgctctggttgatccggtcaaaaacgaccagctgaatgatcgcctacggcttatggctgatcctgatgccatgcatctccattctccagtcttacaaactccagtagcagttttataatactaccagtagcttttttttttttactcttgacaaatttattggcatgatttgaagtttacagttacctgataagctttcataaggccctttttatacggttcgggttccaagatttttcggaaccggtaatttctagttttacaaatttatgatctaataaatcaaccattacattgctaatatttagatatatcattttatttctattttaaattaattttaaaatttaaaccattatgatttaatgtaacgtacaaagttcaaatatgtcgtggatctggagttgtgcaaaacatgacctattttttttcacaaaataaaatgaaatccgtgctccgtttcatagaaagatatttaactatttgtcagtcttataaatggttaattaagggtttgtcaccggatccatataaaaaatcgtgagacgtaaattcttaattatcgcatctttaaagtggtaaaaaaaagttaaatgcaccggcccctctgaggttgcgtggttaggtttgaaacaaagcacaatctggacgcccccggcgcgccaccacacgccaccgcgtgatcaagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtcgccatttcaactccatcctcgcgtgaacgagacgagacccctccgaccccttcaactccgcgtc

SEQ ID NO: 24975 - DNA, 3520 bp, Oryza sativa
  unsure (1)..(3520): unsure at all n locations
nnnnnnnnnnnnnnnnnnnnnnnnnnnnnnnnnnnnnntttctagttttacaaatttatgatctaataaatcaaccattacattgctaatatttagatatatcattttatttctattttaaattaattttaaaatttaaaccattatgatttaatgtaacgtacaaagttcaaatatgtcgtggatctggagttgtgcaaaacatgacctattttttttcacaaaataaaatgaaatccgtgctccgtttcatagaaagatatttaactatttgtcagtcttataaatggttaattaagggtttgtcaccggatccatataaaaaatcgtgagacgtaaattcttaattatcgcatctttaaagtggtaaaaaaaagttaaatgcaccggcccctctgaggttgcgtggttaggtttgaaacaaagcacaatctggacgcccccggcgcgccaccacacgccaccgcgtgatcaagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtggccatttcaactccatcctcgcgtgaacgagacgagacccctccgaccccttcaactccgcgtctcctcctcctcccccctcttaactcctccctcctcccgatccaagaaaccggagcaaatcgtggccgatcttgtgttctagtgagttgctgcagccatgaacaatctcttctctagctcgtggaagcgcaccggcggcggcggcggcggcgacggggatattgaatcgggcggcggcgtggagatggcgccgccgccgggggcggcggcgggggcgagccttgataggttcttcgaggacgtggagtcgatcaaggacgagctccgcgacctggagcggatccagcggtcgctccacgacgccaacgaggggggcaagtcgctgcacgacgcggcggcggtgcgcgcgctgcgggcgcgcatggacgccgacgtcgccgccgccatcaagaaggccaaggtggtgaagctccgcctcgagtcgctcgaccgcgccaacgccgccaaccgctccgtccccgggtgcggcccgggctcctccaccgaccgcacccgcacctccgtcgtcgccggcctccgcaagaagctccgcgactccatggaatccttctcctccctccgcgcccgcatctcctccgagtaccgggagaccgtggcgcggcggtactacaccgtcaccggcgagcagcccgacgaggcgacgctcgacaacctcgccgagaccggggaaggggagcggttcctgcagcgcgcgatcgccgagcagggccgcggcgaggtgctcggcgtggtcgccgagatccaggagcggcacggcgccgtggcggagctggaacgctcgctgctcgagctccaccaggtgttcaacgacatggccgtgctggtggcggcgcagggggagcagctcgacgacatcgagacccatgtcggccgcgcgcgctccttcgtcgaccgcggccgcgagcagctggtggtggcgcggaagcatcagaagagcacccgcaagtggacctgcatcgccatcatcatcctgctcgtcctcatcctcgtcgtcgtcctccccatcgtgctcaagttcgtcaacaacaacaagagcagcagcagctcgccggcgccggcgacgccgtcgccgccgccgccaacggcatgatggtcgtatgatagtccatgttgagttcatacttcatagtgagagatttctatttttttgtcgggttttttctttcgtgattgtaattacttctgtatgattagttgatcgtcttgattattatacatatctgattcttctaaatatcattgcatttgaaactgcattttatccttttattcgagcattcgactatgtgcgatgcaattcattctccagaaaagcagtaaagtcataggcgaaaatttaaggcgtgttctaaaagaacttatgaaagatatggattatttgtgttatgctcaaacgattttctcagagaaaattctgcatcagcattgcttatacaacttgttctagctatttttttagcattatactaactccgttttatataagagataattttttcgcgaacgcacaaatttataagagataatgttgatgccttttagaataacgtttaacaattcgtcttattcaaaataaatagtataaacatgttaaagtataaaacatacttaaagttctttcataataaaacaaatcacaacaaaataaatgacatttatataattctttttaataaaacaaacggttaaataacatgccaaaagttaacggtgtcatctattaaaaaacgaagggagtactataaaatatttagttcatccttacaagtaattgtagctaagaagtccaatcattccgttagaacacgccctaactgatatatcgtctcatataaaaccaggtacatacacagagagctgatttacaaaatttgtcgtcttttttttctttacaaacagcaaccactggactatatataaatagataacattattaccttaacacgaaactgacatatacaccaagatggccgaagagaaatgcgagctcgaaaaagctagaagaacatgctggagctagaagaagatgctgaactggctggtgagtgagtccttgaggttggagaagagcccaaccagggagtactgccggagcttggacacctcataccacgagttgaggacggcttcgtgcttgtcagtgccggagaaggcgagctgaatcccggggctgcaatccacgctgccgcccttgcccgtgcagttcgccgtgctgatcgcgcagttctgatcgacgcaggtgaaggagggttgcccggagcaagcagagcagccgttggctttccagtacaggttctgaagtgtgcctttgttgaactcaaacacctaagaaacagaattcagttggtcgaatgatcagttggagaaataggtgaagatagaatgttcagaatgcagggtgcgggttatggatcgcaccagggtaaagctggtcacggtgtatgagctgttactgacgaaaaccggaggtgatcttgctgcatatttcctcccagcaaaagctaccatgtagccaccagaagttgcctggcacatagcaaaatagtggccaattagaaacacaagtggcttcattatattgagctaaaaacagttaaaaaaaaggacaatcatatgaagaccaatcacttatgggtaagaaagtaccactacaacaatgctaaatgcttcaaaagatggtgtgtggtttgctggccgaaacagtgaaaaatgtgcgcaacagtttgccattaaccgcaggttaccacagtaatcttctaacagtacaacaaaaaccattcttacgnnnnnnnnnnnnnnnnnnnnnnnnnnnnnnnnnnnnnnnnnnnnnnnnnnnnnn

SEQ ID NO: 24976 - DNA, 10947 bp, Oryza sativa
tagcccccaattagaaacacaagtggcttcattatattgagctaaaaacagttaaaaaaaaggacaatcatatgaagaccaatcacttatgggtaagaaagtaccactacaacaatgctaaatgcttcaaaagatggtgtgtggtttgctggccgaaacagtgaaaaatgtgcgcaacagtttgccattaaccgcaggttaccacagtaatcttctaacagtacaacaaaaaccattcttacgcaatagcactgcttattcttgcaattgagaatttgacatgctatggccaatcaataggagtaactttcgtagtgtaatatgaacaaaactgcgatcaacaaatcaggtagaaaacagaaaatgatggcctccatcgtgatgattagcccttatctaaaatgtcaagcacagctaaaccattttaacacatgttggtaattaaacaatcggtagtactgtagcttctctatgttcaatcaattagaataaaaatttccaaaccatagagcacaacccattgaataatttcatcatcaaagcagataaaccgacacttggcccacagaaaaacagagaagcatgttcatgggaccatttccatctgtgttactagagctcctacaaagagtccaaaaaatggtgctgtatcaatccatatgggacacataatccagctccccccaacttttgtcttcatcctccccaagcaggtcgtgattgccaatgttcatgacaaattgacaattcaccggcaagttcttcgtttctctgtttctcactaggcaattagggtgtttgattctaactaaaacctattgcatgacgaaactgacagcataaattctttattgaaaaggaattgtgtctatataaaattagataaaaaagaagaaactagaggactagttctttatgcgtttatgccaaacttcgggttcctgatatacgcaaccgtgcagtcagttagggttcctcgtgtgtatacaccatctgacataaaaatcgacattaagcatgaaaacacgaagcttctagaggtgaaaagtcgaccagggccttagttaccgggtcgaagccaccggcggcggaggtgttgacggtgaggagcgaaatctcgtcgacctcggggcggaacaccgcgagcttggcgcccttggacgccagcgacagccttccgtcgcagggggagagctgcacgccgccggagaagaagtcgccgcgcgccgcgaaggccacgccgaaggtgaacccgtccccgcgctgcaccgccgcgtccgcgcacggctcgtacacgccgttggtgtcgcccccggctgccaccgacggcgcgatgacgaggaggacgaggagcacggacgccgtctccgcgcacgcgcgcctcgacctcgacgacagcgtcgccaccgccatggccggcgcgaattgggtgcctcgggcgcgacgaggtcgttgacgagaggggctttggctttgctgttgctagttactacagctcacgaagaaacgcgtcgtggggaggcaaggaataaaggctaaaaaggcggttgcttgcttgttgggctcgctgcttcttaggccccgtagtcctcatgggccttgtgtacttctatctgttcggagataaaactaattattagtattagtactactttggggaaaaaaagaattatttttaagggcttggtaaagcttgtatgacccgtttggtaaagctctaactcttaaatttaattttagaagatagatctgtaaagttatggagcagtctaaacctagcttcacatctctagttcattttgtgatagcgctccaaccaactccactcctattttaggtagagttgaaactatttgactggattctagctccagaagaggtacagctggagccatgccaaacagactcttacttcaagattcttgttccatagagttagagctgaatcaaacactttcaagattctggataatataaattgaagttgttcttcctaaaaaaaattatactagatgaagcggtggtagtatatttttgctactagaatatttcaattattagatagagaaaacccttttgtaattgatgttgtaatttgttagagcatctccaacactctctctaaattcgactctccaaatatctatttggccaactctccatctcatttatcaagtcaaatttgttatttactccaacagcttcttcatccatcctctctattttgagtctatgacagcagtacccatgcatcagcctctatacccattcttcctcatctttctccccctcttcctcttcctctctctctccctctatacactcccgagacggctggggacagtggcggcggtcggcgcagacagcggcggcagtcgcggctagggatggcggcggcgggcgcggctggggacagcgcgggcgcgcggcggtaggcgcagacggcggcggcggcggacagcggcggcggggacggcggcagtgggcgcggctggggacagcgcgggcggcggtaggcgcagacggcggcggcgggcgcggctggggacgacgcaggcgacggcggcggccggcgcggttggctccggcgcctcgctcctccatgccgtcgccgtcgtgcggttcctagccgtcgcggacgacggcggcgggcgcggccggcggcggccggtgcggttggctccggcgcctcgctcctccgtgccgtcgtcgtcgtgcggttcccgtcgctgccttcttgcgggtgcgacggggagagagagatggggtgggagggagagtggtggggcccacgaatagccaggcagagtgactcttgactctccaagttagtgagaggtgcaatttggaggttgttggagggtattttttctccatacttgctaaattttaacttggccagccatttggccattctatgagttgctcttagaacggataacttttcaatggcaaaacaatagaatttctcaaagggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttaccgtgtaagtttcataaattacactgtaacttacaagaaaatgcactgtaaatttgagtgagaaaatcgagtgagagataagaaaaaatctttcgagtgagatatagcaaaatcgtttctcaaataaaaactgtaccagtagcatggcatggaccaacacgattcataggtacaccaatcaaaaacacaaagttgttactattacatagtcttagttacaccttacaagtactacaacactaaacaaatagtaaaactctatatgtacggttccctcctctcagacacatatttgtacttctaccaactggtctcatctctcatgagatggtcagttgagcctgcatatctatatggccaagaaaagctgcgatgaatgcaaagcaaatttcttgaaatattggatagatcatcacagtccaaggctgccaatatatccatgaacgatatctcaggtgaaaatgttgccaatgactatggatgctctttggataattggattggctgtcaagtctgcagctcaactcttctaggcaactcaattgaactggcaagatgatgtttagtgacctttagggaccggttaaccgcagatttattcgtcatgcgcttgcctgcttcgacacctgagagttagggaaatttggttagaaaattgcaagtgtatgagtttgagccttaagaaacattgtatactagataaggtcagttatgtcacaaggaggagaaaaggcttaacatgaacacatgcagatgatgcgagatttttactcacagctggcaggtaaggagaatctcttatttccttgaggatctaaatgcccagtcctctccttaggattactactcgacctagttccaagtcccgaaggacgagacgaaatttcatcacatccttctctggatgacagtttcagttttgacttagccgatgccgaaccaccagaccggttcgatgaggaaccaccgccctctgagtttggtaggcaggtcttctggttcagtatgtttgaatgaagtgttgaagtttgtcttctaacatgtttcttatgtggagtatagacagcattttcctcgtcttgcattgctccactactaacaggaattccatctgctgcataagagcccaggaatcggctctcccatggacgaacagccatccatctctctagccaattccagccccagctgttcttgtcaggttgaaatgctgtaatggctgcatgttgccttgcttgccactgcgaaaggaggaaaataggttcaggtgtcaagttttttaatgacctccctttaagtcttattttattatcagaaatggaattaagccctcaaaaagtatggaagcacaccaaagaccaacacaaagtgacttgagatgtggccacaactgatgagagatcagttcttacagagtcattgggacagtgtatctgacatcaatgatgggaaggactagaaaaattcttaatctactacctgaaccaatgaaaacttttagagatatgaattcatcttatttctggaaggggttactgcatgaaaaaattatttgacctcaaccacatactggaaaaaggctcccttttcttacttctccaacatacggtgaactgtctaaataatttcatttatcatgattggattctttttctccagaaggagcatgcaaataggtctcatcttagctacatactgaaattacaattaaacgctaaccaacagaagcagaacagtacagaaagtcggaaacaacaagcagcctaattattaggctaacttggagggagagacaacatcatctgttatccatgaaagcaacgtttggaatccagcaatagcaacttagcaagcatgcttgttgttacatgctggagatgacagtgagtcgattactttcatgatatcaagaagctatacttggatgcagaccaatttgattggtgcactacagtatacgctataatccatggttcatatgattaattggataatcatagctgagtattgtcctggtgtaaaatgtttgataaagttacctggtgagttagagcataggccatggctcgttcgcgtttggctgctgcctcctgcctctttaatagttttgcttggatatcttccacagatcctatgctatcacaccaaccatcctgcatttttaaggtaaatagcataagtaaacaactcaagccaaatcactgcactttcatgccagttatttccttgtgaaaattgagaagagcatgcatgcaagcctacctggaaaactactgaaagtgcgactcacctcgatttcccgcacatgtgtctcatttattttctcttgtagaatagcttgctgatccgtctggctttccaaagcaatgcgcactcgccttgctctaacacgggcttgaaccctcaccaaagcttgcatacacctgagtgttatagcagcttgctttctcactatatgaccccttacaagggcttgaagcctaactagtccttttaaagcccgacgggctctcctagcctgaagagaattcaagttaaacttgtagtaaagcctgaagaaccaaacatttgggaatcatgggaaaatccataattccatttcagcaattctatgtttgcatatactttgcattggacttggactagttactaaattggcagagagagaaagagagagagcatcaataccaggaaggctctaaacacagtctgaataactgtagcagcccagatctccttgagttcttcttcagtctgaggcacaggcacgttaggtgaactaaaagcgggttccgagcacgaaagtgcattgctatcaccttctgatggaccattttcatcaggaaactcttctggtgctccaaggttatcatggtcttgaccgtgctgattttggcagtgaaaatggttagcaccgtcccttttctgcaatttcacagttcacaagttattacaaacccagccaaataaaaaaaagttattatatacgaacaatgcaatgctaaattgttaacacgatggtttccatttctttaaaaaaaaaaaagacatagtggtttccatctttcaacatttttgtcagtggcatagaagccaaaaaaaaatgatgcagatattatcatccagatctgcagtaacttcataaatttacacaaggcaaacaagcaatgcaagaagtaccaactgtagtcttaatttagcggagaacgaataccccaggttgatcactacaacaaagaattccccatgacatgatcaagattcacttccccatttcttttcagcaaattgttgtcgaattttaacacgaactaactagtcgaattcccggctacccccatcaaaatcaaccaaaaatgccaagaaaaatagaaggacaaggagcagaacaatggatgagagaacctgtgctactcgcccaccatctccatcctccttgctctgctgctgctgcttctccaccttcctcatcccaaccaacgacttgagccacctcgccgagatgcccatggcgccgcgcccctcaaccgagacaaaaacctaaagccgcaatctttctcatcagcaaccaaccaatccaaacctcaaaaatctctccacaaaaaagaagcaaaacaaaatcacccaaagaacacgcaccaagaacttctaggtgcgtgttcttcttggcaagaagagccgtgcccgcacaccaccagatcgcggcgagacggggccaagaaaacggtggtcgacgctggccacccaatgagcggcgcgccttgcagatcaagggtggtctactctactcctcccggtcccggatcatcacgccacctcgctactactctactctactagtagtggccaccaccaccaacacccgggaacccggccattactgccgcagctgcagctgccaccactgcgtgcgcattattgctgccatcggtgggcttgtgcttgtgtgcgtggcagtgtggcacgctctgctgctgctgctgcagagaggaggatgagattgattagctgattagtagtagtactagtataaaaataagcaagaaagcaccgcgcttttcttgcgtttcactttccgcgccccccgttgtcgggaaagccaagccattgctgttgttctcttttgtttaccctctagtttttcactgcatctttgcctggctttcggacaaagtgatctttatgatctgaaagagaaagaaattctttggtagtatagtactcgcaacaatggaatttcagcaattagcgatgtgctcgcactgttcgagctgaaagctgcaaattcggagatttccccgtggaatttcagtcattcggactaattgagtcattcagactagtgcaaactacgaatttttactattttactaccgaagtgtgcactgtgcaagatggatttgctttgtcaggttaaagatctgaaacatgtagttctacgttcgtgctgctgctacaattattcacatttattgttttctacatttactactagtaggtttttacgagtgccaccggtttataactgttcaactctgagtgaagaactattaccattaccgctccatcaattaaacatgtcatggcatttagtatcacttcttttcaataatgtcttttgctacctcataggaagccgagagctgaatcatcaactgctaccactgcttccctacacaggcagaggccgcaggaccacttcagagttcagaaagttcagagattgtgatcttaagctcaatatctctaattaaatccgtttatctgcctcgaattaaagtcacttaaaatgagaagatttcaggttgtttggcaaaatgcgaatttattagaagtagatgggttcagttggcaataaaatgggatatctacatgcgagtcaccaccgaaaactgacatgacaccagtgacagggcgcatgatggttatggatgggatgttcataatgccgtgctgaactctgttttcgggtggtttgcataagtaatcacgtgattaaattggaaatgttggcattagaactcagattaatagccggtgttcagaaatgaacagagattctctagtttctacagaacaaggatcttgattgagtgtcatgttacctgtcctataccatgacaagctattagtttatccaccgaatcttttcctttgtttcttcctcactgaaaaacatactcctaagtttttcctttcagttttttctgagatattctaagataaaatgtacgggagtactttagaatttggattttggagggtgtcaaattcaaatccatgacatgacaaacgggccaactagacacttttaaggcaaaacgagctgattgcgctcggatatcgtacgggactaacaagctttaagaaaaggctatcaacagagggatgtcttttaaccgtgagatgttggggctgtttggttctcagccacactttaccattacttgccaacaaaagttgccacaccttgcctaaggtgaggtgatcaaattgttagccacaacttactaagcctaagggaatcttgccacacttttttgagccattgacatgtgggacccaatttgttggaggggaatcttgccacaactgtaactacaaccaaacacctgtcaaatttgcctaaccttaggcgtggcaaactgtggcaaagtgtggcttgcaaccaaacacacccgttttaagtgacatgaaaagtgtataaaccacagcgccttttgcagaaaaaaaaaactagagctcaatgtcatgtgtcacttttcttgtccaatgcttaggcttttctacgacaattgatctagaggcctggtttagttcctaactttttcttcaaacttctaacttttccatcacatcaaaactttcctacacatataaacttttaacttttccatcacatctttccaatttcaatcaaacttttaattttagcgtgaactaaacacacccagagtaacaaataacactgtaaagtgtggtaacttaaacagtataaactccatattttttccattttgttaatccaatgtgcattgtcccttgaggtataaccgtagaacttcctcttttacacgtggtggaccatagtatatttattttgctagaatgaccatcctgatcgtactccgtctggtttaactatgtactgtactaagttaagagcctcattggttgccttaataagtcaaagccaaaactaaaatttaaatttccaaacttaattttaaaattgattttaagatattttcaacttagtttcttttatagtgttatttaacttttaagtcaataagagcacatatataaaagttttacctaaaaactaatttttattttctaatgagccattttggcttattagtaaatatgggcaaccaataagaacctaaagtatgaggaaagtagctcgaataacaatctgctctttcacttatatgaaataagattgggtaatttttacagtgtgagtcaccttttacccgcaaaaaattcgctttggatcaccctatatttgatctttacacttgagatatgtaatttttcctttcttacactccgaactatcttgaactttcttctcgagcgcatcaatgcctttaagcgtattggcggctacatgtcggtaatttccatgcaagcaaccctttatcatatgagagactatatgcgactcgagaacagagttatggtggtacaaagcgaaacaaatgcgaatttaccaagccaaaagtgaaaatattggatttaaaatgaaaagttgcatttaattgtgtgattagaaaaggttccatttattcagtgaggtcgaatagaaggccagtgactcaaacaggaaaaaaaaattggtggtatgcaagtggggtcgagggaggatgattataatctaaccatcatggtttaaattctcgtgtccatgagtattacacacttatgaacatgtgtttagtggggtgaggcatttgtcgctatctccgtcttctatgtgcaaatgaaaaaaagcgtcacaaatctctcttcaatggagaaaattatctcgtcgcttatgaagcataaagtttcttgtaaagaatttaaaaacagaaaaaacacagccaccatttttgcatgatgcacatataataaccatgaaaaagatacgaagtgagtgtagctctattagtttggttcaagtcctagatttgatatgggtgatcgtatttacggctatctattatttattatttcagtgctaagcaatgttaccgttgacggtgaggcgcatatagtgacttcgtcaatctcaatattttataggtgttcttagagatagagtgtgcgtgtataggggaaattgtgcgcgcgttgtgagtgtccgtgtttattccatgtttctaaaaaaaacatgaaaaaatgaatataaacgtttttcacataatgcacaaataataatcacaaaaaagtgaggaaaaaaaatcctataggagtattcgaaaacaatttaaatccagggaaacttgataaaaataaaaaaacaaaccaaccatattagtagtatactttccttgccttttctcgacagcgcaaggtaagcaagcatcgccaaggcaagaaaaaagaatctctctgaagagagggaatctccttaccgggttgctcccgtcgcaccggacccgacaaacgcaaccaaaaaaaccggagtcaagtcaacacgcgcggacacacgcgcttcccttccccggaacccgcattgcctctcgggtaccgagctc

SEQ ID NO: 24977 - DNA, 8221 bp, Oryza sativa
agtcgcccttccccaattgcttgcaatcaacgaaaaccatgtgaacgtttagatgcaattccattactggttcatatatcgaaatcatctatggtttgaactgtactattcattagctgttgatgataagttgcccttcctcaattgcttgccaatcaaccaaaaccatgtgaaccttagatgcaattccattacttgttcatatattgagatcatctattttttgtatgtttttaactgtactattcattaactattgatatgcacatttaggggctttgctgatgattatgacagattagggtcttggaacattcttgttaattcagctaattgatagccaattctagtgataagtagtattgagaatgatgtgagatattgttcatttggctgatgcaaacattacatcgtcacctgccaagtgccaacctgattttgtattgcgagtttgtgaccatgtgtactatctatcctgcattgtcatagttaggagcctagttactgtggcatacaggctggtgtgttctattatatatattgttttacctcataattatcgctgatatcttatgagtaaactggttaagctttatgagtactgaattgccaatgctttatctggttaagctgtatgatggggacaatagctttcttgatgagatggcaaactaaaattcttgccttcatttcagttcaaggaattggctcaggcttatgaagtcctgagtgaccctgagaagcgtgaaatctatgatcagtacggtgaagatgctctcaaggaggggatgggtcctggtggtgggatgcatgacccatttgacattttttcctcattctttggaggtggctttggaggtacgagacatgagaagcagctcaattcaacctcctggtgattgtggtttgcttagattttgactggctctcattgtggtctgcaggtggtagcagtaggggcaggagacagcgtaggggagaggatgtggttcaccctctgaaggtttctctggaggaattgtacaatggcacatcaaagaagctctccctttctcgcaatgtgctctgctccaagtgcaatgggtatgtcatcagcttccttttgtgggtcctaaatattgcataaactgtttgactattctgatatctcacactgttctgtgctcatcttgcagcaagggctcgaaatctggtgcttccatgaagtgctctggttgtcaaggttctggtatgaaggtccaaattcgccagttggggccaggaatgattcagcaaatgcaacatccctgcaatgagtgcaagggaactggtgagaccatcagcgacaaggatagatgcccaggctgcaagggtgagaaggtggcgcaggagaagaaggttcttgaggtggtggtcgagaagggcatgcagaatggacagaagatcaccttccctggtgaggctgatgaagcggtatgtctgtgttctgactcctcgcattgtacagtacatggttctaaggtgtagtactccatgtgcttgtcaacactgttactgaccaacctgtgctttgtgcagcccgatactgtcactggagacattatcttcgtcctccagcagaaggagcatcccaagttcaagagaaagggagatgacctcttctacgagcacaccctgaacctcactgaggccctttgtggcttccagtttgttctcactcacttggacaacaggcagctgcttatcaagtccaagcccggtgaagttgtcaagcctggtgagtctcccttcaaagaaagatcaccatagagtagcagcattttggaaaccatctgattgtttttttaagcattcattttagaaactattttattgtttactcatatcggccgtcatcttgtcgcagattcattcaaggctgtcaacgacgagggcatgccgatgtaccagcggccattcatgaaggggaagctctacatccacttctccgtggaattccccgactctttgaaccctgaccagtgcaaggccctggagaccgtcctcccgccaaggccggtgtcgcagtacaccgacatggagctcgacgagtgcgaggagaccatgccgtacgacgtgaacatcgaggaggagatgaggaggcggcagcaacagcagcagcaggaggcatacgacgaggacgaggacatgcacggcggcggcgcccagcgcgtgcagtgcgcgcagcagtaagcagcaagcagcgccgtgcatacatatctgcacggctttgacggcggcgacaaattgtttctttccgctctaggggcgataatactatcaagttttccatgttaggcatatgatgatgtgatactacttttggtcttttatactgcgtattaatgacgtacatcaaccggacctactggtccatgaaacaaaatctctactgcttctccttcctgtgtgtgttagtgcgctgcgttcttcccatgtgtaggatttgctgcttcctcgagatgagcagtagcagatggcaccgcgaatggaactgtcaatgcgcaatttgactcggtgcaactcgttgaggctcggtcatgcactgtgtcagggcccccggtgtcgggatctaacaacatggaacatgaaagaagaggctcctgcttagcaatggtaaactaaattgaactacaactgcaaagatagtgagagactacaaatcagacgcccaatttgttcctaaaaggaacaaaatcgtgcgttgtttcatttctagcagaaaaaagtttcaccactaaataaaaaagttccaatctattaaatgttgtgaatcatgatagcagaaaaaagtttcatcactaaataaaacatttgtgaatgatgatagaaacaatccgttgtaacaaacggaacatcgagcttcagctgctaaaacagcaacgaatatgcaagaattgatgaaacaagattcaaactactcagcgaaacattttgattccccaagaaacatcatacttacattggttgaaacattgaaaatcagaaaaatgcactagtctagattgggttccttcctcttctccagtgatcacattttcctttggtctccgctgcagatctagaccgggacatgcgaggctcttctattccgccgaggtgccgtagccgccgctccacggagaccccgaggcttactcaccccgccgttgccggtcccgagccatcttagtcaccctgccgttgctggtcccgagtcatcgtcatcattcggatgaacaaaaactccgcccgccagatagtcgcatggggaggacgcctcgttgctgtcgaatggtgagctatttcgcttgatcccctgcaaggatcatcgagagagaaagaaagatgcatagaacgagcggataaaggagtgagagagtggataaggggggactagaaggctcggtatagttataaagtggaggtgggcctactgctagcatcgcaacatctgatcttttttagttgtatcggacgatagatatggagctttatcacagagataatagctatttttttaagaatgggataacaatcgtttattcttgtaaaatggataaagaaaattatttcaaattaatttcgctgaacatctactgaataaagcactcatgtaccatccagcaaattaaggatccaccataaagcaaaagaaggatcatggaaaagtaatggtaatgtgaacaactattatttggctctcccaaattctcgggagggacaacaccgcagcctcccgtggaacggctcttaggcttgacggtggactttcaacattgaggtggacggcggtgacaacctccctagtccctacaacttaggcttgacggtggactttcaacattgaggtggacggcggtgacaacctcctagtccctacaacttccagcattgaggtggatgacgcggcaacctggttcaaaaggatgcaacaccctccctccgtcttagagatggaaggcggcactagcacctacactaccataacattaaatttcactttgggattacctttattaccggtgttccattttaaatcaccctttaatcaatttcactttaaacatggtatcttcattttaaaaaagatatcttacctttatgagaccatactctaactcttttacccatctacattaaactaatcatctagggctcacgcatgaagtcagtatatattgaggcgaaacagagtgctcggtcatgtctcatcagttcctcgcattggcttgcatgggcatgtcgcatcgggtgatcatgggaaagcttgtcatgctgcggttgtcaggtgcttgcgtatctatcatttggctaggttaggggatagacgacgatgggtcgcgcgatcacttgtattcttgttggatgttgtgtggtccgtgtggagacggaaggggaaggtggaaggccaaacggcatgggcctagccgcctaggtcttgcttgggagcaaatagcatttgatgctggaacattggatttgatcggacggcttcaaaaaaactgatgacgtggaccaacctggagcaagttttataggaattaatgatgtagtgggtaccaactatgtaggaagacggatatagttagaccctaccacgagaagacaaaagtaattgtaacggcgaaagctagcgtggctgtggggattttaaagagacagaggtgaatctttttgctattggttggcctggcttatgtagtgtggggaggtgaggaaagcggaaatagaagcagagtaagacttggtacaaaattagcatataattgtggattgtaaggattttagcatatagccaatggatttagattaacatggaattatctacaactttttatagccaatggacattttttttaatttaaatttgatcctaattaacgataaatgtaagatgtgatcgtagcctagatcaaatttttccaggagaaaatatcgaaatgcaaacagaccctggatgttagctgctccagttttgatgctgcatgcaaagcatttttctaagtgaattctgttgcctcttcatgtccatcggtattgccctgcacgcgaactatgagcatgccaaccgtttgcacacagacagagagagagagagagagagagcgcttaggctcctagacggacactgcacacaccaggtaatcctagaaagttagaatcgatcggcaccatcctctcctgcctctaggtcgccactgcaggctgaaacttctgcagaacaaaggctgctagctcgtgcttgcagctcgggcgacacctcctcgtggataaacttcgtcctctccgatgttcacatggacatatccatgcatcgaactgttaatcattacacttagaagtgtttggcaaatgagaaagagaaatgatttcccacctatctttaaatcctaaccatttattctccatgtttcatttaatcctaactcttcattaatttttcaatcccaatcccaccccccatttctcattatccaaacacatccttaggcacatcagcatctgcgggggaaacggtacggacgggtcaaaggagaacacgagcatgtcgtgaacaacaacgcggtacatcctgtcgagaccggtgtggcggggtgggttgttcgcaactacgtacagaaaacggagtgatctattagcacgttattaataaagtattagtttttttaaaaaaatgaatgaatttaattttgtttaagtaactttcgtatagaaactttttttaaaaaaacatgtcgtttagtagtttgaaaaacgtgcacgcgaaaaacgataggttaggagaaggggtatccgaacacagcctagtcagctgccgatctcgccaatcgccattgacgtcgagccagacggccccgacgcgatcagcacccgtacgtgggccgtgtccagagccgatggacgacaaagaccggcattacacttctcctaatatatgggattaggtgatcgagaaaaatccatcgtgattccaaccaaaactacgatcgcgcgcgtgctggcctgctgacgtggtaacggcacaaacgtgcgtgggagaattctgatctgaatcaaatttgcgatcgtgtgctacaggcagccgattgggaagtggaaacctatctggtttcgctcggacgacgacgcgcgtggaatgcggatgatagacgacgtacgcacgcgtgtgctagactaatggaccaccaaaacatattattcattttattcattggctagcggtggcgaaccaaaataccgacaaaaacctcttcatttctttttatcttaactaattaaaagatttggatttttcctttcgtcacattaatttctcgttcgtatgtccgatcgagcgaggcctgtgttcccacgcgccatgaacacaagcgatattgcacaagtttaaagatcggtacaaaatccaatcggacacagaacacagaggaagagaaaactacaaacaggaagaataataaaaataaaaatcacacagaaaaaaccttgactggctcgaattgagccattttattgagcccgattctcttcattgactcctcaatgccccaatcccccaatacaatgccccagatcctcaaattgaaggtgaaaatattaacaacaaacaataatccccatatccttattttaacatatgaacaacccagatcctcaagattagaaaaaaaagcatgaataaacatcaacaaagcacaagagtaattcattatcatcactgctccttcttctggtgtgggaggaagaacgggacggggtggcgtcaccatcgcatctcccagatccgcctgtctccgacctccacaccgatggatccaccggccaagccaccgagggaaagtagaggagaggaggggcatttgtcgcacctgcaacccgctgtcgccgtcagcccgtcaccatggaggtcggatgcggctaaatctgacggccccagacctccacgccgatggatccgtcggctaggtcgcccgtcatcgcccgttgaggccgtagccggtggcgggacgagtctggaagaccgagtcgccgcagccgtcgcctcgagtcgccgtgccctcatcaggaacggtgagcgcagggagatggaggagaggagcagtagaggagccggcgatgtggccatgcctgcggctggatccagacgaggaggggcgaggctgctccaacccgctcgtcaccgaactgcctctgagcaggaggaggagagccctggcagcggtgcgacgaagcacgggccgagcggcataggcaggaggatgccggagcccggagggacgggcgccggggtagagggagggggctccgccacggttggggagggttggagccggtggtggatatgtgccggcgccatgaagagagacgaagaaagccagggacagagagagtaaagcgatagagataaggctgttctcaccaaaaaaaaaagagaagaagatagagataaggctagctctgtgactgtgaccagggccaccaggcaacaagtcacgaactcacgatattttcccttcttattaaagtaggagcttcaattttttcttaaaaaaaaatacacacacatgctgtcccaaaataagttgattcatgggtttccgtgtacaatctttgacaatccgttttatttaaaatatatatgaaaaaattttaaaaaataagttacgcataaagtattattcatattttatcatttaatctatatctataactaataactaatataaatattcgtatttttcctttcgtcacatctaattttcgtccgtgttttcatctgtatgcaatccgatttggttagcaataacgatggaaaaaaattgcaaaagaaaaaaatggtggccgcagatgccgccgccggaggaagccgccgctgccggatccgcccgcggtcgccgccactgctaacggatccacccgcggacgctgcagacgccatcgtcgccgtcgacgcttgccttagggacggccgtcgccgagggagcgcggatgccgccgttgggagggcaccgtcaccgagaggtagggagggagggatggccgtcgaggccgacagggagaggaagaggaagagggggagggacggccatctccgccgtctccgccgtcgccgcgccacgccgtgagacgggagggagagggggagagggagcggtctgccgtctccgccgcatcctgccatcgccgcgccgtgccggtgagacggggggagaggagagggagc

SEQ ID NO: 24978 - DNA, 1960 bp, Oryza sativa
gggggagggttagggttctcatcaatttggaacttatccgagccgtccattaaaacgaacggctcagatcgatcgagcgttgggccaaaccacttgggccgtacgcgggccggtggtccagcaagcgagaggaggagtatggggatattaattagactttggtcgcttgagggctgaagaagaaagtgggctgaaaaaggcccatagagataaagggatttttatttagatttttatttcaataaatgctgaaatgatgtttgtattataaaaatagcaattaagctatgtaaatttcaagaaaatttcaatgagtgtaattaatatagaaaatttaataaaaaataaatccaaccataacattttatttctcacacttactttacttataaattaatttaattatatacctacctacttaaaaaatacccaaatatttcagaaattttgtgtttcatttaattataatttaatatttttctaattcaattttatttttttcttttcgtttcaacgcacgaccaattttgctataatttcaaatagtgtaattaatattgcagaaaatttatatttcattaaattagaatttaatatggtttaattcaattttcttcttttttttcattccgttgcaacgcacgggcatttttctagtaataatagagatatagataaagatagctagagaagtagaacttggtccgtccgtctacccttattaggatattcatggggattgatttggggagtcaatctcccgcgactttgggaagtcgatcttaaacgactctacatattcgcaaaccctgggaaaatggcgaaacttaagcagagcttcagccttctcttgctcatcgaacccatcgcagtatgggccacaatatattttctcatattttgaagcaccctcgttggatctgtgaagagcctctgcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgagggtaacataccgcgcgtgcagcgtgacatgcggcgacggcggcttggcgtgctgcgcgacgtgctgcgatggccgccgagtgtggagattatgg

SEQ ID NO: 24979 - DNA, 10805 bp, Oryza sativa
gattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcgatgggtttcgtttctggcatcgacgactgcgccttccttcctgggcaggcgttccggttcggcagcctcaacttcatcaccaacgacttcggcaagatctctctccttgactcggattcaaaccagttggggagagaccaggtcctcgtgccattcggtattccgaactcggccgaggcctactccaagatcatctctcccaagtcggcttcaaaccactcggacgagatccaatctactcttccgcgaccagatcaagacgacgggtcctatccctcaatcctgatgaaacttcctgatgatttggccgctgttttcactgtcaagacatctcccactcgaagatctaggagagctccggcttcggccccgatccaatctagatccagagaggttggcgttatactccaacctcttgggacagtctcgacggaagagttggatggttaccttagctcccccggcgtcagttctcgaccaaccgagatcctcgactacaacgatttcggctaccactatgaccatggcgacctcgacaacttcgatgacagctctgaggataactacacgcccctcttcttcggcgtattcatggctgacaacgaaatggaggaacagcgccaagcccgagaagcggaccaagatcgcgcaaggcaagaagctgaacgtcgccgactggaggaagagcgacagtgacaggagcgagaacgactacagcgttagcaacaagatcgcgaacgggttgcaaagaggctaaagatcgacggcaacgcgccttggaatctgggcgccgagcgagagagctcattgggcaacaagacgtcgatggaacagcggtctttcgcaccccccagcagaacgcggttgcagcaatcactctcctcgacaccctcctcaaggaagacacactcaaccaagctgatcatgttgtcaacatcttgaatcagacgaagaccatgatcgctgcctcggttccagccaactccgcaagcacccgtaccccgactagtagccgagtccctcacttccgatctcatgattatcatcagccaagcctcagcatcatcggcacaggatctagtcgcaggagcaggggtcacgacgaacgatcttttcactcgcctcccgaacgtcacagggagcgccgagctaaacggcctcactctccacctcaccagcgtcccgtcgaccttcgcgacatgatcaaccagcgccgtgcagcgcgaggtcaccgccattcaccaaatcgctacgacgacgacgtggatggagtagctgccttcactaatgacctgcgtcgagtggattggccagccagctttaagccgactggaattgagaagtatgacggcaccactaatccggagtcttggctcaccgtctacggactcgcaatccgcgcagcaggaggagacagcaaggccatggcaaactatctacctgtggccctagcggactccgcccaatcctggctcaacggactaccccgtggcacgatcggatcatgggcggaacttcgtgatcacttcattgccaacttccagggcacctttgaacgccccggcacacaatttgatctctacaacgttgttcagaagtctggagaatcccttcgagattacatccggcgcttctccgaacaacgcaacaagatctccgacatcaccgacgacgtcatcatcgccgccttcactaaaggcattcgccacgaggacctagtcggcaagttcggatgtaaaccccccaggacggttaagcagatgtttgaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccatcatcctgacaacgttcccgcgtcaacaccttcgacaagataaagaactcccaatgtccgcatcatcccaactccaaccacgtggccaaagattgcttcgtctacaaacagttcgcggagcaatacgtcaagaacgcacgtaaaccttcagacggagatcaaggcacatcaaagaacaaagatgatgaagacgatgccccgactggtttccaagatcatcgcaaagaacttaaccacatcttcggcggacccctggcttatgagtctaagagaaaacagaagctaacagaacgggagatcaatgcggttcagcctaacacgccccaatatcttcggtggtcggagatagcaattaagttcgaccgctcggatcatcccgactgagtggtccaccaggggcggtaccccctggtactagacccagtggttcgcaatgtcaagctccgacgaactctcatcgacggtggcaacgcactcaacatccttttcgtaagaccctggacgatatgcagattcctcgcacggagttaaagccgagtaatgcacccttccacggtgttatcccaggactgtcagctacaccactcggccagatcactcttctagttaccttcggcacgggggaaaattttcgcacaaaaaatgtctgtttcgaagttgctgatttcgagacagcatatcatgctatacttggacgaccagctttagctaaatttatggccgtcccacactacacctacatgatgatgaagatgcctggtcctcgaggagtcatatcactacgaagtgacatcaagcaggccgtcacatgcgacaaagaaagttgcgagatcgcccaaacccacgagactattctcgcccgcgaagagatccgactggctgcgaccacgacaagcgagggagaagtgcctgcaaccaagctgacgaagaccgaagaaagcgatgccaagacgaaaaagattcccttagatccctccgatcctgataagactgctgtaataggcgctgagttagattgtaaataggaaagcgcgctcatcacctttcttcaaaataataaagatatttttgcgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggcttcattaaggaagtccttcatcccgactggctggctaacccagtcctggttcggaaaaagacggggcaatggcgtatgtgtgtcgattataccgacctcaacaaatcttgtcccaaagacccttttgggttacctcgcattgaccaggtggttgactcaacagccggctgcgagttactcagcttcttggactgttacttgggatatcattagatccgactaaaagaatccgactgcttgaagacctcgtttattacgccctttggagcctaatgctacatcaccatgccctttggattgaagaacgcaggagcaacctatcaacgcatgattcattgatgtttttcaactcagatcggtcgcaatgttgaagcttatgttgatgatgtagttgtcaagaccaagcagaaggatgacctgatcgcggatttagaagaaacttttacaagcattcgtgctttcaggatgaaactaaacccggaaaagtgcatcttcagagtaccgtcaggaaagttgctcggatttatggtatctcaaagaggcatataggccaacccggagaaaatcaacgccatcctcaacatgaaaccgccaagcttccaaaaagacgtccaaaagctgactggttgcatggcggcgctcagccggttcgtctcacgactcggcgaacgggggatgcccttcttcaagctgctgaaaaagactgacaattttcagtggggacccgaagcataaaaagcctttgaaaagttcaagagacttctcactactccaccagttttggcctcgccgcatccacaagagccgctactgttatatgtgtcggtgacctctcaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcagaaaattatctcactattttcaaagtcactcggtcacggtagtcacatcgtttccactcggagatatacttcacaatcacgaagcaaatggacggattgcgaagtgggccttagagttgatgtctttgaacatatcattcaagccacgaacttcgatcaagtcacaagctttagctgatttccttgccgagtggaccgagtgccaagaaaacatgccagaggaaaagatggaatattggactatgcatttcgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttagttgttaatcaagtcatgaaagagtggtcatgtctagatgataatatgactgcttatcgacaagaggtacgcaagttggaaaataaattcgatggactcgagctcacccatgtcctccgacataacaatgaggcagccgacagactggccaattttggttcaaaacgggaagcagctccttcagatgtgttcgtcgaacatctttataaaccgaccgtgcccagaaaagagacagtcgaagccatggatgctcaaggcgtaagcatgattgaagctgactggagagaaccgtttataaaatttttgagcaaacaagaactccctcaagacaaaaatgaagccgagaggatttccaggcgcagcaggctttacattattcatgagactgagctgtacaagaaaagtccatcaggaatactgcagcgctgtgtgtctttggaagaagggagacagttgttgaaggatattcattctggtatttgtggtaatcatgctgctgcacggaccattgtcggcaaagcttaccggcaaggttttttctggcctacagctgtgtccgatgcggacaagattgtgcggacatgcgaaggttgtcaattctttgccagacaaactcatttgccagcccaagagttacaaaccatcccgttgtcctagccgtttgcggtctgtgggcttgacatggtcggcccgtttaaaagggcagtcggcggttacacgcatctctttgtggctatcgacaaattctccaagtggattgaggctaaaccagtcatcacgatcacagcagataaagctagagattttttcatcaacattgtgcatcggtttggggtacctaatcggatcatcactgataatggcactcaattcactggcggagcatttcaagacttttgtgaagacttcagtattaaaatttgttacgcctccgtggcacaccctatgagtaacggacaagtcgagcgcgctaacggcatgatacttcaagggatcaaagcacgagtttttgaccggctacgtccctatgctggtaagtgggtagatcagctgtcgtccgtactctggtctttacgcactactcctagtcgggctaccggccagtcgccgttctttttggtttacggtgcagaagcaatgttgccgagtgaagtggaatttgaatcgctacgatttcggaacttcaacgaggagggctatgaagagggccgagtagacgacatcaatcgactagaagaagcccgagaagcagctttaattcagtcgactcgatatttgcaagggttgcgccgttatcataatcggaatgttcgatcgcgagcctttttagtcggtgacctggttatgaggaaaattcaaacaatacaggatcggcataaattatctcccttatgggaaggaccgttcataattgctgaagtcactcggccgggttcctatcgactcaagcgcgaagacggtactcttatcaacaattcttggaatattgaacaccttcgtcgattttacgcttaggcatttcgtttgtatctctcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttggcaaaaacttttaagaaatcaggaactaagttaagatatcaagcatagcataaattcatcagtattgtacaaattgtgcctccatcatcattaatcatcaaaatcattggtacagtaatcagtatcagtcttttcatcatcagaattatcaggaccagtcggtcgaagatcggtgtcctgaaatctctcaactacatcagcagcaatcttgtcagcggctttttgtgcattgctgatgaggtcaagagcagcttcttcgctcgtcccgtctgcaaagccatcaatggcatcaacgtcaaccctcgaataaagagatttggtcatcgccaacgccagacttgctcccatacttccagcttctttgatgttcttgaaatatgtatccggagcaactctcagcttgtcgaaaatttcagaagcatcaagtacactcgggccgttgttattgaagaacatcgcttgaacaattggggcagcagcgttagcaacctcatcccgggttccttcgagttttttgatcttgccaaccaggacgtcgaattgagcttgagattgatcttgcggtctgcatcaacagattcacattaataagttagcatatggaggataatggcttttgaggtattcattgttgataccttcaacttcctttaaagccaggtctctttgtcttgccagttctgccttgtcactttccagaatttgaatctggttctccaactgagatatcttggcagcttgcactacattgatcacggttaatcaagattgcaaagataacagtatgagtcagttgagcagagtttgtgcgtaccttttgatgagccactcagttcaaaatttgattcctggagctcagcgatccgatccctcagatcatgttcattcttcctagcaagttctttcacttcgtgcagttgattcctggtggcttcgagggttccgagatgagggactaacctctctaaggttactgttttggcttcgttcctaagatgaatcctctgcaagatagtttaattagcgcgtgaattaaatggcaaacaagatggttgaaatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatacgggggatttcttcttcatcaccaatcattggtcctaatgtattcactgacaaaggttagacaatcgatcagagttatttgggtcaacatggtttcagacaaagtgtttacccgtgatgatttctggacgaggacgagcggattcggatgcctttaaaggagatccagatctctggttattgtccgcgttttgtctgcgagggctgtctgcttgggtttcgacttctagaatctcttggcttggccctgcgtccgactggtttccagtcgggggctcctgattaactccggcttcggcttcggccgactggtttccagttgggggttgatcaccgaattctacattatcagttgccggatgattgtcactcgggtgatccccaacagttggcccggtttctttggaagaattcgtgcccatgttagtcgggtcagagtcttttccagacgggtctatatcagatggtttcctgcaaatttgattatcagtattattgccgcaatgggtgcgtatcaatacaagagagatcgttatatgagttgcacctagaagacttcctgatctttggcacatggcgactggatgttttcttccttggagtagcttgttttggtagtttcttggtcgtctctcggtcttcaggcctcctggtggtatcatcggcttcgtcgtcacttagaaccaacttcctctttcgataatctgactggccgactggatcagaagcactaggttgagtttcagaccgaattcttggtcctccgctcccttgcccagtttggtggtggggagatcggcgttgagcgattgggggatccgactgcatcaaagcaaattcctggatgtaatatccttcattgttagctgattcaacaagaaaacaagatcatattttgagaaagattgaagtgtatgaatacgtactggtggaggaggattgaatgcattgaacggtacgactggcagcaagtgtgagtagctgacaacgatggcgtttgagaagagcttatacatcctttccttcatgaccttgaagtcaagagaatctggatcttcacggtttgggtcatgcttgccgtcaaattcgaaggctgtgcgagatctttctttgattggagctaaccgacatttgataaagtgccgggtgatctgttctccttgaaggccctgttcttttagctttatcatcctctccatcagttctactgcttgtgcagcttcgtctcccattagcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaat

SEQ ID NO: 24980 - DNA, 13386 bp, Oryza sativa
aatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtaaggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaatttaatataaatgcgataaaaatcaacattcaacaaccacaatttacaaagtgcatactcaatcattctcagattcatgaatcacaaatcgatttatgaagcagccgggagcggagagctggagacgggcaccggtagacgccacgccagacgggagacagcgggcggcggctctgcgacaagacggcaaccggccgacgtcccgcagcaaggcggcgactggcgatacaaggagaagttgtaacgtcgtcggcccccagctcggcgccgcgatggcgcggacggcggacccacgggcgtcggcgctgtggtgtggctcggcactgggctgcgccggcgctaacagcggacgcggcgtggcgccggcgcggacagcggtcagtggcggcgtggaagcgggcatcgggcacgaagggaatagatgctggaggtggaagcgctccaggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctgctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattggagtatatatagaacaggaataagttcacttgccaagtctaatttaacgcttttgctattctgatcgcgacaccggggggccaagacgcgatgcttacacggccgagtcaattgcgcattgacagctccattcgtggtgccatctgctacggcatacggctcgtcatctcaaggaagcaacaatgtctcacacagcagtcaagaacgcagcaccaccacacaggaggaagagcagaaagagattttgtttcaacgagtcagggatttccaaggagaagtggatgtagagctagctagcttccccttcatgaatggccgctggtacatcggcacgccctcgatcgtcgttgacagccttgaatgaatctgcaacaagatgacaggcgatatgagtaaacaataaaatggtttctaaaatatgcttaaacaatcatatggtttttgatatatgcggctatgaatctgcaacaagatgacgggcgatatgagtaaacaataaaatggtttctatatataatgctgcttaaacaatcaaatggtttctgatatgctgctgccctatcgtgagttttctttgtagtgtacaagttgggacttgggagacagctaaacatcgtttcaatgcttgaaacaattttgccatagcaaattactcccccatcccaaaatacctattttattgtaaaagcctatccaaccaacattgccacgtcaaaattatctctgcctctctacatacatgaatatctattcggctttttcttcatacgtggatttatagtggtacttatcagccatatcgtctcataaaatgtggttgtgaggtgaaatcgggttagagtcaactaacctaaggacgagcttgagtcaaactaacctcatagctagccatataactatccacactgatatggtccgctgcgaatccatgtcagaagaaatgggttgaatcaaatgtttgtgaaggggatggacttggcagtgctgagtgagtgggcttttgcaacaaaataggttatgtggtggaatatcaaaacaagagcgataattaatttggatggtttacataattttttagtgctattgttcttgtaaaatcgataaataattttaaattaaatttgctgaaaatctactgaggccctgtttagatccctccctaaaatttttcaccctgtcacattgaacatttgaacacatgcatgaagtattaaatactttgcgactaatttacgagacgaatcttttaagcctaattactccatgatttgacaatgtggtactaaagtaaacatttgctaataacagattaattaggcttaataaattcgtctcgcggtttaatgacggattctgtaattagttttttttattagtgcccgaacactctatgcgacaccctatataatacctgatgtgacacgccaaaactttacaaccctagatctaaacaccccccgagtaaagcactcttgtaccatcaagcaaactatccatggaaatgcagtgcctctgtgtcatgactcatgagagagagtgactactattttttttctttttaccttttcatgagtgttctttgcttgatccaaaacacgggggcgcatttagggaaggcatcactggaggcaggctgctcaagtaatgcattatccatattcgattcaacccaaccaaacctaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttcttttttttttttgctgggccggccaaaggatggccgaccaatttcattaagagaggggaaaaaaataaatagccaattacgaagtttgttacatcgacatgaaggatgtcgagggcgatcaaggccaggccttagatcaaagttgtctctttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttgacgtcgcactcgcaacctccccctccctcgctttggatccaaacaaaaaccgcaccaaaccatcgagctcagccgcggcgcgcgcgcggcgacaccaccaactcgctggctcggcgtcgatcgccattgcttgatcaagctcgatcgcgatgagcggcggcggcgcgccgcctggggcgccggggatgatgacgccgggcgacggcaactccgtcggcatgttcagctccgaccgcatcggcgggttcggctacggcgtcggcgtgtccgtcgggatcctcctcctcatcaccaccatcacgctcgcgtcctacttctgcacgcgcgcgcccgtcaccgcggccgatgcagcggcggcggcgggatcgtcgcggcggcaccgcggtgggggtgggggcggcggcggcggcgcggcggggccgggcacgaacacgacgacgtcgagctcggcatcgacgaggcgacgctcaaggggtacccggaggtggtgtacggccagccgaggaaggaggcggcgaaggcggcgtcggcggcggcgacgaagaagggcggcgcaaccacgtgcagctgctgctcgatctgcctcgacaactacggcgacggcgacgtgctccggatgctgccggagtgcggccacctgttccaccgggagtgcgtcgacccgtggctccggcagcatccgacctgccccgtctgccggacgtcgccgctgccgagccccttgccgacgccgctcgccgaggtcacgccgctggcaatggcgaggccgtcatgacacgtggaggttctttgcttggttttcattttttaaaatttttttcttattcatataaaactaaacttgaggatgaaatttgtgtattctgcaaaatggaatgcataaaagaattcctcaagatagggactagaaatttcctcttggtaattgggtgtaaatttgggttcagagtagattttcttttctgatataaacaaagtttggcataggattctctttggaattaggattcactttggatttttggagggagattatgtatggattacaaatttggatgaaccttctagagatctaatttttatatcatcaagcttagtgcagaagaacgaagatgagtgtaaacaaagtaagaagtaggaacatatttgcagaatgctttatatatgtaaaattctatcatgaatatctgtaaaattgaagatgcacatttcaaaaggaatagatccttttaattaatgctcttgcatattatctagaaattgaggttgatgaggatatggaatgcagtaaacagattaacctcagttcaaacactcatgcattgtactcttgatgaattaattcaaagatctactaggtgcatatcaaatgatgacatcagcaacctatatacggccgtcccctagatacattgctccttcccccaggtttttgctgggtcaatcagtttacgccaaaatcattactttgtgctttgaagtaacggatataccaatcatgatgcatgctcttcaagaaaagagagcaaaagtgaaaaatgctaatttggcctaaacaaggcaagagtgcaagacgtatctacatcaagcctttttctgctaacaagtgacaacaacagatgtttcttttacaatttctaggaaaagaaaaggagaacttaattaggcaaattaccttcacatctgcagtgtcctgccacagaagctatggaatcattttcagctatgttgcacactgcagagtctttctatgatataaaagactcactgtgccgctctttggtatgatagacaattaggcatgggcaaaaatctggacaccaaactccatgacatcatttgaacagacagatctatttgcaaagatttggtccggaagaccggaatagtcgaatatatattgtgaatatctgaataaattagaatgtgattgtgatcattttcaggttcatctctgatcacatggagaacaagagcttaaaggaatgtctgcacgttgtgatgcagattacaaactaaatctttgcaaacgaaataaattctaaaaaaaaatcgaagcatcaggtggaaatcctgccattccctgtaggaaaaatattgcagcctggttatgtcagacagagtggttcagaatgcataattcatacagctctctgcagaagccatcttatttttgttcatgattcatgaagcacctagtcgctcccctgctgctttgtttttgactgtaaataacttttatttctcttaatacaaaatgcgctccttgcgtattccaaaaaagcacctagtcgcccttacaatcttcgtcggtgtcaattcctgcatcaatggcaccgggctttggttgataatgatcatttagtccctttcaagctttcatgacatgtgagttaagagtaaaacataattaacaaataatctagcacagtagcactagtgcactcgcattgtattattctagtacaggtccatgtgacttcgggatccaattcagcttcaagctggccaatcaagcaagagaagagaaatacaaaactaactccatttactccaaagttccctcacaatgaccaactgatcccaagatctaacatattaaaaaaatagcaatcagtctgaaggaaggaaaatctagttagcccagtgtatacaaaaatacaagtaacatcacattaaacaattgaacgttggtgtacagtcttctcttccattctttatgatcgaactaactcaaacaagaaactaataggaaatattagtaaattaaaatctagctcaggggatttagttttcatccaaggaaaaatgaaagagatcacgaagaattacggacatgtagatacagtttagtaaattccagtgagatcacagattcatcagtggtctccatttcttacatgtgtattgaagacactcacgagtcaccaatataagcatatgtatcttccatgtaatcataaaataaaagagatcaacaagaaactagcagccaagaactaaaacaaaacttttttttttgtaagtcgggaacactattttgctatatatattgacaaattttcttccaaatatttatcaaatgtaaatactgttttaatccaattcaggtggggtcttcccccccgatgttccatgaagaaaatgtaaatactgtataattacagtacaattacattcgaacttgtataactataacttatatgttacctttacataatcttgaaccattagtttgattacttcaatttctatgcaagttgggaagaaaaaaaataatagttgcaagttgggaagaaaaaaaatcatagtgcacacacgagtgaggatagtttagtcccacggcgtccgctttgcaaattacgaattgtactgcatttacatgcaagttacgatacagttataatatgattgtactgtatttacatctgataaaatttcataagtatatactaggaattaataggcaaggagtagacctgagcaactagcccattaaaaggcccataggcaggcatgagaaggccgcatccatcagcatttcagcacgcacctgagacctgatgatttgagtcctcgtcgcgtcgcgtcgcgtcgtgtccacctgcgaatcctctagtcctcgcgagtcgcgacacgcggagctttggcacctgcagcgatggcgaccgaccaccgccgcttccccgtcttcctcgccgcggcgctgctcaccctcctcctcctcccggcctccgccgcggccaccgacgtcgagtactgcagtgagtgcttcgaggcccttcccgtccgcagcttcgctcgcctcccgtctcgtgtcaagcttacgtttccgcttttggtggggtggggtttgttgctgcagggcaggggcgggattatcctgtgaaggtgagcggagtggagatcgtccctgaccccgtcgtcagcgggcagccggccaccttcaagatctccgcatccacgggtaagcaccaagcaccgatctgttactgcggcgggttgcagtttagtgcggtcatgcggttgggggatttactgggcatatgcagtagtcggatcgggagtcaaattagtgtgggttttgtagcgctgtccattcactggcattattgaattggtccaatttgcagaacagtacaaccatgcgatggaatttttgttgtaaggaagtaaagaacaaactgctggctgttagaaacttagaacatggaaatattgcgctgcagcctgcaggtgtttctgttaagactgcccttcacaaggcatttttcattgcgatgctacttgcagatggagcacctaatgtttgttggttgcaacttgcaaattgtgacaatgcgtgcatctgtatatgcatgctggatttagtgtagtttgccatagtttcatgcccattccttgtttgttgatgcccgtgtttgagcttactatgactgggtgccctggagttcatcatctgtgcactgttatgacacgtgttcattgtgatcccgcttaaattgctctgatagcaaaggggagagaatttctacaaataaggataagctaactgtttcgattttattcaagaagcatccctttctgtagagtacatttgagctacaagtctaaattcagcaacagaacaagggaatttccgtccacctagtttaattagcttagtttaattagctttatattgtttgtccaacatcctgctcaatacaaatatgatgcggcctctcacttcatactaagtaaaacaaaagtattaacacgtgttttctgtaaacatcataatacttattcatctcattagacatagtgtagcattaaccgttaatattctgggactatttgacacattagaagtttctagttgttattctgtctacttaatttagataacttgtgaggaaagctagaatacctccgtttatagttgaaaaagatcaaccaacaataagtcgataaagttgtgtgcattctttccacttgacatgtcggttacttttgtgtattttactaactttgtttgttgcatgacaagtatcatggcactgctcacttaacactcagtgaagtactgattcatcaaaagttcttggtatggttgtcaagtgtgtgtatggcttaagcatgactacagtacataggcttggatatttgaatgtatgaagctctggcagcacagctgctgtcactgtcttttcccatgtgttgtttctatatttcggtagatgcgtggattctttctttatagggaatatttgagttttgctcatatttcatgacattatgtgccaaacaaaattgaggagttgttgaggctgtattcattcagtaatttgtttgaggaaagcaaacatagcatataatttgaagttaatgatgagtattcaattaatacaaagatacattacaaatatatgcttcctagctcacttttcttatgatgatatttgatttttaaaagctactactataaagttttacgccagtagattcttgcctttgagtactgactggggactttttcatgactgctgccagataaaagcatcactaaggggaagctcgtgatagatgtcaagtacttctttttccatgtccattcagaaagtcacaacctttgtgaggagacctcttgcccagtaactggtgaattcgtgcttgcgcacgaacagactttaccatcaatcaccccaccagtaagcatagctgcagcatgcttttagttctgttggtgaagaagatattcttttgttaatgaatttcctaactacccaagaagaggggatagagaacatgtccttatatgacttctaactttctgtatgacattctaacataatattgtgttgcagggttcttacactctcaccatgaggctactagatgacggcaacaaggaactgacctgcatctcgtttgggttcagcatcgggttcatttcacctcttgctctcatctaaattcagctggagtcacagcaatgtacttgcagaactcccatagtcctaccacaacatgttccactaaagccggtttaatctccctgagttgaacatcttactacttctggtgttatgcaataactatagtcaattgccgcttatgttcagtatacttgattggacattgccctgtcgttgatctgtctctctgctctggctgtggagtccggtcgctttcatggaagaattgaaatgggaccattgcttcatttccttgatggcttgtcagcgtcgatcacctgtcatggttgggactaaacccaatcagctagacaaggttattgcttgctgactagccattatcaccctaatgcacaagcacaaaaccggcagccgtttgatcatggtggatgcggacatgcggttgttgtggagcatgcacttgcccatgcttattagctctaccaagcaaattttaggtagaccgctccgcgtgcgtcgaatggtttttgtttcatgcaactcggcatttacaggtcacctctggatatttgacctgttttttatacatgtaaggacgtcggatataacacagacactatttgtgaatgcgagtgcatacatgcttggaatcttatgagacttatgtgttcttatcagggtttttgcgttatcgcgatacccggtgttatcaatgggcacctataacaaatttcttcaaaaattgtcgataacggttctcaacgcgtaacaataactcctactagctaatagctaataattgtaatcgataaggtaaaaccggttctatttttaaaaatttatcctaaagtacaacaactagccatcttaatctctaaaatttatcttaaaatataacttctccaccagtcttattatcttaaccaattataaccatcttacacgcactttttttaacttgaccaatcaagaccatcttaatcaccataaaaaatacaaaattgtttatattttaggacggatggagtgttacacatgctacaaatatagtgtttttctcgaacatatgaattttacaggattttcgtacataaaatttcttcaaatttctccgtcttaaatgagacgacttaatagtaacacataatttcccgctaaaatcctggtggggcgtaacggctctagcctagccggccccgactcgaactcgaacgttaaccgggggcggcggttagttaagcttgaggaaac

SEQ ID NO: 24981 - DNA, 7757 bp, Oryza sativa
  unsure (1)..(7757): unsure at all n locations
catcgccggtggcgcggcgcggctgttctcgacggtgttccgcaagcgcctcgaccctgcgccggctccggccccgccgaagtccacgcctcccggtgagcctgtggttcctgtacgctcccatttgggaagactcgtgcttgctcccgcggttcgtgctcgttagctttgcgctagggtttcaatcatccagggcgttttagggtttagctcagattagctggttcctacttctagtctgattgattttagctataaaattgctatcctccttgatatggagcagtagactcgtgatgaaaatgacgctgttctacaatggaagtttagtgtggagtttcatcacctcctatttgtgtgttttaactttaaatcataccagagtgtcccattctcttatttaaaaccatagcagtgtactatttgcttgtctgtcccaaagactagaaggatttgatgctccaaggtaaaaacatcaagtgtagtatgatgaatgtatttatgccacttaaaacaatcttaattcagtgtaatatccggtctttttatttttatttaaaaccatatggaaagaatacagtatgatatggtcttattttgtctgcctgtagtattacctattgataattttgtgcttggtgctgcagtacgttactaattttatagtcgcttcatgcatgcaggaagcaataatgagccaaaccaaggcttacctgagtcaacacaaactgtaagttataaccaagtgcttgcaaaaaaaaaaaatcggttgtattgtttggcaaattgtgctttatacttttggttaacctattatattccgcttggtgtttttttaccctttattcctttatatttatataacaaaatctgatgcagggttcaaaaccaatcctcgagaaagggaagaaccccactggtgcatcggacaataaggcattgtctgaagtagagcacttgttaatgaggaaaacattcacaaggaaagtatttttcatattaatcttcttgaagtggtacttccatgataactgattttttagttaaccagtgaggtatcaaacaatgttgatttacccccagtgtaatggctatattggttttgtgatgttcaactcttctgttgacaatcgttggaggatcaaacattgttgttctctttccttttttgctggtgtcaactttttgggggtcctcttaaaattctaaacgacagcatctcttctgtcccgtgctttttaagctgccaatgacaatgtgattttgtatcagcagggttgagtttgaccgccttacagacttactgcgtgcaagaactgtggagtctgatttgtctgcaccggcagataaccttgataataagaatgaagcaaggaatacaatggatggtataggaggctccacatcacatgggatggctgcagatcattctattgctgctgatgtaagtagttcttttggtcatgaatattttttattctaaatgctagtccatgaattctggatattggataaatctcctcgagccaacaaagaaaatttaatcatacctggcaaacactgaaagtttatgttgttggtactgaggcatctgtagtctgctggtttggtttgtttctaatgccaactgatatactgtattaccctttttgccatcttcccattatggaagctccttttattgtctgattcttttaatccttttattgtctgattcttttaatgcaaggtaggctgtagttcctaaagtagccttcttgttacttgaactcgtgagtgcaaaaatatttttcgggtgcacacatgttagatgctgcattaattgctgagaaatgctgatttggatttgttggatctgtcattttttttaggcttgattgtgcatcaaagctctttactgaccttttaatatgtttaagtgctagctatataggatatgtgcagctaaacggccctttttgcagtgttggtatgccatatgattgttggattcaattcctacaaattcccatgttacatgcataaaaggcagtggattttacctttcgtttccatgctccatccaactaccatattgcagctttgctacttaggtttttcagtgtttttatttaggaaaaaagcaagcaagtgtgtccttttattcaacttcctttggaactttagtctgtgtttaattttatttctgtttattttgtaggatccggtttgtggtgctagttcacccgcagagctcgcaaagcaatatatgaattcccgttattcgaaagaaaaccgaccaaacagtttgcggagccaagtactcctgaagaacaaggcagaagcaagcaacattgcctatgatagaaggagacctggaggaccatttgtgcaagaactgagtcaatttagcaatgaaaactctgagcttcctgtgaatggctatgtaactccaggattacatgggcggtcagcaatatatagaatgtcctgttccccattctttaaggtattgtgtttactgcacataatgtcaaatcattctcagccatgttttcatgtgttctcaacatgccatactgattactggcgctcgaatttttttcttgttcagtataatgatgctctaacaatgatctcacagggaccaagctcttccaatgatataaatatgtcaccattttcatcatctcagacacgggctaatagtttggtttctggctgcaggcaggtaatttattagcactttatggaaacatatactgcattatatacagtatatattttaaatttgctatacacttagttgaacaagttcatgttactgagaaggtgttacggttgaataaactgtctagctattgaggttcttttctttttcttatatatgtctgtatcgttgcaaatgcaaagcatatatgtggtataaagtgctggtcatcatggacttgatagtgtgttgtgtcgtggcaacatctttagacttgcagggtttgcaccactgagaacattctccatgatatatgatctaaactagacataccagagcttctcttattcctatgtctccctaacaggtcttgaaacgaagaggtgccgaattggagaatgagcttggatctattggtcccatacgcaggattcgccaaaagtcaaatatgatgtctacttttagagatgctcgctcgagcccgcgaggaaactttcttcccagccgtacaattggttcagatttgaccgatggcggttcacccattcgggattcacctagttcgaaaagactattgctggggacgggtcaatctgtggaacctgcagaagcacgtaggaatgatgaagatggtaaaatttcaagtgataatgttcttgctgcgtcacctcaatcaaacaagatggctgaaaagatatttgagcagcttaatataatagtcccatcaccaaaagagaagctgtctcttccacaatttgctgctgggaatgcaagttgctccatgtcaaaacaacctgttaggcaaggcaatgagccaaacgggacgagtgaccctagtagttcccagaaatttcaacctatggatagtgttaagcattcccttgatccagaactgaatggttcaccatcgagtaaagacaagctgagaaaagatggatcatcaaaacttctgtcacattcatttaaggatttaggcaacaaagacattaggtctgataatgttgctctatcttcagttgccgctactacatcaagcaaaccgggctttaaaatggctgtttttgaggtatggggaaagtttactcttggttcctcgaattatattaaacgctcactcatgtcctgagattattctttatcacctttttttgttgcaggatctaccagagtttgatgatgaccaggaggctcctatcccatcgaaaaattcaatgggcaagactgaggtgaagacaactgataaaaaaattgatctgaagaaggagcagaaagttgaaccaattttattcaaacaaaaagttgagtcaaattcagtgcagaaggctgtcagttctccagttagtgaaaagcctatagcatccgcattgaaagatgcccgtccattaggcttattttcacctaatgaccctgaaaacagggctactcatgatgttccttcagacaacaacaatggtttcaaatttccacatgtaccttctggcacccttctggagagttctgtgtcacaattgccacttgcttcaaataaagacgataagctgatcagtgcatcatcttctatatttggtctcaagcagtccagtacaccagattcagaacaaacaaacactgctgatgtaaaaacagaagcaagacttggggagaggtgattttcttggcactccctatttccctttttctccttattaattgtttgcactggtcatcttctggaaggaggaagagtaaaaactataaaacaaagacaacccagtatttgcaaattcgtttttcttcaagtgcttgcaaattcatttgttactaacacataacctactaaaaagaatgttcattctagctattgacttgagaagtcccttatggttttttttctcacaatgacatgacatgtatgtaaaggctgaagatcctgtacagtacgcttgtttaactcggtcataatttgtatatacatgttaagagatggtacattttattccaagggttattttagtaggatggatcgtaaatatgtaattgaaatgcatgtacagcctatcaggatattccttttttttttcaatctttgattacttatttgctgtttggaggaattttttggaaaataacataacagggctttaaaataggatatcccttttgtagtgtagaattgctttctatctatggagtaaccgcttatgttttctgctatttatgtttctagtgtcaccaagcccacaacattggacatcactaatttggagggaggtaatgaaagagaaagaacagaagatgtccataaatcatcagataaggtattaccctcggctgctcctttccactttgcatctgctgcatcaactacagcaagcctgagcaatggtttctcactgccatcatcatcaaagttatcaaatgtaacaccaattgataagcctgaagttagcttggctccatccactgtatcgaccacatttgctccatccagtaccagcccacctgtttcatctccaatccctgcaattccgacattcaattttggttcaagcacttcaatggtggcagcaactaaatcagatagtacaaatacagtggcaaagccagctagcagtttattgttcggtactggggatgctatagctgaagccaaatctactgcccaggatacagccaacaaggcatcatcaaatctaagtaccactcctatttcttcaaatatttcaagttctccagtcacatcctcttctgctttctcaagcatagcaacattttcatcttctatggttgcagcttcaaatgatggaattgcctcaactacttctgcctcaacagcaccttttacattttcgagctcaggaaacaacacttttgggttcaattccccagctcaacctgctggtttcagtacatctgttgatggcagtaccacccaaccatctgccaccagcacgatctttggtagcaaactgccacagtcagagggcacaatgtcgcagccatcgaagagttcacctgttcagtttagttcaccgtttcaaactgtgaccactaccacaggagcttcctcgtctgggtctggatctgtagctttcggagtaggaacagcctcaactggttctgggatcacatcttttggaaccggagcatcctcatcttggcctagcacagtgtctttcggattaggagcttcctcatctggaactggtgctctgttatttggagcgggggcttcctcatctggaactggggctctgcctttcggagcgggagcttcctcatctggaactggggctttatcttttggagcaggagcaggaacctcctcatctgggcctggaactgtgtcttttggagctggaacctcgtctgggcctggaactgtgtcttttggagtgacaacttcctcatccgggtctttgtttggtaattcaccatttggatcaggaactactttctctggccctggaagtggattcgcattttcatctcctagctcttctgctgggtcatctttaactatggccagcacaagtatgttcagcaccagttctacggcttcatcatcccctgctttcagtaacccattcggttcaagttcatcacctcccagcatgtttacatttggccaatcggcttcttcaggaggaggtttttcatttggagcacagtcatctccagctttctcctcacaagctccagttttttcatttacctcagcaagcatgaattcatctactccgcagcctgcttttgggatgacaaatgccaacacatccttcggcatgggatctcctggaaatgatcagatgaatgtcgaagacagcatggcagatgacactaaccaagcagcaccagcaccagcaccgatatttggttcctcaccatttgggcagcctgctagttcacccgctgctccagtatttggtgctccagcagtcccgtccgccggagttttccagttcgggggccaacaaggttccatgcagcagaatgcggcattcccgcctgccggtggtagcctagagtttcagggtgggaacttctctttgggaagtggtggcggaggcggcgacaaatctagcagaagggtgatcaaggtcaaaaggaacccaaagaaaagataagacgctctgttcaaatgtgcatttcatggtgccattttggatctgcctggcaacatgtcgtgatcatcagagcgggactacgaccatggttcgtatggtcatacaaattttccagcgtcagcacagttttcgcagcatcacccggctggcttgtaaaccccaaggtcagtagtgtattaccactcaattattcctttcattggcaaagccggattgcatgttgttgtatgcctgtgctattggagtgtaaaatagaacaaaaaagaagtgtatcccgaggtgtaattttgttctcttttccctgcgcatctgctgtcttatttgcctccgatatatttggctcggagtgtaatgtacactgttgtatttgttctttttgtttacatccgacatgcccagaactccctagtatagaatctccctagtttatcaatcttcgaatcccactgagttttacatcctgcgtgctttacatttcaatgtagtttagttttcttctattgtttagtgtggtattatatgagctgttccgtgatatctaactccacgctgtcttgtctccattagaaacgacttctttttatccaatgtgcctgaccagttctttcagaaaacctatcaacacaaacgttgaatttacaaaccataatcaactagtagaatcagcgttgcatgtcgcaggccgttgtgtgactgggacgttaccggccacctgccgcgtgtgaagtgatgctctctccctctctacctacactgcttcttggatggtggtgatgatgcgatttggacttttgcacaggagcacgacctggtcggccaccatgccacacgcgctttccccttctacgctctcgcatttgccatttcttttttcgcgatcacattcgcgttaggcaagtagatgggcaacgaagaagaaacatggaaacaacacgacacaagagtacgcanaaaaaaaaaaa

SEQ ID NO: 24982 - DNA, 8922 bp, Oryza sativa
cggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcggcaatggggaacacgtgcgtcggccccagcatcagcaagaacggcttcttccagtccgtctccacggtgctctggaaggcgcgccaggacggcgacgacgcgctgcccggcgccaatggcgcccctgacggcggcggccagggccggttgccggcgccgccgccgccgacttccgacgcgccgctcgccgtccaaaacaagccccccgagcacgtcaagatcgtctcgaccacggacaccgcctccgccgagcaggacgcctccaagtcgagcgccggctcggactccggcgaggccgccaggccgcggccgagggtgccgccggtgaagcgcgtctccagcgccgggctgctcgtcggctcggtgctgaagcgcaagacggagagtctcaaggacaagtacagcctggggcggaagctcgggcaggggcagttcgggacgacgtacctgtgcgtggagcgcgccaccggcaaggagttcgcctgcaagtccatcctgaagcggaagctggtcaccgacgacgacgtcgaggacgtccgccgcgagatccagataatgtaccacctcgccggccaccccaacgtgatctccatcaggggcgcctacgaggacgccgtcgccgtgcacctcgtcatggagctctgcgccggcggcgagctgttcgaccggatcgtccagaaggggcactacaccgagcggaaggcggcggagctcgccagggtcatcgtcggcgtcgtcgaggtgtgccactccatgggcgtgatgcaccgtgatctcaagcccgagaacttcctcttcgccgaccagacggaggaggccgctctcaagaccattgactttggtctctccattttctttcgcccaggtgagcgaatcacattttcttttccttttttcttttccagaatggcgcattgaatttagtatctataactgttataacaaacaagatttccaatccattcaagaaatcacactgcatctatggataagtagagaatgaatatggcctaatctttcatgtactgatttgatctttagtgaatctgaagttcttgagtttcagcatttgtttttgggacaactgcattattgtgcttatgatagtactaatactgctgtgagattttatgcttcagaacttaatttcctttacctacatttcaaagttttcaacaccatttgtttctgcataagttctgcaaaaagtttggctgcatatctttaccattctgcagtctgctaccatatcattcagatgaattcattctccattgggtttctactcatatgccattcttattccaggtcaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggtttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttagtagtgcagggctgcaggccatgaacagtgcagtctgatttacttggcattatcatcttttcagggcatccatgggtccaggttggtggtttggctcctgacaagcccctggattctgctgttctatctcgtatgaagcaattctcagctatgaataagctgaaaaagatggctcttagggtaagtatgacttggacacaaattgttactatatttctgatttctctatgaaatattttcccaatattaggatagcaccatcttgtcgttggccttttgtcctcatgcaccaaaggaaaatctgtttggagtttagctcatgcaagatacagtacataatcattttaaaaaataagtatccaatgttgtattagttggagaatgttgttcatcttgaatggttcaatcatacttacctgcatgtcctgatacctttgttgattccaggtcattgcagagaacctatctgaagacgaaatcgccggcctgaaagaaatgttcaagatgatcgacacagacaacagtggacagatcaccttcgaagaactcaaggttggtctgaaaaaagtcggtgctaacctccaagaatccgagatctacgcactcatgcaagccgtaagttcttaagcaatctaccaattccgtcgagtacttttacggtggtctctactggtcgaaaacatcaaaattgcatttgtatctgaattctgaaatggtattattacaggcagatgtagataacagcggcacgatagattacggtgagttcatcgctgcaactctgcatatgaacaagatcgagcgggaggatcacctgttcgcggcgttccaatacttcgacaaggacggcagcggctacatcacggccgatgagctgcagctcgcctgcgaggagttcggcttgggagacgttcagctcgaggagatgatcagagaagtcgacgaagacaacgtcagtaaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgatccttttcttctgacgttaaaaatacaagagaggtttttcgttcctcgccgccaccgtcgttcatgtgataatccttggccccctcgatcccctgcgcgcgatgccattctggtgcgtgatttcgccgtgtgctaccgtgttttcggcgggcggagcggacgaacgcgctgtaccgtccaaccgcgcggcgtgtgctgcaaagcgcgcaatcgctcgtaataaaacggagctccgatcgcgagggcaaacgccgtgtgggggacaagggcagacacgtgaaatgaagccgttttttgtccttcctgggttattacttccacttctttctcccagcggagcggcacgttggtttcggaggccgtggcactgtcgctttgcccatcaatccgcccgcccacgggcgcagatgcagagatactactggactgctacgactagtacccgttgcgctgcacgtcctgccgggaccaccaccagactctgaccttctgcacgttgtagtagtgtttagcgtttactgtaactctctgaagatgaatctaccactacaaggcgatcacctgatgcagtggtgggcaagttatgcttccttgctagtacagtattatagcaacctgcaacctcatataagttgtagtaggccactactccctccgtccaaaaaaaacaaaacctgagtttccgtgtccaacgtttgtccgtccgttttatttaaaaaattatgaaaaaaattaaaaagacaacacgtataaagtattaaataatgaaaatactaattataaaaaaattccatataagacggacattcaaacattggatacagaaacacagggtttgtctttttcttttgtcaaacattggatacggaaacccagggtttgtctttttcttttggacggagggagtagtagagatgctgtggtaataggacacccgcaatggttatctataggctctgtataagatatatatgtcagcatattttcctacttgaaaaagattaaatgaagagagagagcaaagctatctactaaactggagatagtctatagagaaaaacgaagcaatagattagagagctatagatacccatgtagacatactattgaggtggtttactattaatctagtctattgctgagatgtacatgttttatattttatagagagcaccttactttatcattgcgggtgctcttaggcgaagacgattcacattagctgtcactttatttcattaataacgacgtcgttgcttcttagttggagcatctatagtttatagttcagcaggtacatcgtgtattcatgttctcacgctgattagtccgctgtcccgaacgaataatgcaggcctgtacgtccaaatgacaaatcatagcctaataatcttcagagaataagattcgcataaatgattagatctatagaagatgcagaattgattactactagctttaacaccaaggatgctgtgatgtttaattgtttactcggcattctgtcaaaacagaaaaagaagaaaaaatgacggaaaaaaatataaaaaaaaacgctcctatacacagaagatctcggtcttcaagtatgaacattttcctgcctttttttttttcagacaccaacagccaccagattacattccccacctgatttattattcgtaataataaacaaaaataaaaataaaaaaaaacaaatggtaatgtggacggctccagcacagtccatcacctcattctagttcgtgtttcggtatcatgagatcaatctttcgccgtctactggcagcttgcgaatcgcaatcgctgaccaaggatgccagccatttggcacgttgcttctaacaacttgcctgcagtattttaaaatgaacaaagcataagattattattatcaatgtgtgattaacacataacgacactggtgttatactgaagggaaaaaaagctagaagaatatgaggctggggagtcagacgattaatgttagattatgtatcattagataccctgtcaattcaacattgggtgcctataaaatttttggcatttttgttgttctcaagatgtggcaatggcttcatgtagcttggactcaaaggatacaagtagtaagcaataagctcaaataatctagaccaggcaatagcaatatctaatgtcgaaatcacaagacaactgaaaatttaggtcatgaatacccaagaaatatactgccatatagttctataatcagcatcacaccacgttgcacacctaaatgaactaatcaacaaaaggaatatcaccaagtgatcaaggttcacaggcaccagggtagtttatcttactcacgaatccacaatccgtggccacccaaccatttctatggagcagtatatatattgctgctcactatcatctaattcttgagattaaaatcaacataagttttcttcagatcatgacaacttatagatgcttggcatactttttgagcacaggtctaggaaaatcgaggggatttagattgatcttaactatctatatatgacctagatcatagaaaaatacatctaagacaaaattttatctttaacatacatatgtaggttttctacttctgtctttgttttcaccaatcatagtccaaaaatagctcgctctaacatcagcagcattcgcatacaaaggcacacagtttagcaattgccatccctcaacccataaccaatccaatcaggctactaccattccaccaaactctagtaacaagatgtggcaaaggcttaagcatgagccttttgatgctttgggggaaagaaaagctgttgctcatgtgtcacgggcagagcacaattcttgcttgcagtcccaggtacagtatcaagagatggtaaagacagtaacccaccagcacacgcacaattctaatgtttcagtacacaatccagtgctaatatcacagaccagccagctatgtgtaatggcctgaataaaatgtataagtgcatagacaccaaagagaatgactgcaactttggtagtattactgaccacatagtagcaagtgcccaaacgggcaccgacaggccatatgccattcagaacggcaataaccctaattgcttctattttatgcctaagccttcgtctttattccgcccagtacacaccacccaccaatcgattaattaattaatccccgccgctacgatcagaacacttaccggtagcacttacctgttcctaccggtgaagagtaaaccctcacactggcaacattactagcatcaacccgcattgacttaagcaattgcataaacaaaatcatctcctaacctccccaatctaggttgtgaactgtaaatttctatggcggatttgcacgattaataattgagtagaaaatgcaagttcagatctgaagagaatggctgacctctccggagtttgttcttcttgcgagtgccggtgacggcgggcgccctcctgaccggcgccgtgtccggcgccgtcttggtgtcatccggcgggaacagcacggcgtcaatgccctgcactgcgatcctgccatccgtgtagatgtccgggtcgaagagatacgccgagccctcgccatggccgaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggtggtgaggcgcgccatggcctcgtcgttgggcgcgagcacggtgagcacgtacccctcggagacgagccggcccatctcggtggcgagcgaggtgaggttgacgaggatgtcggcgagctcgttgtagccgccgtacaggaggagggtctggatgaagtccttcacctggctgtggccgtcgaagtggtgcttcccggagcccggtccaggggcaggcgccggcgcgatggatgggccgggggccatggcgtcccagatcggaagcaccgggggcgcgccgggtggcacgggcggcgccggcttcttgaggcggtgcgtcctcgggtcaacctcgggcgcgccagttggcagcacggcggagatgtcggcgaggctgcggcggcggttgaagtcctcctggacagagcgcggcacgaggaggcgctcgatcccgtggatgacaccgtccggcctgagcacggcgtccgggcgggtgacggcggcgtgggcgacgcgcatcgcgccgtcgttggcggcggcggcgagctcaacctcctcgccggagagcgtggggtgggagacggcggaccaggacccggaggggaggcgggcggggaggacgtggaagaggagcagcgactggagcgacttgaggttcctcggctcgagcaggaagcgcttgaactccgggtcgaggtcacgctccagcgcctcgttccgcggcgcgaagatggtgacgttgtgcttgccgacggcgtcctccagcgtctggagcagcaggggcttctccaccagctccgccagctccgtgtaatgcgagtccagcagcgccaccagcaccgagttcgagttgattcccgttccagcaccagcgccagatgttgtcccgctactagccgccccatcggcggcggcggagggcaatgtgggttccttcggcgccgtctccgcgggcgcgccggcgagaagaagcaagaagacgagggcgccgcgcaccggcgcgcccatcgtagcgtaggcttctcctgccagaatctctccggatgcgcctacggctgctgctgctcccaccgctctgctactctgctagctactctccaccactctggtggttcggcgaaggaatgaattgggggaatgggggagaaaggaggagaagagaagtaaactagtaatggaggaggtgggtggtgtgagcttttctcctctttttctcactttcccctccttttttactccaacggaagagagagagagagagagagagagagagagtgaggtgtgtgtgagcttgcttataagtgaagagagagagagtgagaagggttgtcgaagtggaatagtggatgcgaggccgaggcgagaccgcgagacgaggaaggagaggagaagacgacgcagagtccgtggttggtgggggcagcgtgcagcggcggcacaggctggcgggtggagccgtggagaggggccagcagcaacaagtgtcggtgtgcagctgtgcgtgcgtgcgcgcgcacaaggttcgcctgccgtaagcaaggaaagtgtgggcagtgggggcattcggtcgcccgccgctcgcgccttgtctcgcggctcgcgcgcgcgcgcgcggcgtatgcaacatttcgccgtgccccgcccagacgcccagcagcgcagcgcgaagccgagccgcgaatatttccgcgggtttcgcccgctttctgccgcgcgcgctgccttgcacggagacacagtgcaggcgtgcctggattttcata

SEQ ID NO: 24983 - DNA, 4973 bp, Oryza sativa
ccccctcccccatcatttttcctctcttctcctctatagtgtagagggaagagatgtccaacaatttttttttcacatttagaaacatataagaaccaaccatagaaagaaaaaacttaaatgacgaaatatgtgtgacggagcgtggggctcctcaccgggagaccgcgcaggcccccctttgtcggttcagccgggggccctgggtgagattctaagctcctagtctgtggaaagttcgcgagaatggaaaaagcacaagacacgggcgatgtatacaggttcgggccgctgagaagcgtaataccctgctcctgtgttctggtggatctgtgtatgaagaagctaccaagagctggagagccagagagctcttattctaaaaaccctcttctccttttttttttttctcgtgggatctcctctccagatcatccccccttccagcctctcctcttaagtgggcaaggtcctccttttatatctcaaggggataccacatgcaccacttctccctctctctttttgggtgggggcccatcctatctatagtaaaacttggcttgccttctcttggaagctgaaacactacctgtttttgagtgtggccacgcgtcctcgttcgtctgacctcggggatcaccctgtcatcccttcataaatgggcggagatttgcaacggctgctgcccgagtgacccttctgatgggacggcccatacctaccttcactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctagcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcatttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatttgccaccggccgggagatagtctcgctgggcgagggatgcccggcaccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccatcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggtgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggaacgagctcctaagggccatgacagtgcgagcgggagccgcaagggagatcaatctaccccaggagggggttgtgcttccggtccccgtgatgggggctcggggggcagccgccctgccgacgcccgagggaagagaaagcaagagggtacttcctccccatctcctccccgagggggcggggcggcacgtgtcagcagcaggcgcccggagggggccgcgccgacgccgcagcccgagggggagcggaagaagaaacggctccgcaagatggggggacagaaccatcccggggaaacctcatttcccctccaaggtggtcgtttaaccgaccccctcgcaggttcgtcccacgcccattgtggctatattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcgaaggcgggaatctgaccggcgagaagccgcggatcgcctacgggaagccgaggagtccgcccaggtggccatccgagctcgccaagctgaagaagccgctcgggagaaggccaaacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttctgctgccccactgagcgcagagcctcttctgcaggccttggccgttgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgctactaccgtgatgaacgaggcgcaagacgacctccgccttcaatacgggagctgggaggcggagctagggaagaagctcaatgccgcccggggggtccttgatgctgccgctgcccgagaacggcgggcggcggagaccgaggtggcatcccggcggcgcgaagaaacccttgaggcccgtgccatggcgctggaagagcgtgcctgcgtcgtggagagggacctggcggaccgcgaggccgccgttgctattcgggaggtcacactggcggtgcacgaagctgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcattgaaccagcgggccgctgaactcgaggcgcaggcaagggagctggatgcaagggcgcgtagcggcggggcggccacgggcgacagcgacttagccgcccgcctcgcagttgccgaacacaccatcgcggatctgcagggcgcgctggattcgtccaccggggaggtcgaggcccttcacctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgatttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgac

SEQ ID NO: 24984 - DNA, 1469 bp, Oryza sativa
aagggaaaagggccctcgtcgtctttgagcaacaccttgattgtaatcaaggttcggacttgtccagtgctctctttcacatatttgttctgagataagtgagtactttaatttatttccagggtttacctaaacttacggggtgtattgatcacttgccaacaaatgcgtttgctggagatttacggctactcaagctgaatctgaggaaccagtcagaatatgctgtgaaggtccaaactatatatttttgcaactctcttcccttctttttcagtaatttgaaatgatttaacgaggtttgctcaaatgagcataacttttggagcaaatttaatggtactacacaatttgaaccaactaccacaaaccacactttcaaagaaggctttcagaaaactacacgttcttcagaaccacaaaactactttttttatgaatttacactagtcagacttctgactgagaccattagtaaggtatacgtggtaatctgtgtgccatatggaccacacacacgttcatggtccatggatgaccttctggttaatgtggcaaaggtacagtggatgagtggagtagcccaaagcctatagtccccttggtgctatgccatcaggatgacaattcacaaggcagtacttggcctgcatagaaactgtcttagtcaccgtatagttggaataatatcagatgttaccatatgttactttcatatgggcctagttggtcataatttgttgagagttctatgatggtcttaaaggacgtcaagtttttgtgagaactttttattgaaagtgtggattttatgatggtctaagtttagttgaagttctatgacatttacactaattttgtcctttatgtaatttttcagcagcttgttttgtagtaataattcccaatcttgttgtgcagaatattaagatgaagcttagccatccaagatttgtaattcctggtgatttatcagaagttgatttcgagtttccccaatgcttaagaaagcatgtacaatcagaaattagtactgtatcgacaaaacgtactcagggagatgccaagggtttgctctttacattttctcaagtgagttggttcaagcatgcccccttgtatgctgcaaaaatcatgcatggtctctgtttctttgcaaatattcaccgtactctcttgccaggatattaaaattcaagaaggagccacgttctcctggcctatttggttccatgctgcaactcctgggaacttttctctttatatatctctgtattatgaaatggagagcccaagtgagataacttatagaacattgcgcatgcactacaatattgaggtaatgacttgtgcttgtatttaaataatacatgatttggtgcaaatttggtggattaaacacctaaatttgtggtaagggttgaagtgggttcttagcaaagttcaaggtggtagagggggtggtaaat

SEQ ID NO: 24985 - DNA, 1085 bp, Oryza sativa
  unsure (1)..(1085): unsure at all n locations
nnnnnnnnnnnnnnnnnnnnnnnnnnnnnnnnnnnnnnntttctaaaaaaaacatgaaaaaatgaatataaacgtttttcacataatgcacaaataataatcacaaaaaagtgaggaaaaaaaatcctataggagtattcgaaaacaatttaaatccagggaaacttgataaaaataaaaaaacaaaccaaccatattagtagtatactttccttgccttttctcgacagcgcaaggtaagcaagcatcgccaaggcaagaaaaaaggaatctctctgaagagagggaatctccttaccgggttgctcccgtcgcaccggacccgacaaacgcaacccgaaaccggagtcaagtcaacacgcgcggacacacgcgcttcccttccccggaacccgcattgcctctcccccaccctctcgcaggaagaccccggaaggatctggaagctgcaacccccaccgtccgatccagatccgacggccccacgcccgccgcatccgcttcacgcagcttccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgagatgttcgggcgcgcgccgaagaagagcgacaacacgcggtactacgaggtgcttggggtgcccaaggatgcgtcccaggatgacctcaagaaggcgtaccgcaaggccgccatcaagaaccaccccgacaagggcggagaccccgagaaggtgagctcgcgagcgattcgtctcttgttttttcgtttcgatctgtctgcggcggcggtgaggggcgtagccggtttggatggaggtgggggatttgaggggggcgttggggagttttggatctgtgatagggttgaagaattcgatgggtttaggagggtttggagtagcgcttgcgtgtgctccgggaatgatggatttaggtggggggaagtagatttggttgtggaaatgtgttggattcagagcacgataagtcgggg

SEQ ID NO: 24986 - DNA, 653 bp, Oryza sativa
tccagccgtatctcgaactaaatcaaatcatcagttctcattcatggcggaagaaagagaaagcttcgagagtcagtgggcgccctccgatgtgacggaagacaatctgaaggagatggtggcgcacgacgttcttccagcaaaagagatcatcgggtggcgaccggcatttggtgaggcattcccgacccccgatacacacgaaatcgtggtatttgctcatttcttctatggcggattttctcttccaacctcaagatttttccggggtattctgaacttctacgggattagcttgcatcatctgaatccaaattccatagtgcatattgccaattttatccatgcctgcgaagcttttctgggcattaggcctcatttcgccttattccgccgcattttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctgttctttccgagtactcctgtcttcctccagtttatcgggatacttggaactcactgctaatgggagacgaagctgcacaagcagtagaac

SEQ ID NO: 24987 - DNA, 925 bp, Oryza sativa
  unsure (1)..(925): unsure at all n locations
gcttaatataatagtcgcatcaccaaaagagaagctgtctcttccacaatttgctgctgggaatgcaagttgctccatgtcaaaacaacctgttaggcaaggcaatgagccaaacgggacgagtgaccctagtagttcccagaaatttcaacctatggatagtgttaagcattcccttgatccagaactgaatggttcaccatcgagtaaagacaagctgagaaaagatggatcatcaaaacttctgtcacattcatttaaggatttaggcaacaaagacattaggtctgataatgttgctctatcttcagttgccgctactacatcaagcaaaccgggctttaaaatggctgtttttgaggtatggggaaagtttactcttggttcctcgaattatattaaacgctcactcatgtcctgagattattctttatcacctttttttgttgcaggatctaccagagtttgatgatgaccaggaggctcctatcccatcgaaaaattcaatgggcaagactgaggtgaagacaactgataaaaaaattgatctgaagaaggagcagaaagttgaaccaattttattcaaacaaaaagttgagtcaaattcagtgcagaaggctgtcagttctccagttagtgaaaagcctatagcatccgcattgaaagatgcccgtccattaggcttattttcacctaatgaccctgaaaacagggctactcatgatgttccttcagacaacaacaatggtttcaaatttccacatgtaccttctggcacccttctggagagttctgtgtcacaattgccacttgcttcaaataaagacgataagctgatcagtgcatcatcttctatatttggtctnnnnnnnnnnnnnnnnnnnnnnnnnnnnnnnnnnnnnnnnnnnnnnnnnnnnnnnnnnnn

SEQ ID NO: 24988 - DNA, 630 bp, Oryza sativa
  unsure (1)..(630): unsure at all n locations
nnnnnnnnnnnnnnnnnnnnnnnnnnnnnnnnnnnnnnnnnnnnnnnnnnnnnnnnnnncaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttaatagtgcagggctgcaggccatgaacagtgcagtctgatttacttggcattatcatcttttcaaggcatccatgggtccaggttggtggtttggct

SEQ ID NO: 24989 - DNA, 716 bp, Oryza sativa
actcagcacatggtagctagtttctaatctcacatgctttttattcattgaagcaacacattattgttagttcatattgttatcttacatgctatttttcttgcttaattaatgtctgcatcttttaggtttaacgtcaccattccaaacaaatttattctggaatgtttttggtgcaaatctaatgatgaattcaatcacgggagagtaatgccacaagttccttttcttgttccgtgcaggtggatgctgccatagttcgaataatgaagacacgtaaaaccctcagccacacgcttctaataactgagctttttcagcaggttagacatgttttcaacgcatgcattccattttgcgcactccacaattttgatatcttaaaatatatcgttttcttttctttcagctcaagttcccaatcaagccatcggatatcaagaaaagaatagagagcctaatcgacagggagtacctggagagagacaggagtaacccccagatctacaattacctggcttgacagcgcttgccatcataacatgaaagctcgtcgtcttcatttcattgtcagagacattgtaaagtagtaattgaatatgtctacctcttgtttttccgacctttttctccttggaagctgtagcaatcgcaacatttctgtatacaagaaaaatgaattttcgataatatcagccatgcatcatgcatacatg

SEQ ID NO: 24990 - DNA, 633 bp, Oryza sativa
caaattttcatcattccatgtttacgcccacccccacccccccccccaaaaaaaaaacacacacacacacacacaataagacaggtaatgcacacaacatggctcagtacagcagagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggccttt

SEQ ID NO: 24991 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnncacaacaatatatagaaaattgacggataatatgatttttgcgatataaacgaatgaaaattaactactactacagagttgaaattttgttttagaaaagtatttcaagaaaattttatatagaatttcttttggcatcaaatactccgtttagtagggaaacatgcaaacaaaaatctaaaatctaaataatactccctccgtttcaaaatgtttaacaccgttgactttttaacacatgtttgaccattcgtcttattcaaaaaaaatttctgaaatatgtaaaactatatgtgtacatgaaagtatatttaacaatgaatcaaatgatatgaaaaaaaataaataattacttaaattttttgaataagacgaacggtcaaatatgtgttaaaaaatcaacggtgttaaatattttgaaacggagggagtaataataaaaacaacatggccgatgtaaatgcacggagtcttacctgttcaagcagaggtgaagcataatggaggtacgggtggattttgcattcatggctatgtttagatttaaacttttttctttaaactttcaacttttccgtcacatcaaatgtttagatacatgcatgaaatattaaatatggacgaaaaaaaatcaattgcacaggttgcatgttaatcacgagacgaattttttg

SEQ ID NO: 24992 - DNA, 748 bp, Oryza sativa
  unsure (1)..(748): unsure at all n locations
nnnnnnnnnnnnnnnnnnnnnnnnnnnnnnnnnnnnnnnnnnnnnnnnnnnnnnnnnnnnnnntttaatgttgtgtgttttagctcctatccatatatttttcttgtctataaactattattaactctggtgactgtaaactaggtggtatggagtccttgggatatttgatgtagccataaagcacttgctggaggtcattgcttgcagccatcagtccctgacaacgcaaagcatgttcctcaatgattttttccattttgttcaggttcttgaccagctccatttgtgctctcattttggtgaaccaaacttctattgcaatgttcatcttgtgttttgtaccaacagagtatggggaagaaatttgatgtctacaagcttcaacttcctgttatcaacatgccatcactcagagttatatatgaagatcatcgtacttatgcatcagatgcagatgtaagtactttccactgctgtaggactatatctagtttatttaccattcagttttccagagtaatcagacattttatttaccattgagttttccggagtaatcagacattgaatttatgatatttcctctaatactcccttcgtcccaaaatatatcaagtttttagtctttggcacgggtattaaagcgagggggaataagacttggttgtctccttgggattggtgaggtataggtccggacaagttggactataataaacccaggggtactggggtagtttagcgg

SEQ ID NO: 24993 - DNA, 772 bp, Oryza sativa
  unsure (1)..(772): unsure at all n locations
nnnnnnnnnnnnnnnnnnnnnnnnnnnnnnnnnnnnnnnnnnnnnnnnnnnnnnnnnnnnnntcctctgttttacacttacattacatttctgttagaatcctatattttttttatttacacttacattacatttctattagaatcctatatttttttattccttcatttttttattcccgtgatttaaaggggcccttcgtttatacaacttgctgggttggtagttggtactggtcgtcatccaccgttggatgtctcagttatcacatgccaaactgccaatcatggatgaaccctcgcaattctgcttgctatgctatgttaccacgctacaaaccaaaccgggtcaggccaacccaaggcggcaacgctgaccgtctcaatcgatcacaaggacgtgaacgtgacgccttttgattgattgccccacctcacatgtactataatactccttttatttttccatttcaatataagaattatgaatataaacgacatgttcagatttataatactaagatataataaatttaaaagctgttacatattataacagagaaagtaacacatttggatgtcgacggcgttgacgtcttatttgtttcgtactactaacttcttttaattntttataagggcgttgctttcttcagcagagggagtactaatgacactattattatggctagtactactcactctgggattaccatagtgatgcgttgatgtgctctcttcgttgacctctccttgttttgctttacgagctt

SEQ ID NO: 24994 - DNA, 667 bp, Oryza sativa
  unsure (1)..(667): unsure at all n locations
tatagggcgaattcgagctcggtacccgctcgcctgcgaggagttcggcttgggagacgttcagctcgaggagatgatcagagaagtcgacgaagacaacgtcagtaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgattgttttcttctgacgttaaaaatacaagagaggtttttcgttcctcgccgccaccgtcgttcatgtgataatnnnnnnnnnnnnnnnnnnnnnnnnnnnnnnnnnnnnnnnnnnnnnnnnnnnnnnnnnnnnnnnnnnn

SEQ ID NO: 24995 - DNA, 1548 bp, Oryza sativa
  unsure (1)..(1548): unsure at all n locations
ttaatctgcaatcaggataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgatttccccccggagttcaccacgccccggggcacggctcggttctggccccttttggcgattttagccgacccgagcccccgagggcaggattgagcacaagtgacatatttcaagtcaagattcttcaaaaggaaacaacagcacaaatacagcctttaggaaatcgaaaatgcttttattgaaatacagatagaagaaaaaatatgcatatgtggtagcccccggccaaccctgcacgcctgaagggggtgcgtggttggcccgagcccgaaacctgacacccgaactccattaggggtagaagcgacgaaggtgttcgatgttccacgggttaggcagctctgtgccgtcgcccgtggccagccgaacggagcccggtcgggggacgccgatcactcgatacggaccctcccacattggtgagagcttgctcaatccagcacgtgtttggacgcggcgtaggacgaggtcgtcgacgcagagtgatcgtgcccggacgtggcgctgatggtagcgccgcaggctctgctggtagcgtgcggctcggagggccgcgcgccgcctcttccaagtagtcgaggtcatctctgcgaagctgatcttgatcagcctcgcagtacatggtggcccgaggggacttcagggtgagctcggatgggagaaccgcctccgcgccgtagacgaggaaaaaaggcgtttccccggttgctcggcttggtgtggttcggtttgcccagagcactactggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaacggccatgaaagtggtatgatctgcagtgcctgggccagctgatggatttgcttggcgtggaactgacacgctctgcatcgccggacccggtcaaccgcatcattnnnnnnnnnnnnnnnnnnnnnnnnnnnnnnnnnnnnnnnnnnnnnnnnnnnnnnnnn

SEQ ID NO: 24996 - DNA, 10651 bp, Oryza sativa
  unsure (1)..(10651): unsure at all n locations
actgacacgctctgcatcgccggaccaggtcaaccgcatcattgaatgctgttggccaatagaaaccttgacgaaaggctttgccaaccaaggcgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaatgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgtgggtcagagcaccggtattccttacagatctggttaaccactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatatgacccccgcaccggcgccctgaagagtcagggagccgtcgaactgcatcacccagtgggcggtgtgaggcagctgcgaggggcccgagctggcctcggggactgagacgggctcgggagccggggtccattctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggtcgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttcctccgtccaggtaaacggcccggagcgtttgaggagcttaaataagggtagcgccttctctcccagcctcgatatgaacagacttagggcggccatgcaaccggtgacgcattgcacatccctaagcttgctggggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcacaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgtgaagacgtcagcgtttgcccgcaggaaggagacgagcgcgtcttcctatttgccatccagaagaccaccgattcgtgtggtcttggacgggccgtcgcccagggcaacctccttgaccgggacctcatcgcacgtgactatccgctgcctcagggcggcggggacggaggtgccaagcctctcgtcgccatcctcgggcttggacgcagcggcgaggtggtccgcgcgctgctccatacaagcgagcgcgactttgaggtcgccatggacagagatggggccaccggggcccggcatcttcatctggaggtaggcgtaatggactgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgccccggcgtcacaccgataatcggctgggacggccggagcaccatccccggggccttgatggcatcaaaggctgcgggggaaaggatgttgagggctgctcccccatcaatgaggacacgccccagcttcacgttgcaaacagtgggggaaaccaccattgcgacctgtcctccccgggcaacgcacgatgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccgaggacttgccctctcggcgctcctgcctcctctcctcctcccacttcctcgtccgctcagccaaacttttgactacacggcagtccgcgaggtcgtgaagggaggtgttgtggacggtgcaccacttgccggttgggcgctccctgctgggagcgctggcctcctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctctgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatatatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtgggcagcacgtcggccattatgccggcgctcgatactgatgcgggcatccggccccccacgaagatcttcccgggtcggaggcgctgacgaaggagtgacggccgaatagcgaacagcggccgctgctcgccgcgccctccgtcttgacgacgcggagccggtggtagcagtaccagaggtcttggtggcggaggaccgcccaccagcatctaggcgctgctgcgccgtcatgaccaagttggccatgtcgtccagccaacgttgggctggagactccgggtcagggacaatgggcgggtgacgtaggagcgcgccctggggcgtgctgccgtcgccgtaaacgaggaggcgacgcttcccatctcgccgcccttccccatcacccgtggatgtcgaagtcgcggatccttcgaccctctcgagcgcctcctcccgctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctaccaagagctggagagtcagagagctcttattctaaaaaccctcttctccttttcttttttttttctcgtgggatctcctctccagatcatccccccttccagcctctcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatcccttcataaatgggcggagatttgcaacggctgctgcccgagtgacccttctgatgggacggcccatacctacgtccactccgccggaagcaggtgcaacgtgggaacacggttgtcttccggcgacataaccagtgtcagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgatgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgagcccgacccccccccccccgagggggttaggccacgtgggtgatcgtgtctgcctcaagtctctaagtcatgatactcccggtcccatgtcaccgacaatgtgatttgtagaattttctaaatctctaccgaaaataggtgtcatttgtgtgtcatttcttaaaatagacgtaactttctcatacgaactcggaatcaggcaaataatataaccacaaaaatctacagaaaaagttacatccgattctcccccgttttgctgggttcggcgaaattaaaatatccaaatttttcttgcaagattgtgttttcgaggcgataagcttttcgacggagctttggaaaattctacatgccacatatttcgtccgtttgagtttatttttttagggttcgttcttgtgggttcctaactgtgaaaaaaatatcaaaaaaataaaagaaaaataaaaaaaaagttgcacatctctctcctctacactagagaggatagaagagaaaaattctgcaggtcacatattttatctatttgagtttggtttgtatatcgttggttcttgtatgctcctaatcgtggaaaaaaaatcaaaaaataaaagaaaaataaaaaaagttgcatctctagactgtttaagtaacttatggctatcattttcatgtggttatattttgagttagattaagcaatttcatctagtggtagagtgcattatgtttaacatgctgaccgaagggttttgctaaaagagttatggtataatttggtgaaggtccaaaatttggtatgttgtttccagacttttagctaagttgaaggatttattacatattccattcgagtttaatttttttttgtggtttgcatgtatgtatcgtgattctaagtgtaaaaaaatatcaaaaaaataaataaataaaaagggtcaagattggaaacgaggtgttgggggggagccatggtggcgcctccccctgccacctcagcaccaccccgccacgttggcaggaggacggtgccagagtgcctggcgccgttcagttagaggacggtgccagccactctggtgccctaaaagaaaccatttgtaggataaatttttttagaggtctattttgcgaaataatttttttaaaaggacttaaatgtgaaaaatccaggccggcgtgccggtctggggaccggacagtgatgagttaaagccggtgagatccgcgtgatggattcgtacaatcgtactcgggtgaaatggagtaaatcctgtggtggatacaggagttgagtacagggtacaggcctacagggtgagtccgaaaggagaggttaaggagctcactaatgaaagtggccaagtgcgtcggttaggtccatatgccaccggaaccggatcgtatacggatgcacctaactctaaacggggtgttatcgtgttggagaatggagtttttttttttttaagaacttggagaacggagttaatcttttatttctgaggtcaaacaggagccgccatgtgcgttcgcgatgtaattaagacgcactaacagctccctcgagtgcactcgtgcttaatacttgcaggcttgcatgctgccagtcaatgcagagcatagtgcgttcacagatccaaatgttatactccctcccctttcattttaattaacgctgtgacaataacacgctctacaagatatacctttgaccttattttttattataatatatataataaataaatgcatgtttacttttattatagtgttttgaaagacaaatctatatatgtttttctagtttctttaaactatatatttttaaagttattgatggtcaaaattataaaagtttaacatcaaccttatccaaacgtcaattaatatagaaccatagggattatttatcctgtcaggtgtatcaacaggttaggttatgcataatcaaatggcctcccccggaaaatccattcggagacagctatactagcatctcgtgatcttgcattgtgtttacaaaggactaatgatatacagtatcgatcttcctttttcttttctcctttccaaacatatcttcttcttggcatttttatcgtacaacccaattcatgaaaaagaacactatcatggtgagttggatggtgtattgtcccacggtggtatgaccatgactttcggtgttatgctaacatgtagcttcgcagcattgatcgtgatttaatgatagatcgttggatggtcaccgtcgccaaatcgtgcttcaattcgtcaatgagccaacgccctgaaaaaagtaagacgtacagatatcaccgtacggccgcttcattagctttcacacaatcagatatcattgttgctttaatccacttcttgaaatcatcgtttaattaatacgatcagcctccatttttctcatgtggtagtgtcactttgtatcacaaggtattaggagtacatccagcaatcgattatcggtagtcactcacttttggtcgtttcaatcgtcggattttattgtgttaatgtccgggcaataacacgtaaagtgagccgtccaacttctggtggatttggcctgacgcgtcgcctttttttgtatgacgtgggttagtctccacgctaagctaccggacgatctacagttcaaccctgcagtttttttttttaagataatggaataaaccctccagatttatgacaatgttttttccgatttctgattcctccaatagttcgacgctggtgggctcgtttatcacttgggcggctattctccttcccgtcgttaattaagctgcatccgaagcacagcaccggatgtacgcgccagattgacgtgcatgttccctctacctggcactttcaccggtagcctgtaaccctttttacccctttcgtctacaacggtagctcgtgagccatacacgtatacacatacgaatgccgtggtgtcaatcacctttgaagccaagttttctgtgacatctcgtctcccccggccggtcgctgcaccaccggagatccagtcgtagggttcaccaaaccgttttaagtgtgttactatcactttatagtttggtggttatagtaagattgatatactgtgattttaaaaacttaaaaaaaattactatacatgataaaccagccggtccaaagtactgaccccgccacgagcacggcacgggaaggaattcggaataacggaagaaagaaaggcgccgagtcgtttcgttgcgcggatgcgccagctgccgcgttgatttcgcggggggcgtccgcgtgtggtgcggggtcgcgtcgtcctcgcgcgcgcgcgcgagcgagagacgagagagggtggattcgtcggtgactcggtgtcggtcggtggtttcgtccgctgcggttgccgagacgggagcgagcgaacaccgtgcgtgcgtgcgtgcgcacctggttctcgtgagcaataagctggctacggcctacgggcagcgcacacatgacgcattcttggttttgttggtttttgctagcgagaccaccacctgcgctgcgctgcggacgcacatggagtggagttcactgggttgaggttttgatctggggagatcattgtcatgtgaggggctaatctccgcgaaatgcttgatgccaaagttaaagaatcacgaatcacgcatgggacaattctgaggaactctgatcatcatgaaagcgagggcatttggatggcagatttttcttttcagaatgttcacgtgctagtactgttttttgtattgtggactaccccagcttgtagagaccttaaatatttccagggtgttcaacagtaaaaaaaggagaggggaagaaaatgaaacaagcatgtccagcgcagggaaaaggtaggtagatgcagtacaagggatgcacttttgtgtgattactcacaaacttatgtgtgatcactgcgaacttccgtgaaaatttatgtgtgtcatacaaaaacgtatcacttctatgcttgtgattactgcgaactcctgtgtacattgcatatttcctcataggccaaatttgcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 24997 - DNA, 624 bp, Oryza sativa
  unsure (1)..(624): unsure at all n locations
tatagggcgaattcgagctcggtaccccactccgcctccgcgaggatacgctcaccgagcgggagcgagccctcgaggagggcgaggccgcagcacagaggctagcggagagcgcgtccctccgcgaagctgcgcaagaggaacaagcgcgtcgcaatctggaaagtgcccgcgccgagagggccgcattgaaccagcgggccgctgaactcgaggcgcaggcaagggagctggatgcaagggcgcgtagcggcggggcggccacgggcgacagcgacttagccgcccgcctcgcagttgccgccgctgtctgcgccgaccgccgccactgtccccagccgtctcgggagtgtatagagggagagagagaggaagaggaagagggggagaaagatgaggaagaatgggtatagaggctgatgcatgggtactgctgtcatagactcaaaatagagaggatggatgaagaagctgttggagtaaataacaaatttgacttgataaatgagatggagagttggccaaatagatatttggagagtcgaatttacagagagtgttggagatnnnnnnnnnnnnnnnnnnnnnnnnnnnnnnnnnnnnnnnnnnnnnnnnnnnnnnnnn

SEQ ID NO: 24998 - DNA, 476 bp, Oryza sativa
aaattatatctaattcattcgaactccgaattgagccattcaacttgcaaaattcatctaaatttgagctctacatggttgtttagtttttatgtactgtttccttggtttttattagagtttttcctcgttttgcgtgccagcgtgtaccttccgtcgtttcggaagtccgcggtcgcgaggaaaagagtttagaagatccaagtgaagaagcaaggcaagtcacacattccccttgagcatgttgatcccaatttataaatgttttaccgtttgcaaataaacatgcatgtcttgctaattacatgggaatagggtttacctatttggtcgcttgtgccatgtttacttgatatctgtcctttggcaaccttgggtgataaatcgactagcttgtgttacttatgtgacctagctagaactatatgcttagccatgcttaattaccactagctcagttgatgggataattacag

SEQ ID NO: 24999 - DNA, 868 bp, Oryza sativa
  unsure (1)..(868): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatttggttccatgctgcaactcctgggaacttttctctttatatatctctgtattatgaaatggagagcccaagtgagataacttatagaacattgcgcatgcactacaatattgaggtaatgacttgtgcttgtatttaaataatacatgatttgttgcaaatttggtggattaaacacctaaatttgttgttaagggttgtaagtgggttcttagcaaagttcaaggtggtagagggggtggtaaatgaacatattccttaaaactggaaatatttttaattgcatgaaactaactgtaaaacagggttgtcatgctccacaacggagtggaccaattaaaatactcgaaaggagcacaagacaaaaaatctctgcatttggtaggacttccactgcatcagctgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25000 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnnnttttctggagaatgaattgcatcgcacatagtcgaatgctcgaataaaaggataaaatgcagtttcaaatgcaatgatatttagaagaatcagatatgtataataatcaagacgatcaactaatcatacagaagtaattacaatcacgaaagaaaaaacccgacaaaaaaatagaaatctctcactatgaagtatgaactcaacatggactatcatacgaccatcatgccgttggcggcggcggcgacggcgtcgccggcgccggcgagctgctgctgctcttgttgttgttgacgaacttgagcacgatggggaggacgacgacgaggatgaggacgagcaggatgatgatggcgatgcaggtccacttgcgggtgctcttctgatgcttccgcgccaccaccagctgctcgcggccgcggtcgacgaaagagcgcgcgcggccgacatgggtctcgatgtcgtcgagctgctccccctgcgccggcaccagcacggccatgtcgttgaacacctggtggagctcgagcagcgagcgttccagctccgccacggcgccgtgccgctcctggatctcggagaccacgccgagcacctcgccgcggccctgctcggcgatcgcgcgctggaggaacc

SEQ ID NO: 25001 - DNA, 40991 bp, Oryza sativa
  unsure (1)..(40991): unsure at all n locations
catcatttacagaaagcttaccctttgataccttaatcaaagctgccctaggctcatgtttaattttatgaccagctgagagaggaatatgaaaaaaacccagaccatcagtagcataaccacataactgagcagtaggtttaactgtagatctaaaagttgggcaacggatagcaatatgatccacactttcacaaatttcacagtaaaacttagaagaacaatcctgcatcgtatgcccctttgtaagacatctaaagcaataaggtttacctgatcctttactttctacctttgacttgcctttgtcaacatcaaccacacaagctgccatctcatgttgaaccggctcaccatgaacctaagaatccttaccacctccatataccgaagcggaaggagcaagagcaaaagcaccaaaagctcctccactaggtatagaacccccagcaggaccaccagcagtaggaccactagaaatattggagaccattgcccccgaacctctagtctgaatcccacctccatccacctttaacctatcctgttgggagtttccttttcttgaatcagcaattttcattaacgaaacagtctccgatgcaacagccgatgtagcagccaacacaccaccagttagcaaaagatcacctgccccagctgacccggcaccaggagtagcaccattcgtcgggaagccagcctgcaacccaccacctggcacaccaccggtcagcaaagcgccggactgcaaaccaccagcagccgtctgcaatctaccacccggcgcaccactagtcgacacagcgccagccggcaaaaccccagtctgcacaccaccaccagccatctgcaatccaccccccggcgcaccaccagtcagcaaagcgccagccggcaacacacctccgccagcagccgggaaaactggagcagacatccctggtaccgcaccaaaaaccaggttaccagcaccaactccacctccatctgcccgaacagcagatccaaaagaaggctggaacccagcgccattaaatccaccttcactcggaccagcattgagaccaaagccacccctccacccatgacctccaccaaaattattccatctaccaccgtgagagagatcatggcgaaacccagggcgaccggccgaccctcctcttccgcgaccacgccctcttncacccggagcaccaccatgttgatttccaacaccaaatcccggatgaaacccgcgtggcgcataanctncgttgtcacccgttgcaaaaccttgacgatgatttcgctccatcgccaaacgagcaacaagggcgtatgagcgaaaagggcaagtcgataacggagtactcgtcaccctacccttgcgccgcgccataccagttttagcgaagagggataccaatccaggagtgggccgaaacagaataacacgttttgaggcagggagactcgttggactttttggattttcgaaatcaatattcaccggtagtacaggaaatagcttagacgatgcccacacaagtctagctcggctcatcttctttgcctaacataatgagagtatatggatatgatcataatgtattgtgttgttatggtaagataggattagtttctactcactagtactatatatgtgacattgcttgatatccaagccatgtaatctaaatatactagccctccgaggcacaatacaatgtgtccaatatctacagtatatctatctctccttataatatttaacatggcatcagagagggcgtcctatggccactgccgcttaggcttccgctgtcatcgcccttgggatggttgtagtagttttcttgttttatttcttggatctttaggtcatccatcgacaatgaaagggttgaacttaaccacacgcaaatcaaatataattgataaaaattcaaacatgtaagatttctatttcacattactcatgaatacattgtttatctttcggtgtaattttgtcaaaacttttggaatattaacgtgaccatgtgcgtacagaccactacagccgtcgaggaggccgacggctggcatatcaccaaccgcccgctcgtgcggtggcgcgacaagctcacaacgccgagggacagcccggcgagagacgcagcacaacgccgccgctgccgcccgtccatgtgagctaccacctcgggtggcaaggtgcggattgggcggtgcggcgggaggagatggcaaggcggatcatggacggccggttcgggacgcgcgcacagcgcgtcgaggggcacgcggacgccggcgcggagatgttcgacggggtggtgatgtgcacggtggacagcttctgccggcgaagcgaggcggcggcggtggtggtggggcaggtggtccgggtgggtggtgtacttgtccgtccgaggcgtcagcaccggacagccgtacgaggtaggctaccgaggatgatgatgatgatgccattgttgttgaatgtggtactcatcgtctgacaaatctcaatgtgaatcgaaatcgaatatgtgctttctgtactcttcgaagagaaaattgcctaaattttaaagattgggagggagagatttaaatatattacttaatagcctgaacatcatttagcaaagacaaaagagtctctttgatcttcatgtcttagcaaacaagggaaacacccagggtcttccggctaactccacaaggtggtgggctaaacgaactggattcgaagcctcacgcccacaccccttctaattatttgatattaggttcttctctaatattcgcgtgttttatgtcttagcaaaccagagtcagagttcttgatttccgaatggggcgacggcgaggaggagcaaatggttctcacatccgtgtcttgtgattgcaccggcttcccttggataatttatgaatgaaattaccgcttctaaatgacgtttataggctatttagtcccttttctcgatctttgggctttgggcgcaatgcgaggtcatcgggctttgggtgcacggatggcgcctgggccatggatcgtcgtgggaaggtattggtgaagataatcccgacgacaatgacagggacgctggtggcgaggcggaggggtgatatgagagcatggcgaagagagaacgtcccggaaggaggatcaatggcgatggcgatcctggctctctgtcctctcacctagccgtggagatggaggcgactgacgatgaaagcaaccccgccgcctacgagcagtggcggtggggtagggcgagcgtgggagaaggcggcggcagtgggttggcgatgggagcgaagatttgattgatcgctaatttctgtaaccgctgtttatgcggagtgggagatcaataattgtatggacggatcaactcgcgatatcagtcgttggatgaaaagatctaagtgttaaaaataatcagtatggatgaaactggtacatttcttttctcatgatcatgatcatgatgatatagatatagatatacgccctattattttctgatgaaattatagattttacctcggtctctattagcacggttttcaaactactaaacggtatgttacatgcgaaaactttctatatagaagttttaaaatatcaaatatatccatttgtcaagtttgtaataattaaaacttaattaatctttttacgtgctctaaattaatctttatcttcgtgagtttcaaatgccacgtgtagatagatatagatatagatgaaagatcgtttcagcaattatttaaattaaaaagttaattaaaatccctctcttacctttgggccgaatccggcccatctccttcaatctctccccgttggcccagcccagcagcccctctccctcaccatccttctctcctcattatttcaggcccattggcccaataacaaaagaacagcccaaaatctaattaaccctatccagctgacacagccaggacaggagagcgaccggccgaccgccgatgcgccgctgtcaactcgccatcgacggtcgaccgtcgtcggcggcagcgcatcgccctcgcccatcgcaccgtcggctgttgcccgtcgcgcggtagccgagttgcgccgcaccgcctcggcgcctccccgggccgcgacgccgcccggagctccagacgaaggtaattcttcccctgcccatagctctgtactgcctaaatccagagatggttactttggttagaaacattttggattaggagttgttcacagttgaatctaggatggttcatttgatttaggatttaggatttagtttatttgaatccagtaatctggaatggttcatggttgaacatttttattttaggatttgaatccagccatccagggatggttcatggttgaacaattgaacttcgaaacttgtgattcactgatttgtgaagctttgtagcagagttagtatttatcagtgcacatatttagcagtgttagcaatgttagtacttaaattggaataccatattgtagtatttatcagtgtacatgttttcaaaatatcaagaagccgaaagttcctttctgaattgtaagatttcttatcattttgccattttctatgctctataaatttgatatgttttgtcaattaatagtttagtactgtacttaaatatgcttaacgcattcaatttatggtcgattctatgaacactataccgttttatattatacaactattagactttgggttgaaaatttttttctcttctagtttcaaatacctaagttgaaaatcctaagcctgcccttgcccgtgggtccgcgccgcgccgccgcgacgcgggacgctatttcttcattgcttcgacgatcagcggtgagccatagagccaagcaatgctaggtcgttggccggctcctctctgcctgtccggttgttcgccgctccacctctcctcgccggattgctggtcacagccgttctagcctgtggcctacgccacacaaatccactctcgctcaatgtcgtgacgctgccatcggcttcggcgtgggaactcgagatgccagctgagagccgagatggcgagaccaagatcccgtggctggctggcttgctggcactcactgccatgcgcccgtgccggtgccacattgctggtgaggttcctctacttctgggctctagagctctactcctcttgctcttagcttcataatgcaatctgtgattttttagagaaaaaggtcacaaggacccggcttatattgaaagccaatgagggcagtcttctggggcaggccaactttacaagcaatgcaacctgtgattgctactagagtactatcataatgttatattgtcaatttgtgattagcgaacctgtgaatatgcaatttatgattactgattagcttccctcattgatcatactcatggctaattgattagctcatagcataggatgctgatttgtgaatgattgaatgcgaatagattgcttctgttattgcaggattggtattcttttattgggtaaaatatgaagagtgaggattggtattagcctactgtaataattgcacattttgagcttgcttgttaaattagtcgattattaatatcataagatattgttactatatttgcatcgccttttaaccaaatttgtactatgcatggtgtttgcggtgtttgaaaaattttcatgtgtgatgtgaacttttgaaataggactacccaacaaaaaatttctggctaagccctgcttggaatggctaatttgtaatcaatcctgccacttttgttgcttgtgatttgtgggatttgttacctgtcaatttagtcgtattacccatttgcaacagagcaacactgtttatctccttcatccttaatcgtgagcttttgaatgctagatttccaggaactttttgtttgacccaatgacgttataagccccaggtagcagccgccgccacagctgcacgggcggatgaacgctcgccatggcggccagtcgagcgagacagctccacatagggatgtaagtggttaacccgcgaaacccacttataggtcaaaataagcaggtttaagtgggttcgcggctgacccacttacacccttagctccacggcctttacctgacgagaggatgttgtgaccctgacaagtgggccaacctcagcaaggactacgcctccaactccttcctctgggaagccgccatcatctactcaaagcaactgccccatcgtacgcgctgcctgcctctcctcatcgtcctcctcaaggccaccgcctcccgcgtggatcccatcctcggtcggcagggcgctccacgcggaggctgtgaaatccgccaacgcccatgaccgcctcgtgggcaccacgctggtgtccggtgtactgcaagtgcggcctcctggccaacgcacgcggggtattggacagaatgccggaccggaacaccgtgacgtgtaatgccatgctcaccgggtatacggcggcgggcgacatggccaacgctgaggcggtgtttgccggcatgggctcacggacgcccgtcacgtgggcgacgctgatccgggggttcgcggaggagcgcgacatggtggatgcgcggcggtggttcgaggccgcgccgccgggcatgcggaacgtcgtcacgtggaccgtggctgtgcagggttacatggccacgggggacatggagaccgcgagggagctgttcgacaagatgcctacgtggaacgcgttcgtgtggtcatcgatggtcactgggtacttcaaggctggcaatgccaacgaagcgcacgcggtgttcaacagaatacccgtgcgaaacttggtgaattggaacacgctgatagcggaaatgcttaccatcggcagtccggccagaaataaaaaatcggacgtcttaatctaaaagaacaacagtgtaggtgcatggtgcaacggttggtcaggtgtactgacaagcaacggagcatgtatacaaacatgtttcaaaatttaaatgatttttactcttaaactatttatccaaatttcaaattaattatatcattagattcgttataattaaatctttataacaagatatcacatgactacattccgacgacttttaatttttctttttaaatgttgcacacattgttactgaaatgttccaacaagcatttgttgatgtttcactaattcattagcaatgtttcatgctatctttttttatatgttttagcaaatatattttttatgtttcaacaataattataattcgatgtttcgatctaaatataaaaaatgtttcactagtcgggacttaatgtttcatgtaataatgattattgttgtcgtcaaaacttttttatatattgtacttctttggaataatttgtgaagtgggttgaaacatctccacaagtgatgaaagaattatttttaaatagttcaacataagtttgttttcttctagaaagcatatatatttttatcaaaatatattcatgtgagatcttgttataaattatagattggatatatattttagaataaaaatttgtttaaagtttgattaagagagagaaagtaatggtgcctcaggccaccttggcaaccagctctactcctacatgcatgcatgtgacaacatcgcttctcgaacacgtccctacgaggagtagcattcgatatttgaaaaaatattgaacgtaagatttgtagcgtcagatttaaaaatatttcaacataatgaagtatttgtgcaaaaatctaatggtataattgaaatttagatcagatatataattttggagaaaaatatttacaatgtgaggaaaaaattaggcacgtgtaataggagggagagagagagagtatgcaagcagcagcgcaagcaatacatgcagggcaggcaagcaacgcagcacgggagtgcgggagagagcattgaccaacaaatgaaacattaagttatatatggtgaaacaaagaatacaacaactgaaacatttaaatatttttatgacacatggtgaagatacacgttgaaacatgtcactgtcacatatgaaacaacaagtattgacggattgaaacatatgtgtttcttttattaaaatataatcatgcgatatcttgttgtagagatttaattacaatgaatacaacggtgtgatcggatcatagattaaataagtaatttaaaagaaaattcattttaaagcttgctaaaatacatacatgttgcatgcatgaggtggagagagagtagtagcagatagtttcaggaattttgtgaaacacaccgaagacacatattgaaacatatcattatcacgtatgaaatattttattctaacggtttgaaacatatgtttttttttgacataatataatcatgtgatatcttattgtaaagatttaattgcaacgaatacaacggtgtgatcggatcgtagatcggataagtaatttaagaggaaaaaatatttaaaaagaggatgaaagaatgaaaagaaacagctaggcacatacattacagtgacatggttcgttcccacatgcgctcgtttagacgtccgatttttggtgtgatgccggacgtccgagccgtagcgctcttccgctgatagcggggtatgccaaaataggatgctccgggaaggcactggaagcatttcactcgatgctggatgacaggatcaagccggacgagttcaccatggcaggggtgctctctgcctgcgcacagctcggttcgctagagcaagcaagaaaggtacatagtttcatcatccagcaccgtatccggaagaaccacttcgttctgaatggcctggttgacatgttcgccaagtgcgatgacctcgctttcgcacgaaagatcttcgacaacatgcaatggaggaataccgaatgctggaacttgatgatctctgcactttccacccatggatagagcatagaggctattaaattgttctccaagatggagtgttcggaccagaagcctaatgcgatcacacttctcgctgtgcttggagcttgcacgcatggaggatttgtagatgaaggactaagaatcttcaacaagttcgatgtttacggggttgctgctgcagtggagcattctggttgcctggttgacctcctggcctgtgctggaagattgagagaagcttatgagattgtcaagaacatgcttgttcaaccaaacgaggtgatctggtgctccttactcggagcttgcagggtgcatggcgatgcagagatgtctgaactcgtatcaagtgagattcaccaattgcactcctgtcgtgtgtcaaccaacgatgcagagtacatactgctgtcaaatatcatggcctcatcggagagatgggagcaggctgaacgcatgaggagaaagatggcgctccatggagttgggaagactccagggtgcagttcagttgagctcgatgttcccgaacaacaagtacgcgcaggcagtggtacgttatcccaattacattaactgcattttttggttgtctcatgtgctggattttctattaacaatacttctggtacataggtgattagccaaggacattagatgaatcagacaaggaaattttgtgttttgctgcatccctttatcaactgttgctgggcttctggcatagaaataaccatacgcttcatgttaattttatatgctaatatcaatcagcaggcacaactgaattctgtatttgaacatcgattattgtggctgaaatgttaaaaaagaaatcttcacaaatgataccagaaaacattttcgccaaatttcctagatcaaaggcgccataaaggagttgggaagactccagcagggtgcagttcagttgatcttgacattcctgaacaccaagtacacccaggcagtggtacgttatcccaactacattaactgcatttttgctcgtctccaatgttctagcgaagcggtttaacaaattagccagaaaagaaaagcccctcatgttctgcattttctattaactagtatgctccttgtacattagatgattagacaagggaattttgtaatctgctgcatccgtttatcaactggatacgatgctgacaactgtgcaattccctctataaaaaacggttcatgtcagttttatatatactaatgtcagtgtgcaggcacaactgaattctgtattttaacatcaatttttgcggtttaaatgttaaaagaaaccaaactatgttcactagtgataccagaacatacttctgtacaggtgcatgtggcgccccgctggggcctgaacacgcatgccgccaagatcccctttctcggagacaccccgggcttgtgagcccatgagcaatgggaggcgccgccgcgcacctccgtcctggaaggagcggaccgcggacgcgctcgcaccggtgtcggactggctcgagtctacctcccccgaaccaccgcgcccacttccttccgcaactgcagtcgcccgcggtgcgtttgcgtagccgccgacaaccttcgcttgagtagaggacatggcatccaccgtcctctcgttcacggagttttctcttcgggcgcgcgaccaccccacgcaccaatgagaggtatgcactcccgacctacacttttaccttttttacatcaagcgctgcctcctgatatgtttggatgttggaactcatgcttcttttctggagatgtaatcatgcaaagtagtacttacatttgaagatttttgtcctcccttttttgcctcgtttgttcttccttttggtcgtagcaattagtacaagttactgtgtgcttcgatttcttcaatttttttcaggttctactacattggggatctgaagccccaggctcagcagttcatcttactgaacttcttttttaataaaaaggtggtatgtgtacatgaatcttgcccatttttttcctaagaaagtattgtccattttttttttctgaaaattggttcatgtgcatgcacttacggcaagagcaaggatgaataaatccttgtttttttttgtcctaaagcgctgcaaggatgcctaggaacaaatttcagatttttttggttggctggatgcacttgaattgaaattttctgtttaatgatttccccccatctcgtttggatgcgccaatttactctctatcattcctgattttctaggcaatttagccagtatacaatgtaacttttgcttcgctccgtccatgttcttttctctagaactagacaacaaattctcactgctgcaatttgctcttttgctgtcccaactcacgagtcacgaaaaaaaaatggtgtctgttgtgagaatttgaacacaacgtacttcattttttcattacagattttttttgtctatgtggattccatttgcaaatcttgtccatcaattgcccaataatcaaggaaatattgattacatgctatatttttgaactggcagctcttatatttcaaaacatgggcttgttgattttgtaggaatcattgtgtatgcagtgagaggacaccagctgctgatttgaggtgctgctcacagtcactggtttcgaacattgggtagagttcccaaaagagtggatgaggtgagcactcaacaggaaccatcaggcaacaaccatccttcagctatgcaagtatctatcattccaccgctatctatcagaatttccagtttgctcatttgtatattgtagtattacaaactatcttttgtttttattgtgcaagtatccattttcatcatgtagtgagcattatttttcagatccacagacattgaacaatataatatcgttctttcctaattaacttatcagtgaacatatcatgacaaaaatgttcttttgcttgagcaagtacttaataatgacttcccaaaatgtattacatgtgaatggtcagcatgttcacttctactccctccgtttcacaatgtaagtcattatggtatttcccacattcatattaatgttaatgaatctagatagatatatatgtttagattcattaacatcaatatgaatgtgggaaatgttagaatgacttacattgtgaaatggagggagtatcatattagttgtgatgcgtgtgctagtgaatttgctttcttattatctattactccttttattgggatttttcattcatgacactacaatttgtgcaattttattggtcttattcatttttttttgtttttttcacttttccttcagttataatacctagaagcattttttattttattaaccgatggatttgcaccatatctaatgcttgttttcccatggattgcactgattcaacagactacatgttttgcagataatacagtaattgcaaagtcatggcaggctttcttatgatacatcaccctaaaatcagaaaaaaggtgatggccacttttactagcttagtgggtcaaaagtcaaaacaagctgaagctccacctccactgtatcctagtatgttcatcaatacgggccaaaaaaattatgcttgtcttgtgccaaaagtactgggatgtgcccatcgaggctttgcaagtgtttacgagctgttcgaattactgttaggtggggtttattggtaaccggtatctatgtaaaaggtgcatttaacagtcctggtggctgatgttattttaagaacaagaaacctgacgtttcaagatgaatctctgaaatcatgttcagttgtcaaatacgcaaatggatagctgaacgttaagaatatagtaaacttatgttgcagttcattcacaactcacttcaactttccaaggtcgagaagtgttcccccagactcgcccccagaaaatgatctttgtgaactaaataaaaactgagatgaagaaaaaatctctctattaatgatgctgttacaagctatcatgcaggaacaaataggagaatgtaacacagaacgtgcgtacaaagtgatattcttccattcacgacaaacttaggtacatagatagtattcataatcagaaacacctggaaacacaaatttcttcctcgcagggtgcaaaccttttgcttggaggcttatgaggagagcatttccaacagcacaaaaccttcatcataggatcaatgctatcagctcatcatgtacgagatgtggccatgtgggcagcaagaagatgaaaaacattttattcttccgccgctactttagtaggctgatttagtttaacttgaaaatagattgccttattttttttgagaagtacacatgatattttggcctgcttccaggtgttagatgcttcctggaaggagaactacataactagaataggcatcttcatccatgatccaaaatcacacaatgcccttttttatcagagctcactcagtaatcctattcttatctcccttaatatatagctgaacctgcgtgtcttgtgatagcgattaaaagcactcataatctgaagatcgcagacccggtgcaatagtggtggaaactataaaaatagactttcaaaacaacccaaccaggtcactcgtccttgaacttgaagttcatatggatttaaagaaaataatagataaaatttaatttgggaccacaaactattcaaggcagtctgatctggactgggaaaaaaaaggaaaaataaactcttatcatgcaaaataaattaacagcaaatctccatatatcgtctcagtgaacagtgaacaaatcgagcccataagagaagtgagacagcgtgaaaagttttcacctatgataggtccagctaaacttgaccttcctctgctcatccttgttagccctgtcctcagtcagtgtacttcgtgttttctgaaaattattatcttgacatcatcatcatcatcatcattattattatccacattgcaactttgcgtattcttttttcattctgctaactctaggttttgagacttgagaatgataatggatcttgttgcaaggtagctttgttttccgtagattattcccttcgtgaatgctacggaacatcatcccgccatgcatccccatgctgtatgcgttaccgaataccgatctcctttgcaagccgtgacgtgtacatgcacgtatgcacattgcgagaatgatgacttaggagttactagtcgccaacccgagtgtttcacgggggttatttatcatcgtcataaatactaaaattctaataatatattggccgttttataagttatggcaatttgcattaatagagggtctacatcaattgctactccttatttcaaaatgaaattaacaaaatcaacttcaatatttttaattctggatttagaaagtaataggtcttgagaaaaaaaactagaacctaaagagcccatggtatattgtttatactgaacaattggttcgattaacagctctaaattcaaaaatagtaattgtaaaatatgtagcctaattatactttttccatgattgaataaatgtgatgctcagaattaaaattaaagtatcgaaactctatttgtcagtaagtccaaacttattatttttagtaactaagtccaaactctgttttctaagtatcttgtagattagttatttggattgatgtcgtttttttattgtcctgaacatgaattcaatgtgatggatttaatctggttatctatttgctttcttgaacacttatctgttcttggtgctggggttaactgtagatggcctgaaaaatgtacatgtgggatcaaccaaccaagtgttcagtagtatttgaagcacattccatctaagaaccacaaattttgtttttcattttggactactaccttagtgcttaaccccacggaggtttggtcagaagaatgttggaaagttacctcaaccactaatcttaattttactgatgtatatgcctcctggctccttatatcatatacttcactgttgtattccttacaggtcgtgaacccaaacgacgttattcccttctcaagatcagctcaatggaatcgaacatgaggtacctgtttatgtttcatgcacttcaggttaattagctgtaataaaacagtgaggaaattagaagtagtcttgatatcagctgactgggaaagtgcatcttaatccttgttgactaatgtgatctgttgtcactctctctttatattgcagaatgtacacactgatggttctgaagaatttgaaccaaatgacctggatcaacaaagtattgacgaactaatggcagagaataacttggtactgttttaacattctctttgtctaattctagtactgtggcatgttggtgtccttttaattcatggtggcatgctctattttgcttcaaatacccattcctctagataattccaggataatggaaacaaataaaaatgtactggctacatttaatcctcgttttacagcatacgcagattattgattaaaatgacctggacagtgagtgcactgcatgattttgtcaacattgtcagactcaacaaggatgacaatatggcgttctattcttgtctggataaaaacattgaagcagaaaaactgagatattaccatcatatagtgctaattatcattgtgcaatgattcagcacatcccctatttgcaatgacaaactatttgcttgggatttgcagaaaaagttgacctttgcaagaaaggattttaaaaccgaagacgacagtgtatgcaggtacagaggaactctatttcaggagttactagatttgattgcagagtgtttcggcagcaacaccattgtgaaatgaagtgagtgactcttggagatagatactgaatatgtatatatgtgtatgtttggagattaatttgggatgtgggtgatgtgactcatggagattgattactgaatatggatatatgtgtatgtttggagattaatttggcatgtgggtgatatgaatatggatatattctttgaattgatgtgggatttttgtgagtatttggtgtttgccctgcaataccatttttttactacagtattataggtgcttgtcatacacttcgaatcgacacctttgtggcttaataggtgtcaactgtaaacacaaaaccagcacctatgtgacccactgggccgctaggtgcctgccactggcaacaggacttctttgccgccaccttctggttctacgccaccacctaccagtccaccatcttcatcgcacatgggcatcggttctcacactgcggaggtcattgacaacaaagaatgtgacaccgccggcggggaggggaggatgctgcacccctaccaccgcctccctgtggggagcctgctgcctctccacccgttggatctggtagaggggagggcacccctgcctcctgccacccctcctcgggtgccgtcgcctaccgcctccccttccgctggatctggtagagtggtgggcactacagccacccgcctactcccagccacggtgaccactatcatccgcgagtggtgacggtcgttatagaccaatttcgaccgtcaatacatccgaaaataaagaagaactagcaatgcttgcatgcatatttgtttaaaaataatatattttcacttgtacttgcaaagtattggtgtacaggagatcttcgtataaatgatggagaaaggatgaaaataatcgttcgatcaatcagagctcgacgtgtggcacacttatggacgaatgggcccacaaacccatttgaacacctacaatttggcccaaccaccataccactgagcttaggatccatcaaatggattacaggagaaaggatgggccaaatggaccagcccagggttcggccgaaccgtcaccagctccgttcatcctggccttccacgtggatgtcctggattactcctcaatgacggttgcggggtgtttaggatatttcagccgttacaaccatcatatggaggctatctctctctccattttaacacacactaaggtggatcaagcaagaagctctctagttatttactttgttctagtgctaatggagtagaattagaatagtttcttagttcttcaagtcttccggagatttcgggtatagctctagtagctcttctatcgcttgtaagactttattctgtaatgaaatattattttttaatatagttttggtcatttactttacttatataattattcgagtgccgactttagttcatacttgactcataataattatgtagctagcttagtggagatatgtaatggtattggcttggtgttcatttacatgattgctctatgtcatcttcagagatatagagtaatatttactaatataagcgcgatgcttagattattacataccattaaatggtgctatatgctatggatctgtagaggtaggccgttgatggtgacagctcaatacgggtattcatccacgtgtgtaaatagggctaagagtttctcctggtgtgggtactcctccatatctattaccggttggatgaccatgacggattgtcgtaagaaactcgacaatcagaggtggtttctcgatatactaggagggcattgttagggggtattggcttcataattgtataatagcaagtgtagactaaataactatatactataagtacataaatgattcttttcttattcttttcgcacttagcctagattatcattttagtgagagtatccttctgtgtgtctatctatccttacccctaaaatgatctacataagtgatactacctccgtctcagaatataagcatttttagagttggacacggttaataagaaagtagatagaagtgaatgatggatggttgtgattggttgagtagtggaggcaggtgggaaaaagaatggtggaggattgtgattggttagaaagagaatgttggtgaagaagttgttatattttaggaaaaaacttgagggctaaaagttgttatattttgggacagagggagtataaattactagcatagtactctcctatcatatctttccttgggattaaataaatatgataccttgtaatacttctgggtgaaatgctacaatagtatatccgtgtacttgcggattatatctgtaacagtaaagaacaccaagtaatatttcgagcaccattactggaaattatatttttagcaatgtcattaagaaatatcaatggcgaacttctcgagaggagaggaggtgcacgcatacggagaggaggaggagggcaggcgaatggagggaaggagagggggaactcgagggatcaaggacgggaggggtgaactagagaagggggaggaaggtgcgagaaatagaggggtggggactggggagaggacaagatgcgagcgacggggacggggggtttatggggtgggcgctcgatcggttcgatgggggttcggctcgcttagtttttatttgtgccggttttttgtgcgattattataaaaaagtacctatagtattggtgcttcctttataaccagtatctagagtgtttaaaagagcctttttcaacacatgaagatgggaaaacgttccatgagccgatacctacggtggattttgtagtaatgaatagtgttggtcaggctggaacgaatgtatagagtgccaatttctctgctatcatcacagtggaaatctagaaatcaggaaagatcgtcgtaaagtgtcgtgactcgtatgaccgacgcacgggtgccatgtccaacgtccgtcattgattatgccagatcatagctgtacgtcgtaattgagatgacaacaacacatatcctataccttaaatgcagtatactgtacctacgtgatcgacccatgtaatcaactcggatatcaacatagacctgtacttaaatgcaattcaatacgatgacccgcattgtacggcacaatattatagaaacgtatgatcagcatgcttcataatgctataatttgtagatgatgtagtataattatatttaatcatttactaataatttttatatatacatgttatatatgatttctgatgcccatatacttacatgttaactaatgcatagacaagtagtcttctatgtaccaactaactaatagcctacatacacaagccttcccatgtatacaccgtgtacactaaccgatgatgcacagcatgtacacatggaaatttcttaacaagttgtacatatctatgtagaaagtttcatattcaaattcattatatagagaaaaaaagataaaattctgactaaaaaaagataaaaaaaagataaaattttttaatgcatctctaaaatataataaatttgagattaagatttaaaaagtaggtataatactgacgaaattgtatgcacaatttttttagatttttcgatgatatttgctagttggtacaaagtaagcatgcaacacttgtatgcatgggataggttcccactatatgggtttgtataactatataaaagatatacatagcgctgagctctagctgccgaaactagaggacaccgagttctactcttgcgtatattaggagtgctgtttttccgatcgatcaagtgaagaaagtaaaataagtggatcattccgaagagtaagtgatcctaagatctgtgcgcaggtatgtcaataatctgatatatatacacataaatatagtctgaatttctgatacgcatccatgaatctgtcagagacgagataagagttagttggactggcctgttttgcatgttcctttgccaatttttatctcttgtttctatctgttttcacataaccccagggctgataattcagtcataattggttagacgaaacgggaaacaaaccattcgatcgacgatgcgagaggaagcgcgcacgatggtggcgacgagaagcaccaccagccgccgttgcttgacgtggtggtggctcgcctgctgctgcttcgtttcttgggtggcctcgtcgtcgtggacggcggcggcctgtgtcgccgtgtcgagcctgcccgggttcgacggcccattgccattctccctcgaaaccgggtatgtatatatactgaatgcaaagcgtgagtacatcttgcagtctcaatatttttttttaataataaaggattatattaagtatcgatatgtatcgataagcatgatattgttcattcaccaagcgctatattcaccggtgcaccggagaagtagtttgggatggtccaagctaaaattggcaaaattaccgatccatatggaaaagaatggtttaaagatgatccaaaaggtaatcatgcaggagattgtgtcatttagcatgtaaaacaatactagtgattgggcagcgatgatgggaaactatgcacctaattaagatacatagcatcgaggtatcacacatggtactcatagatatcatcatatcaaatcagatacctaagtattagacctgataccccttagaaaaatagacataccaacaagttctaaatgaaataataaaacatcaaactttagtttggatagatccctattgctactcatgtgagataaacacctctaaagagagtgatattctccaatctatgacttgccccaatccaaataatagtcctcctgttggaataaaattcaaaagccatagaaagaactcaacaataccacattgatagggttagatgaatttctaatgcaaacaatttcatttctatttaaccataccgctgaaaatataaaaatggcactaccaaaaatttgtttttgaagaaaaggtatgggtccgtatatttctccaatgaacgcagtcaaaaaaaaaaaaaagaacgccggtctaccactggtccaagaaatgacaaacatataatgcaagccatggatacatcatgtgcacacttatgaccgctgcaggtacgtggaagtgaacgagagcactggcgtgcagctcttctactactttgtccggtcagagaagaatcctgatctagacccacttttgctctggctaacaggtgggcctggctgctctagcatctctggcctagcccatgagataggtaatactccgtccatctacttttgatagtcatatttcatcttggcacacaaaccaaggataagtgattctacttatcatccatttaaacatgctactagttattcctcatgaacaagtgattcattaatatttatatttctcgatgtccatgtagccaatcttgtatgggagaatggagagtcacgcattaaatccgagagagtcattaagatgataggttgttggattgaaatatgtctatcaaaaataaaattttcagatttagaaatatgactatcaaaagtagatggagggagtaataattatcgtattattttttcacaaattattaaaaggttctagtgagtttctatggataaccaacatatggtgcattgtgcatataggttatgttgcaatgcttattctactttaacggattgttgatgtgcatgtatgctcttgtagggccatttcaattcgctgcaaaacgatactatagtggaggattgcccataattatctaccgaccagagacatggactaaggttgtcgcctgcatatgccaaataccatgtattagcaaataagttccatgttcaatttttagtggatgtgtatctctctctttctctgaaaatgaaaaggggataagcccaattgcatattttaatggatgaattgtgtgattttgtaggtaagcaatataatctttgtggattctcctgtaggggcagggttctcatatgcagccacagaggagggttccaagtctagtgataccaatgctgtgaaacaacttctaattttccttagaaaggtaactctgtcctgaccaattcctagaagaacaactttttactctatttgtcttgtacggaattggttttcttttctttcgtttcccttaaaggctttggacaagaatatcctcacactttgcatgctatttgattggattacctttacgatgctctctactggtagtattatactaccggtataaatgatctacaccgtcaatttgtgagggtacgatagtacttcccatatcatcgttcagtgggcatttttgtcctttccaaaatatagtctatcacaaccgaatcaatctcacattcgtaagcctcgtaccatacatccatcgctgctccgctcgggtgctgtaaattcacatacaacatttcctttactggccccttctggttgtgccactaccatccgtcgctgcttccttcataccgtgcggcacgtctgccatcttgccgctgggctcatctcctatgggcattggctttggctttgtcggtgccaacataagcgtgtcagtctttggtccatcgcatgatgcctcatcgcttcagataaggaactcggcccctatattttgatatgtattaataaccctcgatttggcggaaattcgacatacatgatctggcttccgatcaatataatctgaaccctgaaatcataacatcacatattctctagttatcaaccgtgccaaaacatgattgaccatgcagagaaggctaatccctacatgcaaatcgaagaagacaagcaagaacaaggtagatggcaactcgattgcaaatgagtgattaagcacttgaattttgggttctacaaaccaaactgccggtgaaactgcaattcgtagaatattctaagcctactctactaccttccacaatcgtcaggttgtagttatccagagaaatgcctattgtgtctttcacccattagcatcgatgatagggatctggatgtttactgcaatttcttgtatgatccctagtgcaatttcttctcgtccgttgtgttgaatgcctcaacacgaactccactattctgtgctgagcttttcttgtcctttattttcatatccgttaatgacataccattgccatgaggtcactagacttgacaggccagatgccagtctttctaaagttattttccttcatggattcaccaatagcaggctttgatccaacaaccattgaggaaagcattgcaggcactaacctcattcatgtgttgctcaatatagggctcaatgatggcgagttgttgcagtacgttgttgtctgcctccgctactgctttgtaatcattatcaaataagcatcttttgcctacggcccccttcccagttaaccttccctcgtatctagccatgggtttcctggtggaattgacatcctttatgtaatctagaacgcactcaaccagttgtgtacccctatgtcatcgatccctctaagtaagcatgattgcggacatacccttttagaatcgatatgtaccactcatacacccacatttgatgcaagtatagcagaccaagttcgtaatctgaaggacaatatgaacaatcagatgctccatcatatcaaaataagatggaggaaaatacatctcaagttggcacgctgtctcgattgtgaagttctggattggtcctaattccataggatcaaatattttctaggaaatttgattgaaaaagtaacacatctttgttatcactaccttcgaactagcttgattgtccttatagcaatagggagaaagaccgttagcattatgacaatcatgagcattctgagatggtcatatctttcattgagactagcttcctgatgttcgatgagaaaccaattggcattcacccaattcaagtatttacaaaaatccgtttttcttttttggtgtcatggagtagcaagcaggagaatcttgtttcccattcgccaaatcttttgggtgaaggttgttccttatgtctaaagttaccaagtcgttacatgaatccagcctgtgcttcatcttactctagatgtctattaaggtgtcaatggtgctatcgagcatattcttctcgaggtgcatgatatcaatggcatgatgaatctccaggtcctcccagtacagcatgtatttgaagaagatagagtgcttcctgtaaggcatatattttcctccactgctttcttcctcttgactacttctttcccttctcaaacgcgatcttaatattctttgtcatatcgaagacaacactaccacttcgttttgcggtggcagactcgttctctattgtattgtcaaaacatttggccatcgtacaatacttgtttctggagtaagaaccgttgatggcgtatgtaagctatcttgcttgaggatgtcacatatttgtatgacatcttgtcaagatagataagatatgcagtttaccttttaatctggccaaagaggaaaatatttgcaagcaggtcaatgatgatcacgaatatgatagcacatagagtaaagtactccagttggtatacatcccacattcgtaacccttcttgacatagatcttccataccctccatcaaaggttcaggaaattcatctatggtgatgccaagttgttttggaccttgtataagtatagtcaacaaaatatactttcccttatgacaatctatgtaggaaggttgcacatggtgagcagaactggccaggtgttgtgtgagatgtatatgtcaccaaatgaattcattctgtttgtgctcaatgcaaaccttacatttcttggatccataggaaattttggatgtagtgaatcaaaaacttccactagtgagcatccgttgggtatcgaatcataccagctactttccggttatcttgacgtcatctcatcaacttagcgtcgttaggctttgagaacaaatgctcatgcgatctttcagtgcaggttccacatcaccatggccaaaatctttttctttgtatgcctgatgaatctggttcaacaacctcactgtcagaggacccactacccattttgtaacgactttaattttctcacaggtgggacaattgtctgcattacacatgcatgaatcttttgaacacctagagataatggccatataagtttattcgcttgatatttgttggatggcaataagttaggcttaggaagtaaaactctcaagaaacccatcaaatcattgaagctgctattggaccattcatacctagccttcaatataaagagttcaagcaccaaacgcaacacgtataatccttctcatatcccttggattcttcataaagaagatcctccgttggtttctataatgcctcttagttgtctaatccccgtgctgtacccataagaacctctggtttagcgtggtgcatcatatcttctagactgaattctgcctcaaaatcgtcactactagtcgaaccatcttcatccattctttcaagggccatgtcatcaattgtaaaatcttctgccccatcaaggggaaaacaagtctcgtcacattccatgttactgtcaccttcaggaacggtgatttccccgtgatagccataccctgcaatcctccttaaattcatgctccattgagtacaccaatattgtactggggtctctcaacaatttctgattcttgcaatcaaagaacgaacaaaatatatgtctttcctatttttccttaaagcatgtgccttagcatggtgaacaaagttatatgctttcttcataaatgccagatgaggttgtcgcatgtcttacatccaggcctaaatcaatctataaaacatggcagtacgaataaaattagggtgaaggtgttccccacaaaacatgaaaattcatgtatgtccacaaaattatgcaacactacattgaatcactatgaacctgtgcttacaataacaatttgctcacctaaaaattctttattgtagctaaaatttgcaaaaaaaaatgctcataaaagtacccttattaactgcaaaattcgctgcatttcaccaatgaatttttttaaaaaatggctgcaattgaaggaggtaagcaagtatgtaacctactataccaatttgaagcaaagatttcaagttggaaacttccccctatttgttgctttgttttggagagagaaacttcaagttcaaatggttgcagcttaagcttgtttggggatataatggtcgtattatcacatgcgggcttcttaaggggccgtatgaattatcacattattaccttttttacttctctcatgttaattaaatgatattatattcttaagattttttttcactcttttttcattattaccattcttactcctatccagttaaataaatgcatgcactgcctttacttttcaattggtcattaataaaactaacactatgatcattgaacaatgaagacgtttcaaaaatgtattgattgcatgcacaatgtaattatgaaaaacaatactgtgatgaggattagtttccatttgaaatatggtgccacgataataaaaacatagtgttatgagaccataacccattgatctacattgcccctacatgtataacagatattccgtggatgcgtgctaaaagtgttgctttatacagtggcttcatgaccatccccggttctcactgaatccactctatattggaggtgactcatatagtggaatgattgtacctacacttacacttgcaattgacgaaagtaagattctttcattatgaatgtataatttccttagacttaccacatacatttagagggccttaagattgaattattagcagtttgggaaatatattttagtaaattcctaatctcatatcgggtaacggctgtctgtgaatatagattagtatcacaataattataatatttttttgttactaaccaaatgctattcttgttgtctagaatctagatatatacaagcacaaaaattgtagttttcatgtttacgagttgggacaaatatggtgttcattttcttgtatcgactaactgcgcatgtacacaactattaactagtgaatatgtgtctatatttttcaggcaatggttcagaagaaaaaccattttttaatctcaaggtctgatcttatcagattatgtcaatcatgaaattttatatttgacatcttaattgcctcaatagtctatcttgcattccttaaataatttgtttcttaatgggcacaatctgtcctgtaattaactttccttcaactaatttatttaccttctgtacataacacagggatacattgctggaaatccagtgacagattacaagattgatgaagatggtagaattccatttctgcatggcatgggacttatatctgatgaactttacgaagtaatccattctctagtataactttatatgtttccatatagtacatactgcatatctttgtaggcattgccaaaaaaaaacagatcaagggccaatactatagaaaagaaccggccataggtgccggactttcaaaccggcacctttgaggttctagaaatgaaaaaaagggctcgatgtatcagctcgaatcatcgagcagctccccttcaacccgatcagaatgaaaattttaatcggcatccaaaaatatctaagaatacaagaacatccaataacactaagagcacaagaatggcccgatgtcgaggagggcgtcatagccgccgccactgctgcttgggaagtccgccacctcccctcccattggatctgttggaggggagagcaccgccgtctctgcttggggagcccgcgcctcaccttccgccggatcaggtggagaggagggcaccaccgacaccgtcaccgtcaggtggggagcttgccgcctccccttccgcctgatctggtggagggaagggcgctgccaccgctgggaaggaagagagaggcgcgagagccgcaggagcagattaatctgctcccgaggataaggttaacgatcagcttggctcggttttttacgcttgcctattttttaaaaaaccggcaccaataatcattattgatgccggttttttaattaacttgcacctacaataaattaatggtgtcggttttttttcaaaataccaatgcctacaatcgtttaaatgtgcttttttttcagcacagaaaagtgagaaaagatctataggtgctagttttagcatagtcgacatctatagctagtgtcgtcttctatgtgcatttctgaagtggtaaccatatatgcctgaccaccatggcacagtagttcttttcagctcaacggatgaatagatgatggattatctgcttttctgaaaatactcaattaggtattacaatgttgaatagtttttttttaaaaaaaacgacttgaatagtttttttaaaaaaaatattcgactaaacttatatataaatatataactttttacaaaacagcaacatttagtagcttgggtaatgtgccatctttatccattcatgacagtatgacacacgaacggatcattagacactaactgtaatagttctttcattttatatataatcaccactcaaacaaatttcctatcagcatgcaaaggagacctgcggagaaaaatacagtgctccgagcaatgctcaatgtgcgcattccgtccaagcaataaacgatgtaagtacccccaataaaaatgatctctattacgccgctgtgtgtatagaaacatcaataatttattcaaaattactgtatatagctgtctgttctgttgtattaatattatagtttacaaattcgctgacatttcaccaaccatttagtgcacaaaggacatcaacaggggacacattcttgagccattatgtgaagaactccagagccccatccataacactgcagcgagagatgtaatgagtaggctcatgctggagtctcgtcctgctgctgccgatgatgacattattatatttgagtgtagagttgcgtgcataaatattattacaacatcatacaatcccattgaattcttttttttcccctcagtttctttggatagttctcgagctaaaaacttttaattttggttaatttattgcagaaagcttcccacgtgttattaaaaatatgggcaaatgatgaaacagtaagggagagtcttggtgtgcaaaaggtatttgtactatggtactacctatatttgcacaaggcctaagagaaagggtgaaatctgcattaattccatgatagttgtgcaaatatgatcagtgtaatttcagaaaagaactgctatgcaatacagggaacagttggagagtggaaacgatgcaatcgcgatatagattacaatagcgatgtccgtagtacagtggaatatcatttgacgctaatgagaaagggataccgagcaatcatatacaggtaattcgtctttcggtactgatttgttggactgatttctcttaatcatataatatatattcaggtgtacatacatggagttaactactacagtagaaatttaaattcttatacaagatttttgcagtcacaaactaagctatatatatctataaatccccatgtttctatataatactatattccaatgcaaccttgtggttgagatcaaaataactcttctcgtcgatagtaaacaggttaacccagatacgtggattaatgttttcatgtaattaacgatgcagcggtgatcatgattctagagttccctccattagcacacaagcatggattagattacttaacctttctattgctgatgattggcgaccgtggtacgttgatggacaagttgccgggtaagtgtttccgttaacactcattgttaaaattatacttgatatactatgctttctagtgtgagctacgcactgcactttgtagcatgacctattttaccgtagagatgatgtaccaagaggtatcataaattaacttagggaacaaatctagcttcaggagttgggtctgcactagagttgtggagcagcctaaacccagttccaactctctagttcattttatgatagagctccacccagctccgctcccattttaggtggagctgaaactgtttggctgagagctgaagttgtgctaaacatgccattaaaaaattatcgcaccaccattatcatactaaggctatatttgggaggtgttgggaacccctcctcctacacataaaacgatgtaagaataattagtattagcttttttttttgaaaatggtttaatatgattttttttaaaacgacttatgtatagattttttttataaaacacaccgtttaacagtttgaaaagcgtgtgcacgaaaaacaaaagagataagttaggaaagtgaagaaaataactcagcctaagaatgtatcatacaatcagttacacttctagtattaatttggtgtctgttggtaccactggaatagaacgtgatgtcacgaattagaccttttacaattagcccttatggtcttatggaaatgcctcaatttctttggtgagtatagctaccaagaggtaaaatgtgtatttcaactagagataatattacttcacagtacttcattagagacattcaaaggtgtgtcaaatctgttaatgtgaagatatattgtcatgcttaactattatattttatcagaattctaactcatcaatgaaggcctgctggtatagtggatcatgggtggaagatgtgttttctattcctatatatgatgatacagttggatattgttatctgcttatttgtccaaaataaacatacttatttattatgttctagctgtttgggacatatgctgatatgttttgcttgtatcataccctaacttggttactttgttttgtagattcacacgaagctttgcgagtaataacctgacatacgcaactgtgaaggtgcattttcatatatgcatgttattagagtatatatatacagagtatttttttagttcatgcaaaaatatcaatatactaaaacaagcgatacaattagtcgtgatttggatatataatatttataatcttgacatatgtgtataccaatgcagggcgctgggcatactgctgcagagtataaacccaaggagtgtcaagagatgtttgcaagatggatttcaggcactcctctctgacgtatattgttcaagtcacctgtaaaaacataatcaaacgatcatatgagaggtaaaataaagatttgctgcttgtaataattactccgttcgggctgataatacttgtcgttttggacaagagtgaagttaaactctagaatctttgattatgaatcattttaaaaatatttgtcttccaaatatgatgactacatgtatagattagtcttaaaaaatactttaataagatcatatatttgctaacaattttatatatattatgatgaaaaatagtggtcaaaattgttttttggagactgtgcccttgtccacaacaacaagtattatcaacccggagggagtagtaatacacatgatggtagcatttaattagtaacaacagaaaaactgtgacacgtttgcacgaaaattcttaggatcggtcgaccgggtgaggggggaaatcggtcgctccccctcccccaacacgcgcaccccgctgggtgcacccacctgtccctccctttgttccaaaaaaatgtttcacctaatgtacttacaatgttgaaacattatatagatctaatgttgcagtggattaaaatattcttttacaacaaatcacccacatattttgaaaaccttctattaagggaattcgttttattttttgttccaccaaaaatgtttcacctagtgtacttgtaatgttttactatatatggatcaaatattacagtgaactgaaacattttttttaacaaatcacccacatattttggaaacccactattaagggaattcgtttctttttttttccaccacaaatgtttcaactagtgcacttataatgtttcactatgtatggatcaaatgttggagtgaatggaaacattctttcgctatttgctgaaacattgtgtttatatatggtgaaacaacgcccgatttaaacgattgaaacattttcgatatacttagtgaaacaattccgatatactttgtggaacatccactggtggagaaaccctttttcctcccggttcgtaaccaccctttagtcccggttgtccaaccgggactacgaatccgggactaaagatcgttatttttagtcctgggtgaaataaccgggactactaaagatgggttagccatgtggctggctgagtcgtctttagtcccggttggtattaccaactgggactaaatatcgagctaccttttttttatttgcatgggcttgttgctgcatggttatatatatatatatatatgtatatattaaagcacttaatattttatgtgcatatataaccaaaatatatatttacattaaagtaaatgtgtacatatgtaaaaatagacatgtattaattacaattcattatgtcctagctagcttcgacttcgacgtagtagtcgttatctcagaagctaacgacttatgaattgtattttcatcgtagtagaatttaccctcgggatcaaggactcgttcgttgatgaatcccatgagttgttcttgaaccgccgcgataaattccttgtgtgtgaggttatccctcatgcgaataacctatgaatgtatgaaattaattaggataaaagaaatcaatacgtacgcaatgaaattttgaatgatttatttttacgtacatcgagctctcttgtggcaatgatttgggttgtaaggcagtggcaatactagcattcatagtatccgcacaagttagttccctcttcctgctttgcacactacatacatcacaaacgacgagagatttaattaatatacacttatatttgaattatagattgaatataaatttagatcatgtactcaatgcaaatttgaacctccggcgaaaaattttctttccaagtgtcgcagaccaaatgacggaaccgataccaagccctacatggagtttaaagatatgattcgtactagcaatagcaaaattcgtaataataacactggaatatatgacattacctgtctataagttcaaaaacttggtcaaaagtagactcatctttattcattgagtcatagacattgactctgcattcctccaagtcaaagagtaaaaggacctagtggaatctgcaatttgtgtgaggtgatatatgaaacactgtacatctatttgtacaggaacgaaatttgttcggtagacagtaaaaactaacgttgtgctgtacgacagtagtatgaacgtcttgaaatgctactccttgaggagatggtcaagattgtcctctgtggcttgcggatacttggtgaccatttcgacgtttattttccgagggtcgatgaatctagtatcaaaaaccccccgccgtcgggccctttgaatctccattctacaacgatataaaggaattgttatatgaggtgtacatatatacaaggagctaattaaaggaatgtaagaaatataactcaacgatacctagaaaatccatgcgctcagaatagagacgtcgagggcgtccagctggtatagtttgtagatatccttgaaattgatccagagaacatcttccccttgtaagaagtcagtgttcttgatcctcgctccgataatctccctaccgctggcgctcatctccatgtaccgttgatggaatttgtacatctgtgttggtagggactgcagctgctcaggctttacaagcggtttaccgagttcgtactggtgtctcacttccgcctttgggattggttcgcctttaagcaactgagccctagttagcccagtgtcagaaatgaattcttttattccaatttcttgccaggtcaccaacggctcgacctcctggcttggttgctctccaagctgagggacttttttggacttcccataatatgctttctttagtgttcgcttgtagtccgttagctttatggcctccttgactggtgccgacatacccctgaagaacttcttggcactcgggtgtataggaatcttcttttctagactccgaggcttcaattgcctcttcacttctgctgccacgtaagcgtcaagctcctcttgcgtgcagtcgtaaggtggctccttgttctcggcggcatcaactttcgccttcttcgttgcccttgtgcgggcaggtggtggagcttggtgagttcttgacttggaaggtgctggaggacacggcgcgggagcctgaggagaagtcggtgcaggagcctgaggaggagtcggtgcaggagcctaatcatgaggagacagtgcaggagcctgaggaggagacggtggaggagcctgaggaggagacggtggagccagaggggatggtgcacgaaacgccgcttgtcgcctagggaggatgatgtagcgcttgcgccatagtataatggcgtggcttgtgtcgcgtagatacgtctcaccgtctcctctagggtactccaactcgaggtcctcgtacgtggcttccaccagctcaatttcgaccctcaagtatcctgcaggaatcggcctgcagtggtaagtccctgaagggtccgttgggatggccattcctgatgcaaccttcacgtgatgagaggttatctattagtaatcaacctaggcagaaacttgcggaatgtacaagtccaaaaaacataatactacgggcataccttgattgataagttcttgaagggaatatgcagctcacatggtgtccgctgcatgatttcatcaacggggcaggtggtttcatcctgagtttgcatggcatccatgctctgtgatcctacctgccccgttgaggcgtagttgctacgattgccctgaggggctgaccattataggaggaatgtacgactggggatcctggcaccgatgtgcggccatgtgttcatccatcttcctttccacctcctctttcatgctgagctcgtagctcgataccctgtactcaagatctgcaatcttcacctcagtatctctcttgctcctcatccgactcctgtacgtgtggatgtcctccttgaatccaatcttccaaggaaccatgccttttcctcgtgttcttcccgaatgctcgggagtcttcaaggcgagtgacagctcgtccttctctctgtcgggtcggaacgtgccctgagaagaggcttccactgcgtccgttagtcgactggcagcctcgcgtatctgatcgctgaacaccagggagccatcaacggggttaagcgttccaccgtgagcatagtattagaacttcgatcgatccggccatttagcggtggccggtttgatacccctctcaatcaagctggcctccatctcctcccacttcggcattgtgacgctatagcctgttgatgtaaaaacacgaggcctaggagatctgcttaactccaatgcaggcccaaaagcttgcctttaggtgtgtgagtgtgccagttgatttgatcctgcaatcaacaagaaataaagacaaagaaaccgcggttaaatccataaacgatagccgatcggctagttgccgatgacatatcatttatttttgagacgatgtcatatgtgaattaatcggcaatcatggataaataagaaagaactaaatctattcgatcggctatagatgttaacaatatataattcttatgtcgatatatacttaaatcaagtgattgggatagatcagttaccatgccgagacagtataaatcacttagatcgaaatatatattaacaacaagactatatatgttcatagcatagctgatcagatagatctagcatgtatcggctaatactccgatactactctatattaagatattaaagcaagtagaatatactaaacaaaagcctaaatatacttaaatgcaataagatcttaatataaagggcagatttaacatgtcaatcaagcatataggataaaagtagttaaatcaggtaagattggctgaaaccctgatgctaccctaatcggcaaccaaaagcaggctagagattgagattctaatcacgacttataaggtcaaactcaactgatggagctataagtatgaaaagaagaacaatatatagacaatcaagccgctggttgtttcatagagtggtggatatcctatataatctaagtcaacattagtatttaacctgatcggctaccttctagttgcagacgttagccgattggaggttagatgacaatattggtagagattatatagaatatatgataactcgacgaattacataaacaagattagagtatcataaagatggaagcactaatcccgagaacgcaaaccgccataacaagttttacttgtagttgaagatcgaaaccgttgcagctcaacccgaaagcaagaactcgtcgaaacaaaatgaaagtaaagggtggcgatgcgcaaagattgtattgaacgtgtgttgttatattacatggggcttggggtctatttatacccgagattacaaaatatgtccgtgtcggacatgactcttatctctaacaaactctaagataccataagtctttgcggcagacttttgcccaaacatatctctaaggaaattacatgaaatatcctaattagtagatacaattgccttctcaggactcaatccgtgcgtagcaatcctcatgaagcacgttaacccaacctgacaacatataccatgtcacattgttggattcggctcaatcggctaactttgtccaactcggactctgccgatcccagtcgcagccgattcagactccagccgatccttactctgtttccggaacgatttccatctcaaattccgctttgaccctatcttcatctccgatacttggattaccaaatttggttattaacacatgccccccaagtccggaatatttggtattgtttcggatttgccatgcccgtgtctccgagagtatcgcttattgccgtttttccgaccgttaccatggatctcccacaggctctgataccacttgtttttaaaaccggcccgaaatcacatcggaaacaaaacacggaataaacaccataggagatccaaacacgatgacggcaccgaggcacgatatttgataacggagttcagccgaggcctacatctccggggcacagattacgggcgttcctccccgatccagcatatacagcgtatcaaagttacaacgactcacggccggtcgccgccggcagccgtgcgtatcagagttacagcaatgctaagtcgccatgcggttacaacaggcacgctcctctatttatgagagatcctaggatagagtccgactcatactctagtcctaatacctattacaactccaagtcctaaattgtaactcactacgtacacatattcgacacaaattctaactgagacagagaggtgagaggcgatgccgtcactgtcgtcggccaaagtcgtggcaaccgcggcgaggctgagcagccaccgccgcattcacaaggtcgccaccatggccaccagaagcccacctccggcacaagaagggtaagtgactgaccgactagcgatttttcttcttccccatggtgtgtgagcttgtagatcgatcgagctagctaacagcggcgagcggcggtgcaagggacgacagtgtacttcccgttgggagagccggggccacgccagacgacgagctggaaggcggcggcgccgccggtgaagctgctaatgaacgtggagaagctacggctgctgacgaaggcggggacgacggtgctcctgtcggcagcggagcgcgccgggctgtcactgtcggcggtggagtggctgggtttgctctacaaggcggaagagctggaggtgctatcggcggcagaccgaccacgggacacccggcgcgctgctcggcgtcgcgctgctgctgctcgccgccggcaccgccgttgtctacctcgtcacggaggagtacccaagggaggtcgccgtccagacagtggtcgccctcgcatgcgtcgttggtggctccgccaccttcgccatgtccagcatcgtgtccaagctcccgagctctccagctgaagcgattagagatgctcattgccttgcgtgattacttacaacttaatttggaattagtgtgtaattaagcagagtgctgagcctccgacgaggcgacgagagacacatataggtgagaggggatagagagaacagagaatatgataggtgggctccactattttttaaaataaaaaattactgactagactgtcacgtatgctagttgaaccccaaaccgctcgcaaaagggtgttttattcgatattgaaagttcagggtaatcgatgtctgattttcgagtttaaggggattgtcatgtttatggataccacaaacctaatagtagttaactaaacttggcagggcccaccacataccatgtcttatacggaaacaaacctcgtatataaaaggagtttcggataagaaatgacaaatatagttctacatggaaacgataaagactaatcggattgtatccatattggtctctctagtcttacatggacaagtgggcaaccatggtataaatacaagcccctctaggaggagagaggacacacccaccataatctacgaagccacaagatgccacaaagccacaagacgcaacatacacaaagccaacacacgccgccagatctcgacatcagagattagcctagacataccccatccggtgcctacgaaggccagaaagagggatctagcgccatctctgatctcgacgagttcatattcgaggaggaagactaccttgtcgtcgactacgagttggttatctagccgccaagtcaacaacagctagatgggttatcccaattgttgtacttgtatgattcagatgaataaagaagcaacaccggcttcggccaacaggatgtagggctattacctgtcaaataaggggcccgaacctatataaaaatccatatctccatctcttttacctcaatctcgcatataccctagtaccaacgatccccatacatccaaataccctagtcgtgactatcaaacatcgacaggggtaaatcgattggccgtgatagttcaggggcaattcgtacttttctgttaacctaatggctgagaagaaagatgtatcaatcaaacggttggcataatctctacagtgggttccaactatgaagaagtttaatggtgtttgcataaaaataaaaagtaaagaaccaacacttcgtagtgaaaggtagtatgcaaaagatacttatacttgattgagatacttagataggaaggataaaaagataattttactggtcaataagtaagagtaggattgtctttgacagtagtgatagatacataggtaagggtagtattggtaattcttcagtatgggttaattcgtcctcatatccattacattatttgcgtgattttttcagatttatgtattgtgcctaaaaatatgatagattataatataagtgattgcatcagttaaaatatgactgaatcttgcttggctgggcctttgcctcactgctagttgccgccggctgccctgttagttgccaaagccctcaccgttgaacaagcacatgccagttgccatcgccagtccacgcctacttggtgtttgctatcgttggtcgtctcccgctgtcatacagataccgttcgagtctccgcacttgacacagaccgcaatggtagataagggaaacaggaattcgggagttatggtttttagccacaaacaagtaaagattttaacccacttcaacacaactatgttagaataggtgttgttagaataggtgtcgaatatactagtcctatttgattacagttggacttagagttgtaataggtgttagggggtggagttacagtcggactctgtaatccggcatctctcttaaatagagaggggcgcaccacaatataaccatggcgactacaatgtagcgtagacacacagggagacgatggcggcatggccatggactcgtagcggctagaagctatattggttggggaggagcgcgcataatcagagctccggggatgtaggcttcgactaaacctcgttaacaaatatttttgttttcctgtgtcgtcatctggcatgtcttgggtgaataatgattgaagcgatcgggaaggttagtcgtcgttccgctatatcaactaacttttataacaagtggtatcagagccaaaggtttgaaacccggaacaatttccatgggtcacatggtggagattgttgggcccgatgtgtgatggggggaaagttgggtttagtcccacatcggtaattgatgatgggggagcacgatttaaaaggtgggggcggtcctcacccatcagactagtcttttaggttgtgtaggtccaggatctaaagttatggctccggttgggcctgtggtggagcaggcccaatatgacctgtgtggcccacggttggtgagccgggctacgcactctaacaaactaaatgcaagatctttgttctttctttcccctaccgatctaaataactgattgagtgatttacattgcgtttacctactaccgattagattgagttgacaataatccccttcaatgaaatacacttgttttacaagttaattactttacgtttctctattttttaatacctctacatctcttaacaccgtaaaacttctaccaactactatatagtaggaagaaatgatttgactcttgttcgagaatacaggtttgcatggatgaaagattacactggtggctgtgcacagccgatccaaaaattggcaatgatgctggttagcgctggtctttcccgttgcagtacacagtacacatgtgcaatttaatacgggccaaccagcatcataaaagttcactgtcggggggcggcggccaccgacaaaagattgatgcgctagtgggtgttctcctcatcaacttccgaggggatatttaactttttttactcatagtatatagcatgtggact
